United States Patent 7,504,493 (CHARACTERIZATION OF THE YEAST TRANSCRIPTOME) - sequence listing, part 4

SEQ ID NO: 12214 - DNA, 666448 bp, Saccharomyces cerevisiae
caccacacccacacaccacacccacacacacaccacacccacacaccacacccacacaccacacccactactctaaccctattctaatccaaccctgatcaacctgtctccaaacctaccctcacattaccctacctctccactcgttaccctgccccactcaaccataccactcccacccaccatccatctctctactgtcaccagcccaccgtccaccataaccgttaccctcccattactcatatttaaccccactaccacttaccctgccattaccctaccatccaccatgtcctactcactgtactgttgttctaccctccatattgaaacgttaacaaataatcgtaaataatacacatatacttaccctaccactctaatcccaccaacacatcacatgccatactcaccttcacttgtatactgatatggtatacgcacacggatgctacgtatataccactctcaacttaccctactctcacattccactccatggcccagtctcactaaatcagtacgatgcactcacatcattattcacggcacttgcctcagcggtttataccctgtgcaatttacccataaaacccacgattatccacattttaatatctatatctcattcagcggctccaaatattgtataactgctcttaatgcatacattataccacttttactccatatactaaccattcaatttatacacacttatttcaatatacccacaaaatcaccactaaaattacctaaacataaaaatattctactcttcaacaataatacataaacacactcaattgcgtatctataccaccatgacgtcattaacgtaaaagttccttaatattaccattgcttgaacggatgccatttcaaaatatttcgtacttacacagaccatacattagaataatatgcacctcactattgtaacactctttattcactaagttataatatagtagtggctcacactcatgcgggtgctatgatacaatggcatcctatttccattcccatatgctaaccgcaatatcctaaaaggataactgatgtatctttaatcttgtatgtgacactactcatacgaagagactatatctgaacaagacgatactgtgataggtacgttatttaataggatctataacgaaatgtcaaataattttacggtaatataacttatcagcggcgtatactgaaacggacgttacgatattgtctcacttcatcttaccaccctctatcttattgttgatagaacactaacccttcagctttatttctggttacggttacacaaaaactatcgcaacccagaaattttgatattttcagtgtcaaaaaatgagggtctctaaatgagagtttgataccatgactccgtaactcgcactgccctgatctgcaatcttgttcttagaagtgacgcatattctatacggcccgacgcgacgcgccaaaaaatgaaaaaagaagcagcgactcatttttatggaaggacaaagtgctgcgaagtcatacgcttccaatttcattgttgtttattggacatactctgttagctttattaccgtccacgctttttctacaatagtgtaaaatttctttctatgtttatcatattcataaaatgcttcacgaacaccgtcattgatcaaataggtttataatattaatatacatttatataatctacggtatttatatcatcaaaaaaaaagtagtttttttattttattttgttcgttaattttcaatgtctatggaaacccgttcgtaaaattggcgtttgtctctaatttgcgatagtgtagataccgtccttggatagagcactggagatagctggtctcaatctggtagagtaccatgggacaccagtgataactctggtgacttgttcagctggaataccagtcaacatggtggtgaagtcaccatagttgaaaacagcttcagcaatttcaactgggtaggtctcacttggatgagctgcttgaaacaagtagtattgggccaaatgagctctgatatcggagacgtaaacacccaattcgaccaagttaactctttcgtcagatggagatagagtggtagtggctggggcagcggcaacaccagcagcgatggcggcgacaccagcagcgattgaagttaatttgaccattatatttgttttgtttcttagtgctgatataagcttaacaggaaagaaaggaataaaaacatattctcaaagacatacagttgaagcagctctatttatacccatgccttcatcagtcatcactacttaaacgattcgttaacaagtgctcatttagcacctcacatatcctctatatctcatctttcacacaatctcattatcactatggagatgctcttgtttctgaacgaatcatacatctttcatagacttcgtatgtggagtactgttttatggcactcatgtgtattcgtatgcgtagaatgtgagaatgccaattatagggtgccgaggtgccttataaaacccttttctgtgcctgtgacatttcctttttcggtcaaaaagaatatccgaattttagatttggaccctcgtacagaagcttattgtctaagcccatattcagtctgctctaaacggcttccatgcaagaaatatttctatctcttgaattcgtacaacattaaacgtgtgttgggagtcgtatactgttagcgtctgcaaattcgtgaattctccgcgaatgccttggtgcaattacgtaattgtagccgctgaaggcggatggtattgagagaagttgatgttcaaagaatcgtgtatgataaaaataaaattgtaacagtttataaatactaaactttacttgaaaagtcttttagtccgaaaatgaatgtgggaatactaattacaagcctcccatggcacttcttcatttctttttgactacgaacatggcactttttcaattaattatatttaataaatatttctttttacttaaattttacaaaacccaaggtcattatggtgattaaaccacagtatatatatgtatatgttgaagaggtttcaattcggccaaaacgacagtactatatctgagtctgcactagacaatattgaatttacttaccaattagcattaatataccagaaaaatatcgaatttctttttccggaataaaatacttctctttcaaaatattcatttgcaaattagaatacataggatattatgatgtgcacctaaaatatagagaaacatacttagaacttacatatcaaacgttatcttagttattaaaaatgaaaaatagctgggcagtgacacctgaaataccccaaaaaaaagagcaactatctagaaaagtatgtagaagtccgaaaggaacagagggtgccaccaatagctttcacaaagagttcctttcgtgttggcaaaaaaaatgagtcacttactacaggttcaatttttataattcaattgttgtacctatctggaaaagaagtcctcaaaattactccacccggaaatagctgtatcaaagaaggcacttggagaacctaatatatcatcgatgaaattttccgagaaatcttctaaaggtccctctaaatcatttagtatagttgttaaactgttttcagttgcatcattttcggtttcaggcccttcatcgatatttttcattcctttgttaaaagctcttcttcctattttttccattgatataataatagaaaagtaataggagttttgccaaatttgagtaagaggtttcaacttttcttggtgaatatgatcaaatatgttttccatttctttaaatgcaattttcagtgaaatacacttattgtgtggaccctcaaagtctccaggacatatagaataagttagtgcggacgaatttctctgaatgaataattggatatctttattttccatatactgtagaaaaatggtataaatttgaattaatgctctgaaagcgttcacataaataagaaacaacgcattgtttaaatggggccattttttggagaggcataatgacttagaagataatttgctgttgtctaattcaaaataggtctcaaggacattaaagcacaaatgtaatgaatttagtggagccaggacgctaaaattgaatattctcgcatcaaaatcttgatgtgttaaggtataaagattggataaacttcctatcatatggagagttgcatgccataattgaagttcggtgaactcattaccatttaaattagatgcatttaagtaaaaatccaacggcttaaacattttaatggtgaacttttttaagtcctcgatgatgagtggaatgtcaggcggtttctcacgagcatgaatttgtttcataatatttctcagtcttaatgttgttttatacagaaggatgtcccctgatgaagaatagttttctagacgtaccttgtttacaaaatcgtcgttgattcggaccggaattcctgtagagagtgaaattttaacgtccgtgaataggatccataaccacaatctctccaagtaaggtatttcctctattggatgatttttactcagatataaacgacgaagatcttcattaaggcccatatggatagctgtgtcaattgtcagaccatgaataaatatgcaatgtgactgatcgcccccgtcaagacccgccacatttatgtacaggtaacgtaaaaataaaaattgcacacgctcagtataaaaaactttagccgaaacaaaagacgttaaaactttatggaagacttcaatagcctctggcacttcttttggatgggatgctaagcacataatggctgtcataacacccactttataataattttttttactgtccagattaagggaaattattgtgtgctgaccagttttatgacttcttgggcctttaacaaaacaatcttgcagatcccttaatactttttctttatgaacaatttggtaactatcgtaaaaatcgctagcaaaaaaatcagttaaatactcacacaaaacttcataatttggaagcgattcacataagtattcaataacacttggtgagcctgagtgcggtggggcagtctcaatggaactaatctccgagagtgttgagtaatgatgctctcttttccagttgttacggctgagttttaggacttgccatatctcctctctgtatttggcaaaagtatctgtttgagttgctaatattgctcgatacgacgttggtccataaagaatgtgcctattgtgctttgaagataaatatctcatgttggaaagagggttttgtccttcgtgaatgttaggctgggattgttttgttagctgagattcaagctcttcaatacgacgagccatctctaattttgaacatctcctgtattttttcctgagttggtcctccatggcggaagtgttttctttatattcacattgctttcgatttcgagaagagcaacttccacagaacggtcttactcgatcgcacttgagctttcttactctacaaaagtggcacgactttgcaggctttcttctactctgcctatctaatttttttttttgactaagttccgtattcttcattttctattgattatggaaagtatattgctacagattcattatttccaaagcaaccgttattggttactagtgctggacaattgatatgtaatcagttgctatacatctagatcaagttgctctcttcttttgacgtttcgaatattttttgacttcaaacttgaagtgcacactcatcttttcaaggttttttatgattctccgttttatggctattcccgcttttaacatagaggcgatgcatggaagacaataattattttaaggtgcttttgagatcaagatatttttaagagtactcactatgggtatgagataataaaatatattccgttttcttattatttccattcttcagatttttacaggctaaacacacatatataaaaatgccatcggatattcaattcagtatcctgctattgatatagaactatataactgatactagaatatactaattcgtgcactattaaccgtttggcgatgtccgaagaacggcatgaagatcatcatagggatgttgaaaataaattgaatttaaatggtaaagacgatattaacgggaatacctcaatctcgatcgaggtgcctgatggaggatatgggtggtttattcttcttgcttttattctgtacaacttttctacttggggggcaaattctggttatgctatttatttagcgcattatttagagaataatacttttgctggtgggagtaaattagactatgcttctataggtgggttagcattcagttgtggacttttttttgccccagttataacatggctttatcatatattttcaattcaattcattataggcttagggatactgtttcaaggggcagcgctactgcttgcagctttttctgtcacactctgggaaatttatctcacgcaaggcgttttaattggattcggtttagcatttattttcatacccagtgtcacactcatcccactatggttcagaaataaaagatctttagcctctggtataggaactgctggaagcgggttaggtggtattgtctttaacttgggaatgcaaagtattctacaaaagaggggcgttaaatgggcgctcattgctcagtgcataatatgcacatcacttagcaccattgcgcttatgttgaccagaacaacacatcaaggcctacgtcaacataagagatcttacaaatttgaattgctagattatgatgtgctttcaaatttcgcggtctggttactttttggatttgtatcatttgctatgttaggatatgttgtccttttgtattccttgtctgattttaccgttagtttaggttatactagtaagcaaggctcatacgtatcgtgcatggtgagtgtcggctctctgctgggacgaccaattgtgggtcacattgctgataaatatggatcactaacagttggcatgatattgcaccttgtcatggccatcctttgttgggccatgtggataccttgtaaaaatttggccactgcgatacgttttggattattggttggttctattatgggaacaatttggccaacaattgcttcaattgttacacgcattgttggtcttcaaaagcttcctggtacctttggtagtacctggatttttatggcggcttttgccttagttgcccccataatcggtctggaacttcgttcaactgatacgaatggaaacgattattatcgtacagcaatattcgtgggttttgcgtactttggtgttagtttatgccaatggctattgagagggtttataatagctcgagatgagattgctgtgcgtgaagcctattcagctgaccaaaatgaattgcatttaaacgttaagttatcacatatgagtaaatgtctttttcgttataaacaattacctaggagagtctaaaggtcacttttatttcacactgtagataagaaggggatagagttgccagaaaattttttgctttatcagctttttagatttgtcttctcgttttataaataatgataatttagtacaataatagataataaaaacatttttttttgcaaattgaaagcttaactggttttttaaaagaaaatattagtgaccttctaccgactaaaatcttccactaaatccccagtagaaacataagataaggttgaaacttttttagggcgattatatttttagtcctatacatgtttgatggcatactttttaaggaagatttatgaagctatgttccacataggtttatgtgctattgatatatactataaataaaacgctctacccaagaaatgaaacattttttaaacttttgtcatcagcacaaaaatatgcggatttacgcgtttgtcattcctataaaccttaaccttaacgcgaaaccatatttcgctacctaatgttggttcggtgcattttgagaaaaggaactaggttcagatatcatgcatcgaatctattatcttccaaccgaacttttacaaacgtttagaccgagcgttattgactgaattaagagcaagtttttacacgtgtgactctggcacattagagctgtttgagaatctaaagtcttgctgtctaaggaccaaaaataatgtatttcgaggtcatagctaagaatctcattgttcttcagcacttgctaatcacatatctatttctaagtacaagatgatagttaacaactaataatgaataaaccaggtaaaaaaaaaaaaagaaaaagctgtaaaagacgacaacgttggcgtcgcgaaaatattaatagaaccatatgttggataatgtagcctctattatacacttatcccgattacattgttttagcgacggtaatcatctttttatccggcactctgaatcaaactctatctttaagtatcctatatgcatgagttatgtcgattatatcgaagactcggtgtgtgatattactccacagtacaaaaacaggaatacagagaaaattgaaaagatatatgaacggatggtatggtaaataaaataacagccattataaagcttgtggtaaattttccaggacggaagttagcttatgcagttttgtttatcttccttgcatctgtgtataatactgaaacacgcaattaacgtttcataaaatttgcctgagggccgtataaaaattcagtgaccattgttcacactttaaatatagccaaattgccaagaaagggtttcattgcaggtttatcgaaatattaactctttaaatacagggactatacagagctaacttcttaagaaaaaaaaccatgcgacacactacgactttcacaaattccataaaagagatatttaagatttagataaaatatcaaaggactgctgtactctgcttcaattacctccttaccataaagttataggcagctttctccatcgacatactaaaatttggataggtattattaatgaaatgactagttttaagtaaaaaatgatcaccagcattgatactcttcaaagtactcaatggcttttgcagacttatctaaaactatttttgcggtttcattcctcactttgtcaacaaaaataggaggtccacagcaaaccacagataatgagccactcaattcagccgcttcatgtagaagttccttaacatttggtcgcccgcaatggaaaacaacaccatcaaaaccaagtggattggcagacttttctaaagtagttgccacaacagtgcctttttcatcagccttctcatcctgttgagaaatatctaaactatcactaggggttaatgatgggacttccattgtgttgtagatgtgaagctgtacattcagattttctaaacacatcaactccggcttataagcctcgagtacgtcgaatcctctaactgcaatcactaattttacagattgttttccagcagccgctgacgtctttccaagtttaattgcatgtgcaataggtccaggcaaaccggtacctccagtgagtaacaatacattattgtaattattgaccggagatgaagaaccatatggaccttctatagctagtctcatagatgtcttacctccattgcgacacacatactttttgacaagtcttgttactccctttttttctttcaggataataaccagttcaccattcttgcttactgaatccaaaacagtaaatggatgtgactgccagaagtacagtggatgtaaaaacgaaacgaaaacatattgcccaggtttggccctccatggccttgccggttttttaactgttaaacgaatgagatcatccccgattagttgtagggaagctttggggaaaccaaaataagaagctttgataattctaataatccggtcaacgatccaaatcgcaatagcagtgtatatccactcaatgccacttaaactaacaacatgctcccaacatgcataaaagaacattgcaccaaggacgatatgaagaaaaagaaaggcttcataaaaatacttcctgaatactgcaaaggaaaagaaaaccattgtgccagctaaacaaagtgctgccaccccgaattgccaatataatcggtttttacttgttgcccaagttttattcgctaccgtataactagtatatgcagagccatgaatcatagcatccaaaaacatcattcttcccaaccatttgtgaaacataatgaaggaagtatatttaaccccagaaatatactcgagaaagttgtttcttcccgcgaaaagaactattaatggaaagtgtgcgaatgcgagtacaccacttctgtctgccacatatcgagcaacttgaactctacgagacttgaatattatattttcaggatcgtattcataaccgtatgccaaaaaaacggtatgaagcacgagatatccaagaataatgataccctctaatcttgtaggtaaatatcctgtgaatattctaaaataagagaaatctgacgcatgtttgcttccaatggtaggtagagtgaggtatccccttacatatcccacaagcttttgcttcaatagaacagttttaaagggagtgtaattcatgcaatgaagaacgcctgcaaaagccatgatagcgacaaaataagcacatataatgccaccatatatgtttccgacatctaagttagcatagaaaccatgcaatgcatgatagtaggcttttcttaactgtgtatccatttcaactggatatgttaggtttgcactgcctttgacatagggcgtcatatgcctcgttccgttgtttagaacgtcataaaactcagaattagtcatgttctgaagagcatcactataacttgcacagttttttttgatggtactaaatgttttttctaaggttttattcgaataacctttttcatccaacgtttcatagatacaatacagcattgattgaaacgctggttcgtaagaacatactggtgatgaacgcttagacttgctggtatactcccaagtaactttttgaaaaatcctcgtgcaggcattagtgacaagcaagggcaccttgttacgaataactgtctttgcaggtgatgctcttgctcctgacaggcagaaaagcaaaatagcgctcaagatggacgtccaatgcattatattcgttgggtttcataagctttggataaaaaagactttattacaactgtagcaaaaaatcatgttcattttttgcgacttatatatttagtggcaaattaatgataccttgcaataaccgaatttagagtatgttgtccaagaaaggagggattttgttcatcagaaaagaattcagaaaagcaaggaaacagtactatcgtttagaatgtagaatgataggttgcttgctaattctattatggcacgaatgatacacccatattttcaacaaaatcaatacccactagcatcattgagccaactatttgtcaatgcaaccattaccggtacttcatcctgatttaacgagtctacttttttatcacgtcaaaatttacttgttttcctgtaaacccgaaataaaggcaaaaaagacctgggtgcaattacgaataaatgtacaataatcatcctgtttgcatagtaaacttccagttagagtcacacaacgcaatgaattttgacagttttctgtgcgatattctttggtaaacgtaaagaacaggcaacttttggtacaatggattctagcccatatggttcatttctggtgcattcgcaaagtcagtatttgtctagctgtgttttctggctgagagacattatgatgttattcattgttatggatatctctgtagctcatgctgcttatttctccctaaaaaagttttttctctcgaatacattcttgaccatttcatagtgaaattcttgtacttatttaaaaccaaaaatggaagtattcatacatccccctatcaaaaacactcaataagtttcgaattattcgttcgtctaaacagtgtccaatactcaaaggggtattcaagacggcacaaaatcagcatcttcccttatccgtgttccagaaataccacgctaaggtttttcctcctacaatccataaaatcattaaggaggcagcttgaaaaatcttgaaattcaaaagagttatcttgggctaatcgaaattaacgataaccagagtagaatattcaagatcacagctccaccttagtttcgaggttgctctcaatggtctagcttagtcatgctttttgttaaacaaatcttgccttttctgatattctatagtgtggtccaatccagatattggcgcatcctaaaccaattatagttcacttatgaagggcaaatgaacactcttaccagtttcacaaataattagtactagctaggcggtcaaactgactagcttattataatattatcgatgtaacatttttccatagtgagggaggaaaataaaccttaaaaaaatatgcaaggattctagatttcaggctagtcttcaaccactttgcacttccggattaaaggcttttatagaaaacatcttggtttgggactatattgctaggtgaaaatttcaaaattgtacaaaagatcattcttgtttttttgcctcattagctgatacaatgcggaactacatggcgctcttttataagcatctactatggtacattctaagtatgtggatcttggttaacacatagacattttttaacttcttgatatcggttccgctaaatttgctgattatatttgttcactaggccagatcataatgcctgtaatattgagtacttaatatcgatacttgatatccgaacagtaaacgtttgtccgtagtcatcgtgactggttgacgtattaactgcaagaaatgatggaaaaaatttaggtatatttgcagatgaaaactctagaacactgccgttgaagaaagaatggcttcagccgtcatgctgtctatctgtttgtaaacttttggaagttttacatattttgcactattttctttagcacgaggtatatgtttctttttcaataaaaatcgtccttttgaagagccaagaacacttttgatttgagtgtataggataataatattgcttctagcgcttaatgaccatgtttgtacttacctctctcccaccttgtataggcggattggctataataacgcgttatatgcatcaaaatatgtagttctctttcattttagcaaattcgtaatacgactccagataataataccaagtcatttttgggtaccagtgagaattgggtctcataactgattgtgaatctcaatattacagtgatgtgagggaaaatacttaattaaaaaggaaaaaagaaatgttacttttctattttaaatgaagattcagtttgttaaacatggattttccatagcattaggtttttatatttccaaatccattttatttaaacttttgaatcatgggatataaagttacatgcaataggaaaagttgtcatgaactccatttgaaactaaggaagaacagtaacagaagttttttgttatgaattattcatgaacttagagctgctaatttggagtgggtccaagtcatcatttttttgcggggctatgattacacaatctgcgcacataatataatcggctttgtatctttaacatcaagtaagaccttgaaaatttattctatctttagacaatgaacggagttacagaacgattttcgtcttccccatttgatcaaaaactaactgaaaattgcagtgttgtaatttttgaaacgccgaacgaagttttcaccaacttaacagaagcagaagaccgttcttgaactaggctgcactgtagaacgctgagcactttaccattcaccacgctattttcaacggaaaaatcaataaatccttgaattgccttcatttaaatgccaattacacctcgtatatctaaaattgctgacatatattatttctttttgatacttcgctgggaatctcacagaaaggtggctctagaatacagaagaacaaagtacatagtccgtaattgatgtatgaagttaatgggaaagtacgaatggtactgtccactcaagtaatactttgagattgaaatttgaagctttttcaagtaaataccataatgataccaacaatgatacctacaattttaaatatcgtaattgttaacttgatttttcataatctcatttaccgacttgcaatactaaacgggtaccagcagacaatagaaaaccttctcatttgaaatgaattctaattgtgaaggcggaaatgcgtactttgaggaacgtctattgtcgtataaaagttttacaattaactaagccaatgtatgatacgcccgcttggcctttttctttccgactatataaatgcaaatagtcagaagttgtaactccaataacaaacccctcataccgtcctcaaattggcatatcgctatcagaatgagaggcgatggggttaaagataggagtatagatgtgttatccctcaaacatttcgaatcccagaaagttgttctgcctcaagaccttttcatggataacttcacctggatgttttatgagttcttcaagtgcttcacgtttcgtacctggttgctattattactgctaatgtggttgccaggttttctttcgcagataaagtccatcaatcggatttttccgtttaaactttgtattttagtctcatgcctagtggggatatttttacccaatatttattcattctctcataaaagtgtgttaacgaatcaacttactcagttctccaaagaaattgttgaacatgcaccaggtactgatactcatgattgggaaacagttgcggcaaatctaaattcttacttctatgaaaataaagcttggaatactgagtacttctttttcaatgctgcagagtgtcaaaaagcattcagaaaagttcttctcgaaccattctctgtgaagaaagatgaatcttcgaaaataaaatcatttggggattctgtcccctacatcgaagaggccttgcaagtctattccacagaatttgacaaaaagtggaagttgttcaatactgagaaagtgtggagccctgataacttggaacatgttcagctccccaagaaaacttatcgttataagtttacctgggttctcaagaggattttcaatctctggctttttccagcatttattctgtttctggcttgtatctatgtgtcatgggataagggccatctatttcgtatcttgtgttgtgggggaggttttctccttatggtaagagtttttcaaaatatgaggcccttttccatgcacatggaagacaaaatgcagttcttgtcaacgattataaatgagcaagaaagtggtgcgaatggatgggacgaaattgcaaagaaaatgaacaggtacttgtttgagaaaaaagtctggactagtgaagagtttttctttgatgggattgactgtgaatggttttttaaccacttcttttaccgccttctatctacaaagaaacctatgtttgatagacctctaaacgtggaactatggccatacattaaagaagcgcaattgacccgcaaacaggcgcctcccgtgtaggaacaagcatgccttttcaatttatagatcgtgtagtttattagatgcgaatagcctaaacaaggtcgcttattattattattacaactattctttttcctattcccctctggttaacaaaaaccagtatattaacagaaataaataataataacaaaaaaatatgaatataagaataaattgcaataaatagtaatatttataaaatataaaaagaagaaatttttattctttttatattttattataaaatagttcaattatttatattatttaaatgttgtaatttattattaataattatattttatcaatatttatacgatataaaaatttaaaaaaattataatatagaaataataaataataataatatgataataaaataatatataaataaaaatgataagattatattaatttatttaattttcaaattattaaataaataataacctaatacttacttttcctaatattattaaaaatggttattgtcaaacccattaactgattatattataatatttcaatatttaattcacttaatttgttgttataataattaatgaaatagagaaactataatccaattgattgtgcaacagtttgatcttccaaatcataaaagaatattgagtgttagttggtactggtcataactatccattttgaacataaccatgtaactcttttcccgtctactgttaatcaagggaacatgttgaaagttatatcaatacatgtgttgagtatttcacgcgaatttattgctacaaaagagcactaagtaatacatcgttaatttctgcggtagaactgacctggtgaccttgcttgatgctttattgtttgtgggatctgtcacgtatatcgccatatttttttcctacggatataatgtaaaacactaatttatccttcagggttgctctttaaaactcaattgttgaataacttggtattcatatatgtggctgctgcgaatatcttgacacatattatgattatcaaaaaaaagtgaagaactaaatttaggaggatttctacagttttggtcttggttaggtaataattccttaaaatagaggcttatcctttcctgtggaccataaatatcttcatgcaagatctcgattgattagtaataagagcagacgatattgtgtgtggaaaagagaattttttctgcgtataaaataggacattatgacagttacctttaattgaagtagagatatgttttttcaacttagaagctatgtctttactgggtgtaagcctaggaacgctcttctgttttagttcaaaatatgcaaaagaaactaatataccagtaatgctcatagtcacagtcagaagttatattattagtttgacataagcagtattcttccctctcacacactatcattctgccaaaaaattttcccacataagggtgtcagttcagtgaaatataatactagtagaaaaatatgtagagttatcagagtataaatcagctagaggctttttttgctgaactcacttcaaaatctcaaccatgttattaatgttaagtcaaatgatatatgccgtgtgaaagtagacaactaaagctttccaattcttcactataaaactgaactcaaaattcaaaagtatacactaaatcgttgggccatcttccttcccagagattaaagtagcatatctcttcatgtctacattacctccacttagtattatgcctactttcttcccaactagctcttccttttttagaagtgcacctgcaaatcccaaacaagctgtgggctcaacaaccaccttcatgcgttccgcaagaaagtgcatgcattttactagctcttggtcgctaaccgttaaaatatcatcgacattttcgcgaataatggcaaatgtgtactcaccgaggtgttgtgtttgagcgccatctgcgatagtttttggcgtattgatatgaacaatggaacccgatctgaaggattgttgtccatcgttaccagcttcaggttcaaccccaaaaattttgcagcctggagaaaggcttctagcggcaagtgcagatcctgaaaggagcccaccaccgcccaaaggaacaaataatgcatcaagttgtccaacctcttctaatagctcttttgccgacgtaccttgccctgcaataacatcaggatgatcgtagggcggaatcaatgcaaaaccatgttcggctgctagttgacgcccaatctgctcgcgatcttcagtatacctgttataccttatgatatgtgctccgtaaccggctgtagcagcaactttaagggcgggcgcatcctcgggcataacaattgttgcaggtacatttaatagttttgcactaagagcaatagcctgtgcatggtttcctgatgagaaggcaattactcccttacttcttttttcatcacttaattttgaaacagcattcattgctccacgaaacttgaacgctcccactcgttggaaattctcacctttaaagtatatttgtgctccaagtcgatcattaagcattcgtgaagtgagaaccggtgttttatttacatattctttaattctgttgctggcatccaaaacgtctccataagtgggaacaatcatttttccaactcaatgaaaactaaatatctcgaactatattaattatttgtactttttaagttttttttcaatactcctttatttgaatttttgcagaatgaaaatgtaactctttatattccaaagcttatctttttctcacgtaccgtcctatagaccctgattttatgataagaggctgaatttactaattagtcatttttttcagtttttttgtcatagaagccacatttaaaagaagtcagccaagttacctgtaaatattaaaacaacctgcttagaatgactgttaatttacagaatttacgataaaaatataacttggctctagggcgtgatgatagtgacaaaaaactcgtcaagtaaatgttgggagcttacttgccgtcgttttctaacgccaaaatacacgaatcatgtttgggaaatataagtgattagaacttgtccaaggatattgtcaaacaataacatactacaataatcctagatcgtgtattatttgcgtatggataaatatacctcaagctttatgaggcatagaaaattcattagagtcactacttacgtcgcactctcgaggattggaatgacgaaatcttcttcagcatttcaccattcaccttttgaagcttcctatctcgttgcttaagtagaatgaaagcatagcagcccaaaagaaaagcctccctcagcaagaatattaacaaagaacaattcatggaccgtttctactacttaatatctctatcacaactgtcagtctcaatcagtacttaaatgacgctgcagaaaaagatatcattatttttatcatccccctaataaaataagtaatgaatcaatgccattaattcgggaactagtcatatacctaaggaatcaggctttgatagctctttaataataatattagggcatttttgatatggtaaaagattagattaggaaaccccttttgtagagcatctcactacaatatctgcaaaaacggtcaccttgcataggcagaacacgctacctttgagttaattcacaggggagagccctttttttttcttagcaaaagtgcttaacaatcttaatttctggaatgttttcggcggattgttgtatattgtttgaatttgttcgttctaaaaagtgagacacctgcactttccacgccaagaacactaatacctttaaacatgccagcgtactttaaaatgccacgagtcgccccgtaccaaacatgctggcgattgtaatttttcgccttttattggaatcgagaattcgggcactgtccttttcttcgtcatttcaatgttataatcatttttatcgccaaattttcttcaataaaaggtctcttttaaaatatgttactatgttttttatttttctattatttttctatgtgatttttcagacgatttattctttgttcgaaggagaacagatgcaacggtcaagtttttactatccacatgaggagccgtaatattctaaaggcaaaagcatgtgtgcttgtaaaaaaaaatcaaaaaaagttactgctccaagccagcaagctttctcttttgcgaaatctttaacacggttaaaatcaaagacaattacttcattgacaaggtcaatgctaatatttacggtctccgcacgaaagactctgaaaaatgttaaaatttatagtggctaatgctaattcaagaatagtctcgggttgtttgatcacattattttaatttttattgagcactgaataggacccgtatgttccaatcagtctatttcttgcaacttaatctggtttgtttttaggggagtggcattttttttagggttattcaaatattcaattctgtaatttgcttacgacaaaaagaaaaggagagatgaaaaaagggcgacgggtataatctattcagccgccaatgtcccgacgtatgccaaaatgtggtgccgcggtaacagtagcatcacacagagcatgagaaaagcaagaaaagtggaagtctgtatgtcacatttttattgaaaatgctatttgctataaggttcgctattcaactgattgaaccgagatagacaaaatgttaaacttttcatagagacgttattgtgatagggtttacgctgagaatggttgaaacatacttgctaataaaccacgtcacgtcaaaatatcagtttttcttttttagttattcccttctcacttttgacttgagatgagatcgttacacttttattgaatacgaacggatcacgatacatccacatatacgaatgttcggccagacagggcatcagagtatataccctttttcctaaaatggaagggccctagatcgttggcatcagcggttacctaaccgaagtggatcaaatcagcgcctatttttccgtttagaacgattagatgccgtcaatatgtatgtgcttactgtatcatccacgtagtaaagctggggcgtagcatccctaggttactttctcaatactggggtccctgaccaaagataaaacataacctattatggcgtacgagtcaaagttaaacgctatttgactcgggcagcatgcatgacccgggggaatggaaaacttctcatggctaccccaacgaagccagacaagatctaggagatgtctccaccttccgagctacactctcacatctcttacatagacactgtgaagtaagtgattgcacacaatccaaagaagcacatcaaataatatgtaaatattacccgtacaaatggcaaatcatgtccactttcccgttagtcatcgggtgggccggtcctcgcactttccttttgtttcggatgttaattaatatataaatggatctataattttcaaaaggtataaacgcacagtatgaaaaatattgcaagaataatgtgtttataaattattttttttgctggtagcaaaatcaactcattgtcttccattcagagtctaatcgaacgttatcgcaatgcttgcacacttttaaacaatacgatttagtttaagtggatggacccccacgcttagtgttccacaggtttgtccccactgtttttacattccactgtacatttttgcaatagaaggtcattgtatgctaccttgggcggctaagaatacctgtaaaaatttggagaaattagattcgtaaagaatgactcgcaacgactccaatgatttcttcttttcaccctttgaacggccgatatccgcgcgggatcctgaccccgcaatttactccactagaccggcgtgtttctctttttccttttcctggggttagagcccaagagctaatagccgacaaacggactccaaaaaaaaaaggaggcacaggacaaacgcagcacctgcgtcattcacgctgaagcggcagcaagcattttcgatcagctccaattaaatgaagactattcgccgtaccgttcccagatgggtgcgaaagtcagtgatcgaggaagttattgagcgcgcggcttgaaactatttctccatctcagagccgccaagcctaccattattctccaccaggaagttagtttgtaagcttctgcacaccatccggacgtccataattcttcacttaacggtcttttgcccccccttctactataatgcattagaacgttacctggtcatttggatggagatctaagtaacacttactatctcctatggtactatcctttaccaaaaaaaaaaaaaaaaaaaaaaaaaaaaaaatcagcaaagtgaagtaccctcttgatgtataaatacattgcacatcattgttgagaaatagttttggaagttgtctagtccttctcccttagatctaaaaggaagaagagtaacagtttcaaaagtttttcctcaaagagattaaatactgctactgaaaatatgtcgtcgtcaattacagatgagaaaatatctggtgaacagcaacaacctgctggcagaaaactatactataacacaagtacatttgcagagcctcctctagtggacggagaaggtaaccctataaattatgagccggaagtttacaacccggatcacgaaaagctataccataacccatcactgcctgcacaatcaattcaggatacaagagatgatgaattgctggaaagagtttatagccaggatcaaggtgtagagtatgaggaagatgaagaggataagccaaacctaagcgctgcgtccattaaaagttatgctttaacgagatttacgtccttactgcacatccacgagttttcttgggagaatgtcaatcccatacccgaactgcgcaaaatgacatggcagaattggaactatttttttatgggttattttgcgtggttgtctgcggcttgggccttcttttgcgtttcagtatcagtcgctccattggctgaactatatgacagaccaaccaaggacatcacctgggggttgggattggtgttatttgttcgttcagcaggtgctgtcatatttggtttatggacagataagtcttccagaaagtggccgtacattacatgtttgttcttatttgtcattgcacaactctgtactccatggtgtgacacatacgagaaatttctgggcgtaaggtggataaccggtattgctatgggaggaatttacggatgtgcttctgcaacagcgattgaagatgcacctgtgaaagcacgttcgttcctatcaggtctatttttttctgcttacgctatggggttcatatttgctatcattttttacagagcctttggctactttagggatgatggctggaaaatattgttttggtttagtatttttctaccaattctactaattttctggagattgttatggcctgaaacgaaatacttcaccaaggttttgaaagcccgtaaattaatattgagtgacgcagtgaaagctaatggtggcgagcctctaccaaaagccaactttaaacaaaagatggtatccatgaagagaacagttcaaaagtactggttgttgttcgcatatttggttgttttattggtgggtccaaattacttgactcatgcttctcaagacttgttgccaaccatgctgcgtgcccaattaggcctatccaaggatgctgtcactgtcattgtagtggttaccaacatcggtgctatttgtgggggtatgatatttggacagttcatggaagttactggaagaagattaggcctattgattgcatgcacaatgggtggttgcttcacctaccctgcatttatgttgagaagcgaaaaggctatattaggtgccggtttcatgttatatttttgtgtctttggtgtctggggtatcctgcccattcaccttgcagagttggcccctgctgatgcaagggctttggttgccggtttatcttaccagctaggtaatctagcttctgcagcggcttccacgattgagacacagttagctgatagatacccattagaaagagatgcctctggtgctgtgattaaagaagattatgccaaagttatggctatcttgactggttctgttttcatcttcacatttgcttgtgtttttgttggccatgagaaattccatcgtgatttgtcctctcctgttatgaagaaatatataaaccaagtggaagaatacgaagccgatggtctttcgattagtgacattgttgaacaaaagacggaatgtgcttcagtgaagatgattgattcgaacgtctcaaagacatatgaggagcatattgagaccgtttaatcacttttcattgctctctagggcgtgttcgcttctctatgtaactgcatttcacatatattcatattatagcctttataacattacataaaagacatgatatacgacatactttaaagttagaatttttgttgtattaattttctcgaagggattagaatgtaagtacatttaaatagcgccgcaagaaacataacagccgttaacactagcaagatggtagattactgtgtctaagaatttaaattgttttgcttgcttttgccactataagacaataatagtaatagaaaagaaatgttagtcgaacagcaaattggtaaaagtggaaaaaattatttcgttattcattttaggccgttcagaaatatagcattttggttcttgcactgaatgggccctgaggacagtgtgcggctggatagccatatacttcgacattacttttcacctttgaagggggatgtatgcttatacacaatcaaagctcggcctgtgcaggtttcactacataagcttttttaccatagaaatcttgcagaaggaagtaagtatcaagatattacgtatcgcatccatagaacgatagcagaaaaatgcagtatatgataacgatatgcttcacagctgcggcccatttggggaaaaaaggaaaaggagcatcctcgatcttacagatgtcgctttttcctcttgaggtcattccctaaccttgggatccaagtcaatctggtatcttcccaccctaaatagtgtattccccatgtaataagatcggacgataaacttcgaaacaattctagccttttttattagatatttactctactttagatttggtgattttactaaatgttatccttcagccactacagcctactttttctcactaatatgttcttgaagccattttcttcaccgggctttgccgaaggttatttcacgatcttcggcattcgccgaaaatttttcaagatgcccatcaccaaaaaataaaaaaagctttatatatggcatggcatacgcatcgggaaccggtattcttctcttggattacacagtttggactactagacgtttcaaatagatatacacaattactcaaaaaaaaattgaacttccgtaccaaacatgacagccagtttaactaccaagttcttgaacaatacctatgaaaacccatttatgaatgcatccggtgttcattgcatgactacacaagaattagatgaattagcaaactctaaagctggcgcattcattacaaagagtgctacaaccttagaaagagaaggtaaccctgaaccacgttacatttctgtccctctaggcagtatcaactccatgggtttaccaaacgaaggtatcgactactatttgtcctatgtattaaaccgtcaaaagaattatcctgatgcacctgctattttcttctcagttgctggtatgagcattgatgaaaatttaaatttgttgaggaaaatccaagatagcgaattcaacggtattaccgagttaaacttgtcttgtcctaatgtgcctgggaaaccacaagttgcttatgactttgacttgacaaaggaaaccttggaaaaggtttttgcctttttcaaaaaacctcttggtgtcaagttgcctccttattttgattttgcccattttgatatcatggcaaaaatattgaacgagttcccattagcttatgtcaactctatcaatagtataggaaatggtcttttcattgatgtggagaaggagagtgtagtagtgaagccaaagaatggtttcgggggtattggaggtgaatatgttaagccaaccgcgctcgccaatgttcgtgcattttacactcgtttgagacctgaaatcaaagttatcggtacaggtggaattaagtccggtaaggatgcatttgaacatcttctatgtggtgcctctatgctacagattggtacagaattacaaaaagagggcgtcaagatttttgaacgtatcgaaaaagaattaaaagacataatggaagctaagggttatacatccatagatcagttccgtgggaagttgaacagcatttaattatcggaatttgaagaactatgatgggacaagttatggaagagtgttaagattcgtatgaatattttattattttgaaattgcataaatcaaggatagttggtaaatgctaattccttaatttttcggtgagtgcattcgcaattggcatcatacattagggttcaatgtgctttaatagatgatgatactaaatacttatactttgaaataacttaatcaatgtaaattattgtcttgattcatttatacttaaatttttatatctcaacatatgatatatccttacattaagacttattcaagaaacatttttcaacgataattattagtaggctaaaaatggcataggaaccagaaaataatgttgaagaaatgaagccatctgtttaatatttggggaaaaaagtgaagaaattaacgaatatgtgcatatatatatatatatatatatatatatatattgcacaggtgattttgatgtagaatgtagccttttcgaaagagtaatttggttttatctacagagttccgaaacattgttaagtgcctgttcttatataattaaactgtactttctgtaaaagtcaatttgtggctggcgcatccacggtataccaatggttccgtgtaattcgatattgactaagaaccaaaaagaaatgctttaatccttgtattgtccaaatcccccaccaccaggggttttaatgatgaatcgatcaccgggttgagcgtaaatcgtatttttaccgccgacattgattaatgcgcctgtgctatgtcttacccataaattctcacctctactaccgtcttgtcctccctttataccatgagggccaatgacacgacgttctgataatatagatgctgttacagccttccgaaattgaacatcccttactacgccatttccgccagtatatttacctttgcctcctgaacctcttctgatcgagaactctttcaacagaacggggtatctcctttcaaatacctcagtatctgtcattcttgtattggtcatattcgtgtgtacagcgtctgagccattccaaccacttcctctccatgaatctgcaccagcccccgagccgccacatatggtttcataatatccaaagcctttgatctgcttatcggttttgttaccagaatttcctccagttccaaatgtaaagttgttacagtcaccttgagaatctgccatgacgttaaatgtttttaagattacatctgtcactctttgggaagttaatacattgcctccgacaacagcagcaccggatcgggggctcaagagggaaccagcaggaatttttattgttaagggttttaaacaaccttgatttaaaggaatatcttcgcctactagacaccgtagacaataaagaatcgcagaattagtaatagcctctggtgcatttaaattaccataaacttggggagaagtgccatcgaaattaaaaatatactcctctttttcaggtcttatgataacttgtagtttaattaagcttccatcatctaagcgatcttcgccagaaaacttcgttgtgccaaaatgttcaaccatttttgcaagcattttttttatggattcagatgcatttgtctgaattgcagccatgtatttcaatattgtagccagatcatattccttagttaatgacccaattaactgtatcccttttgtgttagctgcgacttgcgcttttaaatcgcttatgttatcactaaatcttcttgaacctgagcagcctgggtatttgcctggatcttctacgaaaagcttgtaaattaattcttcctggaaaattccctctttgacaaccaattcggaataaattgcggttccttcttcgtacaattctttggaatttggaggcactgaaccgggtagaatacctccaatatctgcatgatgggctcttgaagccacataaaatatcaattcgccagttgaagagaaagaaggagttattactgttatgtctggtaaatgagtaccaccaatatccggatggtttgtgattaaaacatcaccaggctttaatttgccttcccataacttcgcctgtgctgatatgcaggttgacattgatcctaagtgaacaggtacatgaggagcgttagcgactaagtttcctttagagtcgaatagtgcacatgaaaaatctaatctctctttgacgttagttgaaacagaagttttcctcaattgagtacccatctggagggcgatatccataaacctatgactgaaaatagacaataagattggatctatatcaagttcatatccgcttttagataatgtcttcgcagccttttggttgatcttgataaatatatgagagtttaaaattgttgcttggctgtttggtaaaataatatttgtttgggtaccgtcagccaatatggctgggccctcgataattgttccggcaggaagatcatcaattttgaagaccgcagtgtcgacccatttgttgtcaaaatatgctttctgggtaaaactagcatcctttgacacgtcggctttcttgaaatgggaaatttcaatcaattgctcatcaaccgttttttcttttctaacgcctgatttcccaattgctcttatccttatatcatcaattataattcgtttgtcatcgaatgagaatccgaactcttttttatgagcttcagagaaccattccctaaaattccattggtcatcatatttttgtaatatcatcaaactggtttcagtaccttcatatctgagatttaaatatctttccaagactatgtcctcccgagaaaacgactgagataaaaggtttttgattgaatttttagaaagttctaagaatctttttttcactttcaagatggtctctggctcacccaagataaaagagcaaggctcttggttttcttcaataacatctgctaagaaaatgccataagcggacaagatagaagaatatctatgaattaaaacagtgtcaatgcccaatgaatctgcaaccgctatggcgtgttgcccgccagccccgccaaaggaaactaaccgatgctgagatactacatgtccttttgcttctgtaatggccctcacaggtcttgccatgcattcgttagctactttgataaatccataggcaacctcttccatggttagatttgaattcagatccttattgatgacatctgttaattctctgaatttcaaagtagtggtttctaagtcaagtgattcatcctcattgggcccaaaaattttggggaagaactcaggaaccaaacgtcctaaaaagaggttggcgtctgtaatggtcaaaggcccgccctttctgtaggctgcagggcctggatcagcagctgctgaatcagggcctactctgaataacccgtttttccatgacaaaatagaacttcctccagcagcaacagtatggatgtcaagttgaggagattgtatgatgatccctgcggtaacagtttcaaaaacatgttctaacctcccatcgccgtacctactgacatcagtagatgttcctcccatgtcaaagcctattaagggtatgttattatttttatcatagcatgtactagaataacctattacgccacctgcaggaccagataaaatagatttcaaaccggaaaattttcccccatccactaaaccaccatcagactgcatgaattgaatgtgggtatcttctgcgtggctcaaacctgcagaaatgctattcaagtactttttaattaccggagtaaggtaggcatctgcgacagaactgtgagccctcggtaaaaattttatcattggagagacttcagatgataatgaaacatgagaaaacccaatctccctggcaatattaccaacaattcgctcatggtctggaaaagtgtatgagtgtaaaaatgctatcgcaatagacttgattccgctagcataaagcactttcagaatagatcttacgcttgattcatctggcttctttatgacccttaccatttcgccactattaccttccaggataccttcttgttcattaggagacgatttggtaaaataagggtcttccgagaaatcttctaaagtaactctctcatctatttcaactacagtgtcatataatggcactaccttttttatatttaagttgaagatatctggcctggtttggtctccaatcagcaatgaatccttaaagcctttcgtagtaatgaaggcacaacgttcaccatttctttctagagcgcagtttgtagctagggttgtccccattcttaaacttctcacattagagatgtctagaggaataccgcgaggaattgtcttgtgttcaagcacctccaagagacgtcttatgccttcaaggggagcatctggatagtttttgggatccaccgacaagagcttgatgacagtatcatgttcttgtttacctgtaccaatattccccacacaatcagtgaaagttccacccttatcgatggcaattcttatgtttcctttctgcattgtataccaagaagttatatttaggttttcaatgctcaaaattattactgtttaagttcagttcttagtttttggcattctttcttcaacaccacgtaacatttgatcttatctttcttttcagtggtaatgttatggcgatcgtgctcaatcggaaaagcacctgaggcaaacaaaacaattgttgaagtattcatgcaaataatactgaatagagcggagtacgcttgttcttaattccagagattggtaaagtgtttatcattgctaccctctagaaataaaaattaattatttaggtaaaaagtagtactgaggtttcatatctgtagactgatggagtaaaaaaacattgaaaagactataaagaaattataagtagatacacaattgcttaacctttcatgtaagcatctaattcagcgtcaagagcttcgacagaagtaggagtgttattcttctcacggcccttgttctttttggagactctgttaggcttttggcgataatggctccctggcctgcctcttccgtgttcttgagccgtctgtttgcgacggttgtgggcattcattctagaatgctttctctgtggttggtaaatctccacttcaatttttgcattatgtaactcatgtccattataacgctcgacaatcttttccaaaacttctgggtcttcaaattcgtaaatacatgtacgatcctctttattgtcaaaaattttcgaaaatattggcgagccaaactctttaatcatatcatcgagggtgtagtcagaaacgtctagtgggattttggatattctaattctcttaggcaaaggaggctcttccctctctctataaaggcgatctttcgaccttgatgcagcatccgaaggcgcaaatcccagtctaggtcctaattcatttcttaaatcccttctgcggtatctcgttaccttatgattagatgagctgtctgtgtgactatttccaataatttcgtcaaatgctttgtccattgcaaaatgcagtattgaatcgtctaatggaaaaggtactagacgcttatcgtttcagttttttagtcttttccatctatttatcagtctgtactcaaaataaccttattgtatgtaacctttttcatttcacgatgataatttcttgccgagttagacagaaaatgaccgtgatagtttgtcataattttcaatagggcagaaagaattttaaagattatttgctatctagacattatgtgttttatatgattgctgtaaaagtattaggagagatcgtcgaaaatatccttaaaccttggcacgttcccatagctccttttgatgtttgcaagccaagttacggagttggcaaattgtcttaatgtaggttcaacagtagccaaatttccgtaagctacggttagcctatatgcggcttcttcgcattcttgatactcttccaatggcccatacttggtgttgatggcgtcagctacgataggcaaaagttctaaatcagagttccctttcgtgacgagagctgaatagttgaaaattagtgtggaaactgcaatagccaaattctgtgactgtttagcagatgcctgagaaaattcagtatctatagtctcaaaaattgatttataaacttgatttgattccagtaatttcacaccccagttttcattattgaagcaatttaccaaaatacgcacagttaacatggttagagtgatattcttattgcccaagccttcttcgatgtaatcttttatatctgaagaataaggtaatttttttacaatcaatcgtactatgtcgtatgcaggagtcttaatttcccagttagatcttatagtgttagcaaatgaaagtagcaactcccagctttcatctatgtcatgtagtgcgccaccaatttgcgccagaatttcatcatcaaaggtcttctcatttgaatttatttttactattccattgaaaatagtatctgggttataattttccatgataagatactgcttgacaggaagaaccttcattacgctcgtttttgaaggtgatactgcagaagatgatgcattatcgttgggctggtctagcgatatgccattagtgttcttcagtatgaactgtactacttgatccctataactcattggcagttcataacgagccaaaaaattgtcggctgctgtatatgggttgtcgctgacattaatcggcaatttcaagggaggttttccatcttcaatatccacatcaaatacgtagtcatacgttttaccctcgaattctatttttttgtcgtttccagtagcacctgcaccgacaacatcaccaacctttttccatgaagaatttgaaaattgatgagcttctatagtaccttgaggtgatttgactaccacaatttgaccctctttgcgccccggcgattgtaaaatttcataaggtgatagtttagactcatcaaattctattgtcttggaacttatagtggatttttccacttgcgtagatagttcatttatttcatcctcggaagcccatcttgacttctcttgcgaaaatattctcacaagattatcactacttcccacaataatatcaccattagacatacaatcaacggaccaaatagagatggcaggaagtgtaattacctgctttaacgaaccattttcctttgaccatatacggactgttcggtcttcgccgcagcttacaatatctccattgggcagcagtttaatgcaataaacaaagctttcatggccttcatatgttcttagtacgtcacctgtatgcatatcaaccaacttgatgaggccatcgtttgaacaactgataaaatggccatcatccaccacagctaaatgtcttactacatcattgtgaatcccactgaaagttttgatcactttatcgttttgccacagtttaatcgtcttatcggcggaagctgtcaagaatttattttctgagaaggatacgactttggcatcccatacagaggcattgtgtgcttgcaaattgtaaaccaacgatccttctttccaaacctttgcggttttgtcccaactaccgcttatcacaacaccatcttggaaggataaactacaaacgttcccttggtggccaatcaaggtatacaagggatcctctcctgaggtggcaaacaagggcacaccgttgatcatagtatccttacctccaaaaagcaacaactccttctcggaatcataacacacactatttaaaaatccttgtcctgtataaactaccgtaccgagccattggtcatctttagaccacaagcgaactgttccatccctcgaaacactagcaacctttgaatcatccacagctaccacatccctgacgtcctgatcgtgccctttaagtgttgcactcaattgatatcccatactccaaatctgctgctctacaccttactatcacacatgaatatatatatataaaataagccaagacagtggccttcccttattatcagcgtactaaaatctcatatgatttatttttcgtggtcctgaacgagtgtgaaaaattttgaaaaactcgcaaaggaaatgccaaggtcagcaactttctcgacgtccaagcctcgctcctattgttttagtaacctgtagaccttcaatattcaagagcttgcacacgcacgcattgctgcactactgcttacccacactacaaatttaattccagcttattgaagttgaaaaggcaagggaaaaataccacaggtttagataaggaaataggagaaaggattagaaaccatatccctataacagtaacgataatatttatatacacgtatattttctcgtctagatatgacaggtccaatagtgtacgttcaaaatgcggacggtatcttcttcaagcttgctgagggcaaaggaactaacgatgctgttattcacttggccaatcaagatcaaggtgttcgggtccttggagcagaggaatttcctgtgcaaggtgaagtagtaaagattgcgtccttgatggggttcattaagctaaagttgaacaggtatgccattatcgcaaatactgtggaagagaccggtagattcaatggccacgttttctatagagtgttgcaacattctatcgtatctaccaagtttaactcgagaatcgattctgaagaagccgaatatatcaagctactggagttgcatttgaaaaattccaccttttatttttcatacacatatgatttaacaaattccttacaaagaaatgaaaaggttggtcctgcagcctcctggaaaaccgctgatgaacgattcttttggaaccattacttaactgaagatttgagaaactttgctcatcaagatcctagaattgactcctttatacaacctgttatctatgggtatgccaagacagtggacgccgttttgaatgccacccctatcgttcttggtttgattaccagacgtagtatatttagggcgggcacaagatacttccgtcgtggtgttgacaaagacggtaacgttggcaatttcaatgaaactgagcaaattttactcgctgagaatccagagagtgaaaaaatacacgttttctccttcttacagacaagaggatctgtgccaatatactgggctgaaatcaacaacttgaagtacaagccaaatcttgttcttggagaaaactcattagatgcgacaaaaaagcattttgaccagcaaaaggagttatatggcgacaactacttggttaacctagtcaaccaaaagggccacgaactacccgtgaaagagggctatgaatcagtcgtgcacgcgctaaacgatccgaagattcactacgtgtattttgacttccaccatgaatgtcgtaagatgcaatggcatagagtgaaattgttaattgatcacctggagaaattaggtttatctaacgaagatttcttccacaaggtcatagactctaatggtaacaccgttgaaattgttaatgagcaacattccgttgtaagaacaaactgtatggattgtttggacagaacaaatgtcgttcaatctgttttagcccagtgggttttgcaaaaggagtttgaaagtgccgatgtcgttgctactggaagcacttgggaagacaacgctccattgttaacttcttaccaaaacttatgggctgataatgcagatgcagttagtgtggcatattcgggcactggagctttgaagaccgatttcacaagaaccggtaagcgtacacgtctaggtgcattcaacgattttttgaattcagcatcacgttattaccagaacaattggactgatggtccaagacaggattcatacgatttattccttggtggatttagaccacataccgcttctatcaagtcgccattccccgacagaagaccagtgtatattcagctgatcccaatgatcatttgcgcagccttgaccgttttaggtgctacgatattttttcctaaagatagatttaccagcagtaagaatttgctgtattttgcaggtgcgtcgattgtcttggcgctttcaaccaaattcatgtttaagaacggtattcagtttgtcaactggcctaagttagtagacgttgggttcttggtcgttcatcaaacgcatgataaagaacaacaattcaaaggtttgaaatatgcacagagtcctaaattttccaagccggatcctttaaaaagagattaatgagttctatatgtgataaaatgatgattattgtaaatccaaaacgtaaaaccgaaaatatgataaaaacgagaaaaaaagtaagttaaaaaataaaaaaataaaaaaatgaacgccggccccagagggaagaacaagctatttattttcttttttactttatctttcatggtcatatatatatatatatatatatatatatatcttctataggctactatacatgaaggcgttcgcccttacaacgttaagtttttttccctattgtaccgtgtaagtttcaattattcgcataattcatgaatgaacttcttcacatcggttgatttcattagggcttcacccactaaaaatccatggacaccttcttttttgtatttttcagcatcgtccctggtggtaattcccgatagagcaattagaagaacatcctttggaatagattctaccaagttactggtggtatttaggtctacgttgaatgaatgcaggtccctattattgacacctacaactttagcaccaatttctagagccctttgtaattcctctttggagttcacctcaacgagaggttccatgttcaaatctttactgtagctgtacagttccttcaataagggttgagatagcatcttgactataagaaggacagtgtcagctccagctaatcttgcttctagtatttgatacttgctgaaaataaattcttttctcaaaacacaaggcctctccttgggaggaaatttcaaatctaggattttcctcacatttactaaatcctgtaacgaaccgtgaaaccaatgaggttcggtcaatacggaaattgcggatgcaccagcctctgcgtatttgagagcctgttcagcagcaacagcttttaaacaaatgggtcccttcgatggagaggcacgcttgacttcagcaagaacaacggctcttttatgggatgatgacaacaccgtgtagaaatcctgtaacggtggggcaagacctaaatcatagttagattgtaagtcttgaaaggtgaaacctgggattttagactgctcattgacgtctattttacgccgagcatagatacggtccaaaatagaatttgaaggagatgatttgttttcctcccaagtgcctccactgacgtttaaaatgttcctgatcatcagatgaccttcctcggtcaagatggattccggatgaaattgcacaccttctacagtgtacttcttgtgtcttacacccatgataattccattttcggtactcgcagtaaccttcaagcaggatggtagggacgattctgtcccggccaatgaatggtatcttgtcacagcaataccttgcggcacgttcttgaaaattccacagttgtcgtgagagattggggacgttttaccgtggacaatctcaccagcgtaggcaacttcaccaccaaatacgtcaaacatgcattgctggcccatacagattccaaatacaggaattttcccagtaaagtaccggatacagtctcttgaaatgccagaatctgtctttgggtggcctggtccaggcgagataagcaatgtgtcgggattcaaggcggcaatttctggaactgtaattgcatcgttacggtagacgctcactttggcgccctcctggcacaagtactcgtaaacgttccaggtaaaggaatcgtagttgtcaattagaaccacatgcttattgattgggtttgttgcagcgtgcacagacatttttttcttacttttatggcgttctatgtagaaccaaacagatttggtaatgtgttaatactgaccagctccttgtcgaactttttgcgtaccttaatatctgctatagattagaatgagtcaacgagccattgatgatcattcaatgattactacaagaggcattttccgtcgtcagtgatatgaatagcacggtgaggtccagaagagatagtaggaagtttaatactggctcaaaggcatacttatatcgacaagctaagcgcaaatactactttgtggtacatcatcagcattgctttcgagaaaacagcatttaaaatcagccatttgctgcgctttctttaagccctaacagaaaatagttcaaaaaggcctataagaagcaaaaaaagtgaaaaatacgaaaaaatactccagcggaggagtataaaagggaggaaaatacaaaatgtagttgtgttgttacgcatctcaaagaagaaagaagaagaagaagaagaggacgtcgcacttgcaagcaaaaacagcgactggcgcgagaacaacaaacactaatgcatgtctctgtccagcaggaaaagcgagccttagtgtttcttattttctcgttcgcctcactagtttgtagtagggtgggagaaacgatggagtggattgtatgatgaggaaccagatagggacaacagattctcaagtgacgaggaacatcttttaaagcccagtttttagtagagcttagggcgcctttactgactatccactccttgttaagctatgatcttgtattcatgtgattgtaaataatattagagctctttcttgaattgccattacgcttccatgcggcatattctcgtgtagtgtgacaaaaggtgcgggtggcaaataaaggtaaaagaaaatgatcaaaaagggcctttaagtaggatgagcaaccgccaatcgctggatataagcaaacaaaaagtaagattagtagcaaagcaaagaacatataactatagctatgagcagcaataatagtggtctctctgccgccggagaaatcgatgaaagtctttattctcgtcaactttatgtgttgggtaaggaagcaatgttgaaaatgcaaacctccaacgtattaattctcggcttgaaggggctaggtgttgagatagcgaagaacgttgtgttggcaggtgtcaaatctatgaccgtttttgaccctgagccggttcaattggcagacttatcaacccaattctttttgaccgaaaaggatattggtcaaaagagaggagatgtgaccagagccaaattggcagagttgaacgcatatgtcccggttaatgtgctggattccttagacgatgttacccaattgagtcaattccaggtcgttgtcgctacggacactgtttctttggaagataaggtgaaaatcaacgaattttgccattcctccggtattagattcatttcctcggagacaagagggctgtttggtaacaccttcgtagacctaggtgacgagttcacagtgttggacccaacgggtgaagaacctcgcactggtatggtttcagacatcgagcccgatggaacagtgaccatgctagatgataacagacacgggttggaagacggaaattttgtcaggttctccgaagtagaaggtcttgataagttgaatgatgggaccctttttaaagttgaggttttggggccctttgcattcagaattggttcagtcaaagaatatggcgagtataagaagggcggtatcttcaccgaagtcaaagtaccccgtaaaatctcattcaagtctttgaaacaacaactgtccaatcctgagtttgttttttcggattttgctaaatttgacagagctgctcaattgcatttgggatttcaggctttacatcagtttgccgttagacataatggtgaactgccaagaacaatgaatgacgaagacgccaatgaattaatcaagttggtcaccgatttgtccgttcagcaaccggaggttctgggtgaaggtgtagatgttaatgaagatttaatcaaagagctttcctatcaggcaagaggtgacataccgggtgtcgtagcatttttcggtggccttgtggcacaagaagtgttaaaagcatgttctggtaaatttactccgctaaagcaatttatgtactttgattccttggaatcattgccagatcctaaaaacttcccaagaaatgagaagactactcagccagtaaactctcgttacgataatcaaatcgcggttttcggtttggattttcagaaaaagattgccaattcaaaggtctttcttgtcggatctggtgccattggttgtgagatgttgaaaaattgggcacttttggggcttggttctggctccgacggttacatcgttgttacggataacgattcgatcgaaaagtccaacttaaaccgtcagttcttgtttagaccaaaggatgtcggaaagaacaaatctgaagtagcggcagaggccgtttgtgctatgaaccccgatttgaagggcaagataaatgctaaaattgataaagtggggccagaaactgaggaaatatttaatgactccttttgggaaagcctggattttgtcaccaacgctctagacaatgtcgacgcaagaacatacgtagatcgccgttgtgtgttttatagaaaaccactgttagaatctggtaccctaggtactaaaggtaatactcaagtcatcattccaagattgactgaatcatactcttcttctagagacccaccagaaaagtctatcccattgtgtaccctacgttctttcccaaacaagattgatcacaccattgcctgggccaaatctcttttccaaggttacttcactgattccgccgaaaacgttaatatgtacttgacacaaccgaatttcgttgagcaaacactaaagcaaagcggggatgtcaagggagttctagaatccatctcagattctctatctagtaaaccacacaattttgaagattgtatcaaatgggcaaggttagaatttgaaaaaaaattcaaccatgatatcaagcagttactgttcaacttccccaaggatgccaagacttccaacggtgaaccattttggtccggtgctaagcgtgctccaacaccattagagtttgatatttacaataacgatcacttccattttgtcgtagcaggtgctagtttacgcgcttataattatggtattaaaagtgatgactctaattctaaacccaacgtggacgagtataagtccgtcatcgatcatatgataattccagaatttactccaaatgccaatttgaaaattcaagttaatgacgatgatccggatccaaatgccaacgcggctaatggctcagatgaaattgatcagctggtatcatccctaccagatccttctactttggctggctttaaactggagcctgtagatttcgagaaagacgatgacactaatcatcatattgaatttataacggcttgttctaactgtagagctcaaaactacttcatcgaaactgctgatcgccaaaagaccaaattcatagctggccgtattattcctgccatcgcaacaaccacttctttggttactggtttggtcaatttggaattatataaactgattgacaacaagacagatattgagcaatataagaatggctttgttaatttagctttgccatttttcggtttttcggaaccaattgcttcaccaaagggagaatataacaacaagaaatatgataaaatttgggatagatttgatatcaagggagatattaaattaagtgatttaattgaacattttgaaaaagatgaagggttagaaataacaatgctttcttatggcgtttctcttctttatgcctcatttttccctccaaagaaattgaaagaaagactaaatctaccaataactcaattggttaaattagtgactaagaaagatattccggcacatgtatctacaatgattctcgaaatttgcgcagatgacaaggaaggagaggatgttgaagttcctttcattaccattcatctatgagtaactaattaaccaaaataaaaaaataaattaaatatatacattaaatatgtatatatatatgtatgacttttgacaactttttctttggtaaaaacttattattattattattattattattattaatgtagtctcgaatatttgagtatgttttagttttttgttttatattttctttgggtttaactgctttggttggaaacaatttggaataattccccgcgattattatataaagtgtcgaagttacctcgctcaaccactttaccatctttaagaactgcaatcgagttacaagacctcatcatttgttcactatgcgttataaccattgttagtagagcaggtggaccttttttgacgatctcattgatgatagaggagctgacagaatccaaggctgaagtacactcatctaaaatcagaatttttgattttctcagaagtgctctggctatgcaaagcctttgcgcttgtccacctgacagtaaagttgtatcaatacgtgtatccaagccctgaggtgatgaaattacaaagtcatggattcctacgtattttaatgcatcatacatttcaatttcaagtatttcatcttgtaaaccataagttaggttatctctgatggttccattgaataataaaggtttttgctcaaccactgaaatttcttttcttaaacttgtcaaattccagtcatttacgtccgtaccgtctattttaattttgcctacttcacaattataaagttttgttaataaaagcacaagtgtagactttcctgtgcctgattcaccaatgatacctaacgtctgtccgcaaaacatgtcaaaattcatgtttttgtaaacaaaggcggtaggtgcagatggataggcaaatgtcaaattttgaattgaaacgattggttttttttctttgccatggtaggtgtgaccagctattcccactgttctagcattattgttttcaacctctagggtattatgcttttcatcaagaatcctatagatccaactggcagcacgttggcctctacttatatcgggtatctgacttactaggctagtgcatgacataatagtgaataataacaaagtgaaagtcgtaaacatttcctttgaggtgtactcgtgaatcataaccagctttaggccatagtagtaaataatagcttggatacacatgacaatcatgtttgtcatagatataccaaatcctgtggcaatggcgcgtttggaggcaatttgttgcatttttatcttcaagtcatggtaggtcaattgaaaatgaaattcagcttgtaagcacttaatggttttaatgttagtgacaatctggtacaggcagttttctaactgagcaacagatgtcttataatctgtttcgcatttttgtaaaatgcctccatatattgctgaaaatataattatgagtggaaacatcgaaatacaaaccaaacttaacttccagcccgatactaacgcccaaattagtccaatcgttgatacggtaacgaaactagtcattgcactcaaaaattcagagaccaaagacctcaaatctcgcaaatcattcaagactagagcagaaatttcagaagccttgttgttttcaccagaaaaccagtccatattctttctcgtcagtttttccataacttcatttctaagatccataacccagtattcactgcagcaatctaataggaatcctttagcaaaattgaaaataccatctgccgcagccacaccaagaacaagaagcgaccatttcgccaaataatgtgaagagccagtttttccatccgtggatgggacaattccttctagtaagaaactgaatgtgtatgaaaagacgggatttgtggcgcctgcgataagagaacatagcagtcccaagattagaatttttttgtatcttatgcttttaatcattcttttgataatctgaataatgctcagaagttgtggccctgttgaactttcggtgttcttttgttgttttagtgcatacccaatattttcctcttcaactttaacccttcttgttctaacgttcgatcttttttgatagattgcttcgtaaaaggacaactgatctgtctcatcatatcccagattacttaagcatgatccaagttttggtgtttccaattgagagttaaaactttccacagtgtgtatagatttttcttcagtctctgtatctacaatagttttcgcatcagagtagtcattctgtaggtgataccatgtgctaaatgtagtggtcggatcggctagaagttcagactgggtgccgctttcaacaacttcaccttccttcattaaatataaatagtcatcagattcaatttggctcaactcatgcgtcaatatgattgtagtctttcctttcctccaatgcctaattgccttcatcaacaggttgcgatgaacaatatctagagccgatacagcttcgtctaagaataatattggagtatctctgatgaatgcacgtgctatagcaactctttgttgttgcccgccacttagtgtgacacccccagtcccaattaatgtttccagtccatcgggaaggtctagaataaatctatccagaagagccatttgacaggcatctttgattaaatgtctattttcattggtgctgcaatcggcatttcttaccgaatctgttgaacctaaaagaatattttttctaagagtatcattaaatagggtacaacgctgttctacgacggtgatattttcaattagcaatttttggtcgattgtttggatattgtggccattgatagatatcgatccattatagccatcgtagaaccttaataataagttggataatgtagatttacctgagcctgattttcctactatgaaagtaaattgtcctgcagagaaatttaaactaacgttctttaaaactgcttccgaaggtctgcttggataagaaaacgaaacattagcaaatgttagatcactggtggcataatctagtggaaattggtgggctacagttttatttaaaggatttcgcttggatccatcttttaatagagtcatgattttttccatagccactccgcctttttgaagaacaactatttggtgtaatgtattatttaaagtcgagcccagcataatgcatgaatggaagcaagtgattacatcgttaatgttcagcttgccctttttgatcattgcggaaccaaaccagaatccctgtacaaacatagtcaacgtcaaaaatctcaagatcccagcgtttgcagcaacaaaaaagcaactcttgatgaagaaagtgttacaatttagtatgatttccttgaattttttcctttctagacgttgtgtacaatataatctcactaattgagcggcattcatcgaccatgtaagtaattgggctgctttactcgtttcagaattctccttctctgaatatacatgaatcattctggaaaacaccactgcaaaaaatgtgattattggagagctgcaaagaataattaaagttaatgaccaagaatagtagaatgacgtccccagaagcgcacatattgcaactaaattctggaaagttatggctgatgcctctgcggagcttgatcttagctcttccacacatctgttgatttgagtaaaatctcctaacaatttttcattattgtcgtaccattccattggcttttcctccaaatatgcctccaatatctgtgaccgtattctaaagccttgtctctcgccgatgtgcatccaacttgttagagaaagccacattactggcacagaagccgcaccaagtgccattactgccattgacctctgtactagttgggaatacaaaccttgatgtgacccattagccacgaaaactgatagtagatcgaacactctgcccgtcaggatagaagtaattgccggcactaggcctgttgccacggtacctattatcattatcattaacagcctgtagtcattccgtatgttcacgtacctgaaaatgtgatagtgttttgtagtcttaaaacttaaaaagttcatgacgtagcttgttctttgtttcctagtggaattttcagcggcacttgaaagctctctgtgtgaacgtaacaacgggagatagttcagccatatccaggtttataagctctggtatttaaatgatgaacggcaataatgcaacagttttcatatctgaaacaattgtatatgtgcgaagcagcgtgtaaatttccctattaggtaattacatggcaaaaaaaataagaaactattttcttaaagtacctttaccctttgtggaaaacaataaattgtatagtggcagaatagagaaaagaaaaaggaaaggaacatatttgtcagtgcaaggaccatcattgtttgaaaaaagagaggatattactagtaggtaataacagctatgtcgcgttatatatattatatataaaaattaaaaaatagaaaataaaatttcaaatgccctctgtgggaattgaacccacgatccccgcattacgagtgcgatgccttaccacttggccaaaagggctgagtaatttttatacctgctaaatttgtggctccgctatactttacagatttatctattttgaagatgatacatttagcaaaaatgaccttaaaaatgaagcaggtgccatttgcctatagcttggaaaagtagtaatggttattcaaaaagttagcagcgagatcttttttctatcgcgcgttaaaacgtttgaacagatatatattattcagccacaactatctatatataatatttcttcgatttttcgttttctcaagtttcgtcttattgattgatcagaagtttactgcgcttttgggtaaagaagcattaaacaaaggagagagaaatattgcaaggaaaaaatggtgagctatggaagtcatagtagtgaggtttcgaaagttcttaaaacgccgaagtttgtgcttaggtatggaaatgtatccagcaaacaacgttttgccctaaagcggaagataaattacaaactacgtgaaagcaaatatcaagaatacttgaatgaatacaacaccttcgtgctttacgactgggaaaacagtggcgctggtagtcttgtcgattcttcctacaatctcccctctttatggaaggaattcataacagagggcatatctaaaggagcaataaacgacaaactaccgacagtctttatgaagaggaagttgacaaactcagcgttgggtcactgtttgggacttgatttcctgactgatccgagcgagtcagaacatgaatacaggtgcatgtttcagacagttcaggacatcccatctctctcgcaactgatcttattcaacagcatgccaaacgttccagtaagattgaaattgcataccattggtataaatataaatttcggctgcaaacgttccctgataagcaacggtggtgatcaagacactgaaatgagcgaagcagtctcttatatccagcctttattggaagaatcctcgagaatgtaccgcaatttaaactactggaagctgttaaaaatagcacgaaataacaagaaggatgaaccgttggatcagagcacgcgtatcaagtcgcaagttaagcttttactgagtcaattggcgacgaaccgaattacctcaccttccgtcacggatcatgggggtcacaactggctcatattcaccagaagacggttgtaaacgataaatatgccataaagatctgcgaactgtacatatccatatataatgcgtattatttggtgactatagcactggcttccgccatctcactaagaacgaagaggtataataaagcattgtgatgttaaagaatgacgattaaccagcatttacaacaacttctcttcaacagaatagacaaaacaacaagcagtattcaacaagctagggcgccgcagatgttattagatgaccagctgaagtattgggtcctgttacctatttcgattgtcatggttttgacgggtgtactcaaacagtacatcatgacacttataacgggaagcagtgcaaatgaagcacaaccaagggtaaagttaactgaatggcaatatctacaatgggcacaattattgattggaaacggtgggaacctgtcttccgatgcatttgctgcgaagaaggaatttctagttaaggatctcactgaggaaaggcacctagccaaggccaagcagcaggatggttcgcaagctggagaggttcctaatcccttcaacgatccaagtatgtctaatgctatgatgaacatggctaagggtaatatggccagtttcatccctcaaactattattatgtggtgggtgaaccatttttttgctggatttattcttatgcaactacctttccctttgactgccaaattcaaagagatgttacagaccggtattatctgtcaggacctggatgtgagatgggttagctccatttcatggtattttatttctgtgctcgggctaaatccagtctacaacctgattgggttaaacgatcaggacatgggtattcaggccgggataggtggccctcaggcccccaaggccctccacaatcacaggttgacaaagcaatgcatgcgatggctaacgatttgactatcattcagcatgagacttgtcttgataacgttgagcaaagggttttgaaacagtatatgtaagttcgtggctatatatgcacttgtatagaaaacagatatacttctcggtttcaattgtataaatctacaaatttatctcttgcatccgccattccgtatgcaccttgccatgatataggcctgacaaactttacaattggtggcgcgtttttgataactttttgagagattatccattgtaagaactgttgagaatctaatgagttgtccccctcattggccaaacaactacagtacttaatgctgcggagggctttaggcctctgcgacgcattcagtatttggaaaagtattttgaagatcggctgatcaacggatatcttgtcttggaaactggtaggagtaaaatgtaaccagttattgaccatcgactcttgatcgtttagatggaggttcgataaaagctcagcttcatcgtcgaaataaaactctccgagcgaatatacctcctgtggacgtacaatcacaccattttcatcctccattgcatatagagagtcccaaatgcatatttccgatatattatacttgctcaagaacggcaagatgatctctacgatgaaattattcagatagttaacggacacgagtggtgttcgttgctgtatggcaaaaagtcctcgcttcttattgtagaaaacttccaaagcgctgctatacttcatatcagcgtctttatatagcgagtcgctaccatcctctggtctgtctaatggtcccacaaattccactaggtatttcgaatctaacgcctccaaatattcccattcatttgcttgtgaattcagcagccagtcaatactcaattgtggtatattccctacgcttactaatggcaacaccaggcagctcatcgtatgttcctttgggttttgtgctattctttcctgaagttttaatttaatttccttattttagtgtaggtggctttttttttagcaggttactcattgtgggatcattttcaggctcaaagcgaaaaattgaaaaattagctaacaaaaaaaaactaaaattttttcaaattccatcagttagtttgagaagttgtcggtaagcaacctatagaacaagtgtttccagtcaaatcgaggaatgctagaacggattcagcagctggtaaatgcagtgaacgatccacgctcagatgtggccactaagagacaagccatcgagctgctaaatgggattaaatcatcagagaatgcattggaaatctttatatcattggtcatcaacgagaattcaaatgatttgttgaagttttacggactgtccacattgatagaattgatgacggagggcgtgaacgctaatccaaatggtttgaatctggtaaagtttgaaataaccaaatggctcaaatttcaagttttgggcaataagcaaactaagctgcctgactttttaatgaataagatttctgaagtgctgactactttgtttatgttaatgtacagtgattgtaatggaaaccagtggaacagtttttttgacgatctgatgagtctattccaagtggattcggctatttccaatacgagcccgtctaccgatggtaacattcttctaggtcttgaattttttaacaagctctgtttgatgattaattcggagattgctgaccaaagctttattaggtctaaggaatctcagttaaaaaataacaatataaaagattggatgcgtgataacgatatcatgaaattgagtaatgtgtggtttcagtgtttaaaactggacgaacaaattgtgtcacaatgtcccggattgatcaattctaccttggattgtattgggagttttatctcatggatcgatattaatttaattattgatgcaaataattattatctgcaattaatctataaatttttaaatcttaaagaaaccaaaatttcatgttataattgcatactggccatcatctctaaaaaaatgaaaccaatggacaaactggcttttctgaatatgatcaatttgaccaacgaattgacttactatcatcaagccatatcaatgaatccccaaattattacatttgataatttagaagtctgggaaagtttgaccaagttgattacttcctttggcatagaatttactatcattattgaacaagtcaacgatgatcaaaaattggatacattatacaaacaatcggtcatttcaaatgttgattccatattattggagaaaataataccaatacttttggaatttatgaataatgagtttgattcaataacagcaaaaaccttcccattctggtcaaattatctggctttcttgaaaaaatataaagcatcttcaccaaattttgtaccattgcataaggattttctagataatttccaacaaatttgctttaaaagaatgaagttttcagacgacgaggtcacacaggatgattttgaggaattcaacgaaaccgtaagatttaaattaaaaaatttccaggagatcatcgtggtaattgacccaagtctgtttttaaataacatttctcaagaaatttcagcaaacctaatgaattgtaaaaacgaaagctggcaaattttcgagctaactatttatcaaatcttcaatttaagtgaatgtaccaagaacaactatttcggtttgaacaagaatgaaattatgacctcacaaccttcgctaactttagtacgatttttaaatgaattgttaatgatgaaggatttcttattagccattgataacgaacaaatccaaatactattcatggaattaattgtgaaaaactacaatttcatattttcaactagtgctaacacagcaaatgctactgatgatgatgaaaagtatctattaatattgaatattttcatgagctcatttgctatgttcaataaaagagaaaacgtcagactaaggtcatggtatttatttacaagattcttgaagttgacaagaatcaatttgaaaaaaatcctctttgccaacaaaaatttggttaatgaaataactaataagataagtcctctacttcacataaaagtaacatctatcaacgcccaagggacggatgacaatgatacaatttttgataatcagttgtacatatttgagggtattgggtttataatcacattgaataatagcagtcaggagctcactgctgccactgccaacacccccatcgattacgatatattggaccagatattaactccgctatttacacaattagagggttgtattacccaaggagcttcgccagttgtgattctggaatgtcatcacattcttatggctattggtactttagcgagaggtttgcacattggtctcgtccctgagaatcaggtcaacaatatggttgtcaacaaaaaattaatcaatgactctttaatccataaattctctaatatagctgaggttatattagtaacattctcttttttcaataagttcgaaaatatccgcgatgcatctaggtttacctttgccaggttaattccaattttaagtaataaaattttaccatttatcaataaattgattgaattgatcttatcgtccacagatttaaaatcatgggagatgattgattttcttgggttcttatctcaactgattcatatgtttcacacggacacagactgttatcagctgtttaaccagttacttactccgcttatcaacaaagtccattctattatcgaagagattgatgaacaacacgaccaacaatcaagcagtaacaaacctatagacactgcagtcacagccacctccgtaaataagaatatcgtggtcaccgattcgtatagagataaaatactattgaaaaaggcttactgcacatttttacagtcatttactaataattccgtcacttcgatactattgtcagatataaacagagcaatcctgccggtcatattaaacgatttggtcacctatacgccgcaagagatccaggaaacatcaatgatgaaagtgtcactcaatgtattgtgcaattttatcaaatgttttgggaatgggacctgcttggataatgacgacatcaataaagatcccaaccttaaaatagatggtctcaacgaatacttcatcatgaaatgtgtcccaataatctttgaaattccgttcaatccaatatacaagttcaatatcaaagaagggaatttcaaaacaatggcatatgatttggcaagattactgagggagctatttatcgtcagcagcaaccccaccacaaatgagaatgaatgtgtaaaatatttaactcagatctaccttccacaaatccaattaccacaggaattgacgattcagttggttaatatgttaaccacaatgggtcaaaagcaattcgaaaaatggtttgtagataatttcatttctgttttaaagcaaggtcaatagctttcaggcgcagaaaacctgaaaataaaaaaaaaatgcaaaacgagagtaaaagttgtaattatatttatactaatatttaaattggtaatatgtaattagacttatcattcactttggtttagcagctagtcatgtaatggcactaaaagtgcttctttatctattatttatacgtgacataccattacttctatgtattacgtaaagaatgacaaacgtttagtttttttaatttcaaagaaatcgttggaaggttcaaaaaggatcaggtgagatattagagtatatgaatgtttcagtctctaagctacacaaagaactagcatagtaggactttaacccatacaatggaactcaacgacccttcaattatatcaagcagccagttttcaggtgaattgtctgacagcgatactgcagccgctactcacaaatcgcaacaagccatctcaaatttattccaaaaattagccaaaaagggcagagaagagaagccaatcggtagcgtagaatcttcaactgatagctctaacatttctgttgctacgagcggtaacaataaagaaagcaataaaaaaaaaaataagaaaacggccatgctaaatttcagcagtttgacggaccctataacgaactacaaaccaatggatctgcaatacaagacatatgcatactccatgaatgaactttatcatttgaaaccatctttggcaagtgcttcgtacgaagaagacccacttatttcggaacttgtgaggagtttacccaaaagaaagttttggcgattgcgcatgggacctccagatcaaaagcatgctaataaccatcattttaatgggaacaatggtggaggcagttggaaggctggttacaagaatgggaaaaacgatgagagaagaatgagtagaaccaaaaacatgcagggaggcaaacgaagatctcaacaagatgatgaagaaaaaaagattgaccaagaaatgctggagatggacaagaatcttcaattaggaggtgacgtcggccattcaattgcagattttgaagattggaaggcaaagatgaaagaattagaattgaaaaaactttcaaaatctaaaggaatcagtaactctaccgcaattgctcccagggaaagcgcctctcatgaaacacccaccgatttaagaccggtcattccaaggggccctagttcaataacagattttttgaatttaaagaggcaagataagaaggaagaatcttcacaacaaacacctggtattcctgttggacagccaagcctatccaaaaccagtatagaacaagttaacgaattagaaactaattcagatttgggtaaaagttcatcatctcggttttcatcatttttcaataaatctgccacttcgttgccttcattagataataataatcaagtgccatcgtcaaacgtgtctgtagtaaacaacgatggcaacagtacacctcatcaaagtggttcaagactgatgtcgtttttcaaagaatctagatcgagcactccaaatgcagaatcgcagttgttatcagcctcagacaaagataatggaaagatgcagactcttccgcaattccagcagcaaccgcaacaaatgcaaccaatggcatttacccagcatcctcctaataacaacgcatttttcaatgggctattgaataaaggtaaaagtgaaactagtactcctcctcctccacccccaggactaattgctcatcagggtccacaatttcctgtgatgggtgtaccaccaaattttccacaacgcatgatgccaccgccaccaggtctcgttcaattccagaaagattctaaagatgtaaataagaaggaagacaggcaattaaggcaaaataaaaatccaaacggaacaagaaatagcaagggaaaacaagaggaaacagcaacgccagatctgcctcaacagcaatacatgccaccacccccacctccagggttttttccaatgcatcctaactttcctaacggcccaatgccaccattaccacaggggttcccaatcccaccaaatggtatgttaccggtaacaggacaacagccacagccaccttatccaaatatgatgctacaaggaaatttcccccctaatttccagcaaggttttggtagtaactcccctatgccaattccatctattattaatgccaatggcaaaaatgttacaaaccagttaccaccaggattaaactctaaaaagaatataaaatgagatgcgtaacgagcgagtacttgacaggaaacgacaaaaacacagtgaacatactatctaaaagcatgttcttttccttttcatttttcatctttattatctagagtttgtatataacatgtatcctatattatcttatcctatcatcatcacttaacttgttataattctcccatatacttatgttttcgcctttgatatttactagtcgaaggaacttttttcgcagttagtaacgtcacgctcggaactaaacattaatgaatgagatgcatttttatacaacacttttacaggctatatacaactaagtgattttcaatacattaaaactaccagaatggacaccaaccgatataatgttggcataggttttccactgatgtggcttgttggattagtttatccacttgttctggaacgtccaagtcattaaaccttcttatatcgttccccgttaatttgtcagtaatgcgcttcaataccaacatggcccttgcatttcgaatggcattcttgtgctcgttttccaccctttgaacttcttcttcggtaatagccccattactcaatagctcattggcattcatcacgggaagttgaatgcccgtttcttcctcaattttctttgttggtaagtcaaaaccccaattgatcaaaggatcgaaagcaaaagcttcaaggattgccattaatgaacccttgttatctctaagtaccttcataacattctcacaagtaatacggaagctaccttcaattccactcacttccattgcatatgttaacattctagttaatctaaaaggtactttttcggggaatttttctcttaatatagcagcctcgaaacaatcaccaaaatcaatatgaatgactttcccagtgattctatccaacatcaaattactagggtggcggtcacctaaccccaatatataaccggtcatggacatcacggctagcgatcgagtgtaagtagttctacgctccaaccacgtttccgatgacctactcttcagccataacaccttataaagatcttgtccctccgtattatttagggcgtaagtgaagacttctactttctgcaacaacgttaaattgtcataatcaggtgccatttgtaacatgacccaatgctcaatgtttaaaggaatttttttggcttctctatgctccctaattaatacatggaacgtgtcactattcggtacccaacccagtaacccagacttcggagataatgggattgctggatattgctggatatctagatgccttctaaagcactcagcgtcattttgcaaaagcgtgttaactagtccgaataattgcatgaccaagctatcctgtctaatgtcttcatgtcctttcaacacatacttataatctttaccatcactacccttgatacaaaactttctcggtctttgtttggatgagattactgaaaatactggctcgaatttagatattttaacaattggttttccaccacttgcacgggtcccggggacagccaattccaaatcatgcgcagatagtagttttggcgacacatgttgtagttcaagagtttgtaattgtggcaactgtttaccaattttcctgaaaacattatagtaaatgtcccacgcttggtttaaattactaacatctttagattttttgtaattcatcagccattcgtaagcgtcattcaagtccctaccaaaagaattttggaacgatatttccctcaaagtttccggtcctctcttcagcatttcgtacagaggctctaaagcagcaaacattttttcggtattatgttctccaaaaaactgcctactggcgtcatccagaccctcataccattgctcatgccaaagcaccgccatacgtatcaattcgtggctgacaagttcagcctggtcgaccaaaactggactatgtattctcatcttttctatgatggacaaagctgctttctgtcgtgagagagattcggatttaatcgcaaccattaaggggtacactaatgcctgcggatgagccttacctagatcagataatagggagagtaatgacctactaacaatttgattgggttgatgaattctagaaattaactgtggcaacacttctaaccatgtgcctatttggattaggttgaaaccctcgtgcatagcttgggttgcttctggaataccaccaaaagtaaaccataaagttaataaccttaatgcatcttgaagagagcttgattctgataaagaaatggaatgaaaaaaacccttaattgctggaattacgtgcctgtgtattaaattagaagagtaatgaacttccttagcatcaaatgtattgacgccgatcatgccattatcaaactcattaatatcagttaccgaggaagcatcacttccttcctgtttctttttagagacagatgttagcatagaaatgacttcaaaattggccagtgcccagttatgccacgctttgtaccatgtgttgtcaaaatgtgtagcgagcaaataggagcctaggatcgaatctggattgctcaatctccatttaggctgtaagcaaactctccattctccttgcttcaagaaacaacgagctaaaagcttagtataatcttcaacgtgacgagggactcttttgctttgttgaggaacgctttgagctatcatattatttggatccaaacctaaatcatgagccattctagatgtgaaattaattaattgcttcaaagcctcatcttgcaaccccgtagcccacaagtacttcagttgtgcataaacaactggaggggatgccttagcagtattaggatgatctgggtcatctgtttcttcaagcaatgtatttaagacttttttagctagcgccatcctacccgattttctgcataagttggcaaacttaatcctcacttgagcatcctcctttggctttatcaccaatgatctgacacgcagaattctttgccacacatcaatatttttttgacagcccagtaatctggtattccaagtttctctcatagttagacgtttatctgaattttgtggcaacttcttatatttgatgatttcctccaactctgctataatctgcgctctaacaacaacattatatgctctattgtagctttcattaacaagagctgacaattcagtaactagaagatcccttgcattaaagatgtgaacttccgccttcttaaaattattcctatgcaaacataaaattgcatcatagaattctttatctggagactgcgatttcatgacgctagtatactgggctatttcatcccattgctccaaaccccaggcagcggcagccaaaggcgccattgccttcttcacttcgggttttgccgtgccccacttttcagatgccaatttagaaagctcttcccactctccaagggcatataacgatcttaattttcccatcatcacttcaaccgaatcttctcctgctgcctccttctcattatatgctgcaagagcatcctcccaacgttgaagtttttcataccaagtttccttcagctgcaattcattgtgttgttgcgcatgcttcaaaataccaatagcagaatcagtttggtgaagttgattattaatgctaatcaatgcctcgattgttgaatttttcggctcttctaagaattctacctctttgtaatgtagtgccttcgcaaaagcatgacatttttgggcatacttacctaatgtatggattgggataggcaatggtttgtcatcgtgctccataaattccactaaatttaacaacatttgataaatctcgggtgggttttcagaggatgataaagccttgcataatgcttgaatcaaatcctcttggtatgacgtttgaagctcaacccagcaacttgagaatgaagcattaaacaattctctcgccaacggataataaacgctgactaaactcgaacaggatcgtagacaagctgaaggtgattcctttagaagctgaatagatagccttcttatccattcttgccaatcttctttggtcttctgttgagaacaataccatgcattctttaggatattttggtttaccggtaatttcgttacttgcatttcgtcttcataatttttcctttcaggtacttcgttctccttgtcaaatatgatatttgttggcaagcattcattgttcagtaatttattaaccagttgatcgtacactgaatgctgaatcctattcctcaataacgccttgttaatcactggcacaaagaccacaaagtcggtacctagttgtaaaaggagcaaacttagcgtattcatggttgcttttgttagttctctatccccattattcaaaattcttaccaacgcctgaacaattcttgatgacatttcagagaggttgatattctttgctaatctacccaaagttataatggagattttctttagacttccagcagaatactcagtcattctaacaacgataggcataatcaaatgggaatagtcttctagattcggcccaaaagtaaccaaagattttaatatacgaatcggaacgatccttttattagactggtcgttctcaagaatatcaaggaaaaaggttagagtctcgggaacaaatcttttaaactcaccttccagagccttagatatcgattctatgacagaaataattgtgatttgtagtttaatgatcgggaaaaactccctgatcacaccataaattttctcgacatggggcctaatatgttgcttgacaattgagatgagagatcccagttgctgaaaataaaagtcaagttgggacggcgggcatgaacgcatgactaaaatgatacctggaataatttgatccaaaaaggagacacatcgtaaaccaaggttttgaaaaatatgcataatagcttgaatagcagccgtgtgatggattgacaacgatggatcattcaatatcttcatcagattgtggataactacagtggggtaatattcatcgttggatggagataccccttgcattagcaatgcgatgtcgattgaaggagcattttgctctactgaactctttgagtttgatgtgacttctatttctctgtgcttatatggatcaagagcgcctaatataccaatcaaacgaacagttccacgcctgatatgagggttgttttcagtcttaagaatatttatcaaaatgccaagtaactctgggtagtctagtaaagggccaacaacataaccagaggaagcagccagctgtcctaatgttgttaaggcggcatctcttttaaaagagtttgattggtcctgaaatgtgttaatgatcaatggcatcaattcctttaagtaacgcgtcatttcttttcctccaacaacagatagttcacccaaaacctttaaagcggtggatgctacggcagatgaagcatcctggcatttaggaagaatgacgtctagaataggatcaatataaggtttcgctacttcatcgctggaatttatcagcgtacataatagagttgcactttcctcctttttttttggcatatttgagaacttcaattgcgttaatagttccagtaaagttttcctcaaagaaggaactacataagcggggttgacagaactcaatctgcctattattttgatagcttccaattgaataccaaaaatctcatcgttcagcgccatgaaaagtaggcgtaaattgtctggttgggccaattgaggatcaaaatttgaccccaaatgctgaagaatttccaatctaatttctgcaaccggatcagttattgcgatcattaatagcttacttagcacttcagaaaccgagtgtaaagcatgaactgatgtttgtttacatatatcgtctttgataaataaatcacacgacgttaatgctgccaattttctgacagacgaatcctcatgctcaatgtaagaaatggttataagcctaacaaactccgtcaaggaatattgatgatgaattagttgcagcattttaaaacactgaatcaaaatttgggcatctgtaatatcgtcattagattcaccagtttttttcatgaaactttggtttcttgatttacgagccttttcaatggaaaattgattattaaaatcgtattggtttgattgaataaatttttcaccagataaggatatcgacagtaaatttagtatcctcgaattaacggtagattccaaagagggtattttctcgttaaggatcattaaagtctcctgcatatggtcggacattggacagtttaacatcaaattaagaagatctttgttcaagtgcttagcaaaagctgggcccaaagcacaagctaatttaccaatgcaataaaataaatccttctcgaattgttttctaactttgaatttcgttcttaagccttccctaatattatccagaataagtgtcatatagggtgaaatgctcgaaccaacttcaaatgcaatatcacctatagaaactaatataaaaggtttatccgaattatttgcagcattcatatcgatgttcttcaaatatcttaaataatgaaccattatcctatcgagatatttctttgtgaaaatggcagggtcaaaagcagctaaaagaggtaaaatagcataaacttctctccttataacatcaaatttatattccttgtacttcatagtagatttgtaaatatcatcatatttatccctgagataaggtgctttcaagctgagtaattctcgaaataccaacagagtagcatgcactgaatcattcgtattgagacttaagccatgtgtacaaccttgaaataatctttgaaaccactgttttcccaaagcagggtctctatcctgaataatagtaagacatttacccaatgccactgcggcatctaatcgtataattaactttgcatcccttaatggcacccaaatattgtctaagatagagttaacgtaagggtataaaagatagggtgaattgtctgctaatgcctttatgattaatagcgcagcatgtctcctgtattccaacttagagctcgatgagttattatctgctgtcagagtaagccaatcaatgcaagttctgacctcaaattcgacgaaatctgatgttaatgtaccacctggcacggtcaatctacctaaggtgttagccgctaatctcataacttcaatgtcactggatggaattaaaacacgtaaatagttcgccagtcttgaagtttggtttggcagctcctctgtactcaggtagaatgagatcagagtatcaacagcaagaataccacctatcttctcacttgaagtaaacccgtgaataagttcaaatatcttattgtttaaactgttgctaaacctttgaaattgctcagcagatacttcccttgctaatgaggtcaaagtagtgcttaattcattagcgccagaggctcgttcttgtggcacatcgcttttaagtttatcaaaaatcaaatttaaagtagaaaatgttgtatctagttctgaatctacaaaggatattttaccaatatgaccagcagaaccagtgatcactctaccagagtcattgggcccattgtgattggaatctgtgtttgaagtagttgacatctcatcatcgtgggagtgcgatttgtgtgtaagtttctttcttgttctgtgtttgccttcggccctttgtcgtaaagacaataagttaggtggcgtggtgtatttgttaatgtatttattcatttttcatatggggaaagtaaagatcagaaatctctttgagaaagataactatttgatcttaatgactatgctctttatgcacccggtatattttccctttctactgctcctaatctacctgtaaataaatacaagtaaagctcagttaaggaagtgattggtgtcacgatgataaaaattggtctttcctactgtcattacatttcttccaattttaattgctgccatatatgtcagtctctattcaaacatattcagtgcttaaaaaggaatatccgggtaaatattctgacatcgcccaagaaatatacgatataacttaaagaaaagagttgtagtaagctaatagcattaagattaaatgtatgtttgattaattgcaatatcatgatgttatagagtaacgtggtataattaccacgattccgtcgaattgtttgccacttatcactggcgccaaaatgcagcagtatgtaaaaaatgacggtaataaatatataatacaaatgcatagaggaaaggctatagaaatgaagagattcatgaattttcagtcaggttctccgacttttaattgctgtgcccctcctcctgcttctttttttcctcttcttcgttcttcttcttttcttcctcttcctgcttcttcttttcttcatcttcattcttcttgtttttctcttcctgcttctttttttcctcttcttcgttcttcttcttttcttcatcttcattcttcttattttcttcatcttcattcttcatcttttctccttcttcctgcttcttcttctcttcttcttccttcttctttttctcctcttcctcctgcttcttcttttcttcttcttccttctttttcttctcttcttcttccttctttttcttctcttcctcttccttctttttcttttcttcttcttccttcttcttcttttcctcttcttccttcttcttcttctcctcttcctccttcttcttcttctccctccgctttctttcttcaagtaacttggcataagcatagtcctcgtatacaataatagggtccttatcaaacatttgaataccctttctgttaacgtcggataaagttggcgcaaaaaggtctaaaccatatgaatttaaatccaaaaaggagttgctactaaagtttaaatttgatttaaaatccacaggatttacttcaacagtattagcaggagtataatcttctgtgttatcatctagagttgttccagtttcatcaaaagtaatgttgaaaagtgaaaaattcctgtatttcaaactttcggacagatcaataatttttccgacatattcttcatgaacaatcttggtaacttgatctaatgtagtctggttcatagattttgataaatccttccacatagctttttcataaccaaaaagaaatgggtcctttgcaggggagcttaacttaggagcaacattaatgcgcaattgatgtaataatttctttttttcaataaatgtcaggttttggcagtattgaatttccaattccttttgcctatatgcagtgacattgaaggaattgtacaagttagtaaatacctcgataaagccagcttttggaatatttttataaattaagcgaacatcatccatggataggtttttgaaagagtattcagagactttgttggaatcaaaaagtttcgactcaaatttcgtagacgatatttctttcaagaggttcggattccatgaattaatactggggatgtttggataccatgaattaatattactgcatttctttaacccgtcatagtcgaaccaaaatctaaattcgggcaaataagcagtatttttgtaagcatcaaatgcatatctatcaggtacatgatattcattgtgcaagcagtaggtatgtctgtgaggaatcaacgctggcacaccatggaaaacagtattgattaagggagatagttcctcgaacgagttaaaatggttgtttctacaattgtaaagtttaagtttttcgttgagaaaatatctttgtttaggattcaacttgttttcaatggtcttagactttggtaactcttccagttcctttttcaaaagatctttcaaatcagtatcagtggggactcttttatgatttttattttcgtcgctggtaatgtaatcacgtagctcagtgatgtttagtgtagccatattgactaacccatcatctactttgtcgggcaaagtagcggtctcaccgttcgattcagggatattattgatatccaaatgttcctcttgcaaccgctcttcaatataagaattcaagtaatccctactaggggcagaagtgactagctagaccggtaatatcaatgtaaaggccggtgtcgacgtcaatgaatcttgcatcgatattgttttttaccgttaccgttaattcttactgtcaaggagtcgctgacgtctaggaaataacgtccattaccctgtcttgggtcttccaatataagagattggttgaagtattgactgagcaattgtaaatgcttaatgggcatttgcaagtcgaaatcgttatcccaaagggaaagccattccattgtaaagatagccgtacagcgttccgtgagacaaccaagatatgatgccgttggctttagtaaacttttggaatgttctgatcattgagttcaatctagcctggtattcttgtttatcattgattaatgtatcaacattgaagaacctcttgtcacgatggaaccccatacctttatattgcttcacggcaccagcctcatagaagaactttctttgcaatgcagggcttgtctttacggaattcttcaaactgttcagataattctcattatgagcggaaaatttgtccggatagagtttcttctgttcctctaactcttcaatttttttggaggcattcgaacttgaaatccgaagggataaataaaccaaatctttatcaaaagtgaatttatcagtttcttcaatttccagtttgtatagggagttaacttggtcgttattgacgaattcctggaaaagcctgttatggttgaattctacgtcctgtttatttttctttctcttgttcgtagaattaatgttatcattaatatattcctgcaacaggccggattgcaccaagttttttgatttttcagtttgcaaggggacttgatacgtggaattatctgattcgatgatggaaatggatagtggatgcgactgtgtagtcaaaatgtagtttcttgcctgcaattggtaaacttcgggtctaactttatcatacagctcctttatttgaaattgcgtattaaatcttaaatcccttaggagagccatgcccgtctggagttgaatagctttggaacaatgcttttttagttcctttgagtctttgattctgtcctggtttctagcggccttgtaccacagtttctgcgcgtactttggtctttcgtataggaacaaaggttcgccgagctctgtctcaatggcctctaaagactctttgtcgaaagcggactggaaaagaaaattgcagggcagaacagttttatctatggaaatcagcttattcagctcgtggaaggttgtccagtcgtaccatgaaaagggtaacttttctggctgatctgcgtcattattttgcaaatggttcagcacaacggaccacgtgagacgagggtcgaagtcgtaaaacttcaactcatccacggattcgagcttactgccctttcgagggcccattttgaccgagagcaggtcattttgcagagtatattcattgacccatttagggttggtgccgaattttaaattttcgtataatgtcttagcgaactggatcttgcgatcgtttttgaaagacgaagtcaggatgctataccaggaatcatcatcactgtcaagttcgttgtaatttggtagaaggtaatcagcgtcccgcccaagtccgttacgctgcggtgaatttgaccagataaacgttataatgatgatctgcagtagaatcagtggaaggagaatgcgccttaatgggtagtgcttgacacgcagcaggccagataagaaccgcctgtgaagtttagatgatatcgctgaagcataactaattagtttatttgtgtgaaggaatagtgacgttgtgatgcggtgagttcggcggttaggggaatggtatatgataaaaaacggaaacgtgcttctttaatttaattgtttaatattgttgcagatatataaaaagggggaaagaaccaaagatgtaattatttctttattgcctcaacctaaagcaagcaataaggtatagagatcaggacgtctcgagagctgatatcaaatttgaagccacgcaagtaactacgtaggtcagagggcacaaggaataacacgtgacatttttcttttttcttttttttttttttttttttttttgttagtcttggcttctgtgccgtagtctgtatacggttttagatgcggtatgtttatcatcgcccagaaatttgcggggtgcaaagaaataaaatccgtgctgaaacccgtgctgaaatccgtgcaccgcatcaaattttctcggaggattctttgcagccggttttcattttcttccacggaataccaagcccattgcatcgcgatgttagtttagcggagtttcttggcattggcaaatctctgctaaatgctgcgtacagacggaaactcacaccgccgcgaagactggtcagtggcaaaaaaaaaataaaaatatagaaaataactattacgtatgttactgtttctggtagttgatatgaagttggagttgtatattgtacgctttaggaacagggaagtgaatattatttactctgctgcacattctggctaggtcgaagccggaacttgagaagacgccgcgctagaactatggaccaagctgttgacaatgttcagatggtgatgcacctaccctgtgcggggagtggccacggacgcgagcggaaggtgcggaaggtgcggaaggtgcgggagttgcgggaggttcttcgctaagcgtgagggttgctagctggggcggcggggtttccctaagtgtaaataaggcctcggctggcacatgagtcgccggaggaggcggcggaggcgacgacgctaaaaccgtggccgttggggaaggatgggcggctatatctaccattgacctgatggggactcggttcttaaggaatgggtttgaggtgggtgtggttgcagcaacatctgtagcgatatggaaaccccgcggattctcgtacgtagtggttttgataataggtttcttacacacatatttgtcgttggcatcaacacaagtctcaattccttggaaccatgggtcttcgaagaggtcgtcgatggtgtagcgggtggcggcttctgggtcagcgagccgccatgccacgcgagatgcatgtccgttcttgaaatttctagccaagtgatactccattcccggccccgggcggtaattgcgcgattgcggaatgcgcgatcgtgaagacggataaagttttcataagcgtcacagtaatcgcggaaaccagtgtcgaagctgcaggattccaaaaatggaatgacgttgttgacgagggtcatgaggataatacccaggccataacagtctagagcgcgtgggtcatacggctgttgcaattccgtatcgtagtgcttcttggagtcgtagaacatgacctccgggggagcatacggcgcgagccgatcatccctgcgcacttcttgacagggctggacaggtcgtgtggatccgtggtggtaccagtctgagataccaaaatctgtcagcttgcacacgccgtccggggatagcagtacattttccggtttcaaatcacggtgggcgatgccctgatcgtggcaaaacttgacaccacacgccacctgtttgaatatacaaaacttttctgctagggccacgtggcgccagcccgatttttgtatcatcgcgaacaaatctcgtagacctagctccatgacgaacccccacccgcgagtggtgtagacggtggtgggcaccttgactagaaggaaagtatttgtgatgtgaacatgatgacttagctgctttgcgatgataaactcctttggagcagcgttgtagaatttctcgggcgtttcattatagatcatattgagcttctttagagcaaatacgtccttcttgcggtacttggagcggatcttgcgcacttcgcacgaaccgccccatccgatggtcttattctcatcatcaaagacgaagttatcgctcaactggatgcttgcctccttcatctcgtcgggcagatactcgtttgggtccacaattgggatcggcagcatgcggattttggaatccccatcgtgaaggtagaagcccagatcagggtctttcttcatggaggtagagacggacgagagtgacgtgcttggggttgagacgccgtatggattgtacactaatcgttcgctactgaacttggagtttgagagattacgcgaagtggacgaatgtctgtttcctcttgagatggacgtgctggagccggccggaggtaggatcttggttgaggcggaagataaagatctcttgctgttggttgtgtgagcgaaagagtttgcacggcgagaggttttcaacgaattcggcagttttgggctggaggattcgctgtcattagtacttgtagagtggaagtctggaggtagagacgcctttttcttcaacttgttcccatggcttgaacttaacagcttctttccgaagaacttaaatgctgataccgaggagattggttgttgggatatcttcgtagaatgattgtgtgagactgtcattggttggtggtgcgatttaatgcgtatgcttgcctgtggcgttaaaatggtctatacgtttatgctaatatttcttgatgtaatgcagggcctatgaatacatggaggtttgttgccggtggtatacggttgaaaaaaaaaagaaatagatatatatatatttcttctttgtatagacttctgcgagaaaaagaaaagataaggaaaaatgaaaaaaaaagcgtataggtgctaagaagaattaagtatcaaaaggtagcaggacatttatgttatatatgcaacttcggatttcgttcaatacatcttgaccggtctccactgttactggcatatttctcgggtttttccttttcaccacaagggaaaaaaaatgcgttatgtaatttcaccaatatttttcccgtcctgcgtgctcgcacaatacaatagggtcatgtcacgtaataagcaacgtgcagccgcattttttgccctttaaagggaaacgcgctttgttcttttcttcttccttttcacataagggagagtcggctaccaatgtcgatggaattctcaccattgggcatctcaccgttcctatccttctggaacctatcgtaaatcccccttaatttgaccaactcacttgttgaaatactaggttttgtctcttgacaggcttccaataaatcgtttattgtgaccacagctgtcagctcagaagcagctgaagtgcttgtctttgtctcgtgcaccacatcttgctgcaatagagtctttagccgtagtctattttcttctctacgcccgtgctcattgatactgaagtattctatattatcattgccgggtaccacttccgattggtctgcagcagacagccacctatgtacagatttcaaataagcattgtagcagagcccctgtaaatcagcacccgaaaaaccagctgtcttttcagcgatcaacttcaagtctgcatttttctccaatgcaaattttttttgtcccgtatccttgtcttttgaattgacgatagcttgcaagatatctaacctctctgattcagtcggtatattacagatcacacttttgtctaatcttcccggtcttaacaatgcgctatcaatcaaatcaggtctacttgtagctgctagtatatatacaccatcaaggccctcggcaccatccatttgggtcaataattgattgactacacggtctgtgacaccagtggagtcatgccctctctttggcgcaatagaatcgaactcgtcaaaaaatagaatacagggtttgacggactgtgccctttcaaacaattctcttatgttttgttcgctggcacctataaacttgtttaaaatctctggtcccttaacggagataaagtttaacccacattgttgtgccacggcgctcgccagaagcgttttaccacaaccaggataaccgtaaagcaagattcctgatctcaatcttaggggacaattaacgaaaataggctcatattttgtgggccactctaaggtttctagaaggacatctttggcatttgctaaagcaccaatatccccccatttgatgttcgtttcttttgttagctttactccacgcaacgcagatggtgtaaacgcactaagcgacttcgaaaaaagttcccttgttacaacattatcacaatctctttccaactgcaagtcgtagaaaatcttttctgtgaatatttccaaatctagtggcgaaaatccttctgtctccaacgacaaatcactgaattgcaaatctcgatttagtttcatgatctggtttttcgagaaaaaatactccagtaacttcgctcttgcatgtttgtcaggtgctctcaaagaccacgtctctgaaacaaaatgcttatcaaacaatagcggattaatttgagttttctgcttgcctgaaaataaaactctgattcgtttattatccttgttaaatatctttgtcacctgattgatgaaaaaattcaaaagtttgcttgcattatcccattggccattattagaaggatctccgtcattggcttgaggttttccaaatagagcctcaacgttatccaacacaatcaaagaaggaccataccaataacaaaaagaacaccattccataattaatttttgggttttatctaaatttgatgtctcgtgcaatgtttcacaatccgcatatttaacgaagatgtgatgatctttttccacttcatttataagctcttttaataaccttgttttaccgatcccttgcttaccatctaatataatagctggtgtggcaataataggcgatgtcaaataattgaccatttctttcttgatactatttaccgtaatgaaatcatcttcatctttactagtgcgcgaaacttcgccagtttctttgacgtggtaatgtttaggcaaatgcctttcgataatatctttaacttcttctttacccatttgggttactttccattgaacggattcattggaaatttcattcaaattacacaactgctgctcggattcacctttttttatttcgattataatttgctctgttggaagtattaagttattggtcaataagctcccgcccaacaacttagaatactgatccccactcttggtaggaacgtccttgccaaaatatttgatattgactgttgcatttcttccggatattatatttgcttgattcatttgtagaaactctagtttgatttttgctccgttcattgggtgcgtaaagaatgcatcccaaagatgagagcttaatgcaatgtgattttcgggtatctgactatcacattttataaaaaccccaatcttcttcgaagggataccaactgatttattatctgaatcgcttttcttggactgccttaagctacattttacgatagaagcgtagcccttctgagaaggcaattgtgccccgtcactgatatatacgacaaaaaggttatctttagggaagtccattttgcacacagtactcctcaatattaccttctttaaaagttggatagccccattttttagtattgtcttattactatgaccatactcagccttcaccaaacgtgttttattgacttttggtgccacaacaaccaaggaaccatctgtgatcctcgcagacttcattgatggctccaccctgtcaattttgaactttgtaacaattccttccaaataacaaatcaaagtctcacctggggtaactatacgggtttggtgcaaaatctcaccattttggaacctcatcgcattggcatcgataatttcccaatcatcactcgtttctggcgtgacatacacctccgtagccaggtgtgtgtggtcatatcgctggatgtataagtccaccaatggagacttttgatttaaatcatatactgtggccaaaacaggattgataagaacaacattctcactcgatccagaatcatggccatcccatccaagatgaacaataggtatatctgaattatgagaatggactgctataccgaattcctggatagcgtagttggttgactctaacacgtttataattgaatgcggtaaccttaaaaagtttcctactatggcattggagaattggattctcagattctcaaacttcaacctcttggtcgtcgtcatttgaaagagcagttcctcaggtgtttcttgttactgccgtcccttccagaagaaattcgacgatgacaatagtcggagagatattccggacctttataattgcggctacgcacaagaataaatcgcgatagtaatcggatataagacaataaagtccagctaacttggttggagaattcgacagattaccatgaatatagaaatcgatgtttttttttgtccacgccgattgatcagccatttttttttatcagggtcgcaactgccctgtgcaaataagaaagcctgaaatggttgcacaaagaccacaaacaagggcatacgccagtacagtattatggactcatgccatcgaggttacatagaattagtttaaacaaaaaccaactatcctctaatatccatggtacgagtatatataattgtatgaagtgtaagaatatgatataaataatgagagcactcatagagagtaacggcgctgaattgtaagaactgtcacgtagtaacacaatcactgaaagcatataaagtgaaatgagaaacggtagtaatatcatatgcattaccaattccttttagtgaatttccatgtgcccgaggggggacttccagtatattctgttacatttaagtaaatacttcatcaacaaatagggcccagcggtttcttacactaattatacatttacaacgtaaatgctccagctcaagcattatttatatatcttgttttcaaaagaaaaatatagcaattagactccatggccaagttggttaaggcgtgcgactgttaatcgcaagatcgtgagttcaaccctcactggggtcgcttatttttaacttttttacactgaagaaacaaatcaattctaatacaatgccaatggcttcaaatcaacctttggttataatagttaggagaatcgatgcttacatagtatattatttaaacaattaatttgatttaaaagatttttgtttcccttgctgctgtcattggctttctaaattacataaagcagatgaaaagccacactatgctgaaaatagtgtgtggatgcatctacatgatgatgcaacacgaattggattttttagcttgcttataaaacattttggaacttgccgttaatgactccgatttgtccaccaaattatccaacttttcacctctttgtaaaacattctcaatcgttttgtgcaaaacgattttcgtctcatccagttcttgttgaactttcatgatagcgtcagcctgtgaaggatcttgatatttgctaatgtaagtgtccagttgcttcattttcaatgcatcattggtctcagtcacatctgcccactcttccttaggatgtgcgactaaatattcatccaatattttgtttaatagtgtgtatgctggtctgacaggatattctttgtcggtgatcaaaacaccacatatgccctcactcctggcataaacgtggccaatatagttgccttcttctatactttgtctttgtcctgcaccagttctagaagcgaccgtttcagcaaaaaaagtcataaactggccaacactagacctttcaaagaaaccaaattgtgacaagtctttaacttcactcaactctagagccttttctcctccagagcgaaatacaccgatgtagtagattctcattgccaaaataacttctctagtgatacgtaaagcttcagaaatgccctagcctggtctaacgcagtcaaactgtgccagagacttttgtatattgttcatgttgatatctattgtgcttgctcttgatttcacaccaagccaatcgttctgtacggcacgccacccaataagaaaaaaagggaaaaggagccgaattttggtttaaaaacatataatgctgaaattgtggaacaccaattaccaactggaagtaggctcgatccaaagagtgtatattatcagtaaaatgcttcgcaacttagtcgtcaggaatgcgtgcagaaacaggccgtcaattcaagtggcaagggggttatgccgacaccaaacaagacgtctcatggcgtcctcccctcagttcggtaggaactccaatcaggaaaaaacagcgggctttataatggggattctttctatggctggtgctttatattttattgctcctaataggaagcctcttttcgcctcaaggaaggtagaatccgataaaaccgcagaggaagagctttccagtggtggtgagcaatcaccagaaaatgaagatgacaacaacagcaaaagcgatgaaaatggagatgacaacgacagcaaaaacgatgaaactgaagctggccctcaattagggggtgataaaattggtgcttcaaaagtagctgaagatggtgaattggttgttctagcagaagaagacaacaagtcttccgaagataaagatactgatgaatcaaaggtatcaaccaaagatgatgagcaatccaatgaagacaatgccaccgctaacaatcaaaaggatgaaaacataagttctgagaactcggaagaaaatactagtgacaaaacactagacaacaatgctggatcttctgaaaaaaaagatccagaacattcagatgatgaaaaatcgcaacagggacaatctgatgacaagacaactactgaagataataatggagaagaagaatcctcaaaaaaaactgtaagtgactcggaaaattcagctaagcaatctgaatctagcgatgaagagaaagaagaactaagaaaacaagaggaaaagcaaatgggtcctactgaagaagaggttcaacacgaaggtgcttataacccagacactggtgagataaattgggactgtccttgcttgggaggtatggcccatggaccctgtggtgaagagttcaaatctgcattttcttgcttcgtctattctgaagctgaaccaaaaggtatcgactgtgttgaaaagtttcaacatatgcaagactgtttcagaaaataccccgagcattatgcagaacaactaaaggaaacatctgatgatgaggaacctcaagacaaagtaaaggtcaacacaatagaatcagcgccaaatgtttcaagcgcaaaggaaaatgctgcgaaaaaagcagagcaatcagatgtgaaaaaagaaccattgaatgaggaatccaaaccttaaaatctcctgaaaatctcccgaacgtaaaaagtataaaagtataaaggatgatacatgtaaatacagtaatattatcttagtttaatgactacatatggtataatatgtgaaatatacatgaattaatgcatctgtggggcggatgagtctagtctctgtatgaatccagctatacatcaaatcgtatccttttatttacagggcaagtttgtcatatattttaagttacttgtagtttttttccagctcaataaatttttcccaaatttgagacattgtaagtttctcgaaactctttctattatcacgttctcgaatgttgtatttctgtaactgtacttcctcatcacccacgataattaaataggaatagtttttcaaaatggccgacttgatcctataccctacgggttcgtttcttatgtcgagatcaacattgaaatgccaatcatttaaaggaactggttccatgtcgtcggcttccagttcattacgtagttttttctgcaaggcagtgcacatgtctagctgttgcacatttttcgtattgacgggaataattacagcttggtaaggattcaaccaaaacggccaacggccctcattagaatctatcagtaaagccataaatctttcgatagaaccaaaagtagctctatgaatcataattggcctcttgtacgagttgtcttgatccttgaatttcaaatcgaacctctcaggtagctgaaagtccaactgaatagtagcgacttgatgagttttgcgtaaatggtccgtaaccattatatccaactttggaccatagaacgcaccatcaccagggttcagtttccacggtttgcctgattcttccaagatttccttgagtacttgctcagcatgattccaaactttgaggtctccaatgaagtgatccggtcttgtagaaaagtttataaaataattgctctctgctccagaacctcctttaacaaaggggaaaattttgttgtaaactatgtcgattaattttaaagagttgaaaatttctgatttcacttgggaaggagtgcaaaagatatgaccatcgtcttgatggaacttccttagtctagtcaatcccgacagtgcaccagaagcttcatttctatgtagtggtgaaaaatcagagaagcgtaggggaagttcgttatacgatctatcctttttaccgaagatcagacaatggcctgggcaattcatcggttttaaaccgtattcctccttttcttcatccgtagtttccaccttaaacatgtcatcagcataattttcccagtgaccagacttttcccaaagagtctttttgtaaatcaaaggcgtcacaacttcattaaaaccaaatttgaacttttgttgtaacttcataaactctatcaatttgttgaaaatcttagcaccatttggaagaaagaacatggatccaggagatagtggatctgtcatgaaaagatcttgcctctgagataccatggatgtcatagtagctggagtcgccgacgaagcgttcttagtggcctttctcgtagagtagaaagcacgattccaaagagcattgcgagaacaatgccatcttacaagttgtattttcatattgcgagacagaaggacgtgcccttagctattgcatatgtttttctttatgtagttcagcagctcttctttttttcatgctcgaggtttttaagggcgaactttaactagatggattattcagttttttttaaaaggatcaaaatcctacattatatatatatatatatatatatgtttgtgtgtgtatataaaaaaaaaatcatttcttgatcaagatcagcctcttatatatgtcgcatcaatcttctgtagggatggaggtaagttcatagtcagttttcttctatacgaagtcttattttccagttgaatagggtttccctccagataaatggtctccaagcgtgatagggcggacaggttttcacccaagctctcaaaggattgatctatcttgttaaaggaggcccatatgtcagttaaatttgacaggtggttcaagttttccagggaggtaattttgttggaggtcacgtccaaagtagttagttttaggtttttctctagaccttcaatcttggtgatgaaattatgtgacagatagagctcttcaagattggtcaactcttctagattttcaattttttttaatttattagattggatggacaatatcttcaaattctttaaaggatgtaagttaataagtcttggtatggaatttttacccaaccaaatttcttccaagtttgacagaccttcgaaggaatcgggttcaatagaatgaaccttattaccacctaattctaagtttttcagtgatttcaaagtggacagattttcaattttggaaatgctgttctgcacgaagtataaattctccagatcagtcaaattttctagatttttgatgtgcttgatcttgttaaacgacaggtctagagacgttaatttggtgagcttattaacattagaggagatatgtttaattttgttatcgtaaaaatcaaggtcaacaatcttgtcatggggtaaaacttccacttcgcttatgctttcgatcaggttctgtctgagacataattgtttcaaattcttgaacctataaaggttcaaatcttctaacgatttgatttttagatggaccaagtcaataacctctacatcatcaggcagatcttgtgtcagttccgaatctgcagtgatgaagtcaggatttgtatcgtctacaacctcaatcttgtgtctttcgtctttttcttcactatctttgttaactgaattcttatccataatgatggctatgtggtgctagatttcttccgacttcttgctattttcattcaaaaggttatacatgttttatttttcaacagtaccttaatatataataattcggggccaaaataacaaacaacgagaaaaagggaggagagagtaaagtatagtattaacagggctggttatatagatatatatatatacgggtcaatcgatctatttatatacatacgaatataatatgacatgggggtgacacgatacaatataatagagcggggacggacacttagtttgcgtcgggattggaagcgatataatcgaccgtttcaccaacacttctcaactcatcagccactttgtcagggatttcaatatcaaattcttcttcaatagctacgagcagctcgacagtgtccaaggagtccaaccccaaatccttgtgaaattgggtatcgctggagatttgcttgttggcaatgttgggagagttcttatcaaacgccttgataacatcaatgaccctttgagaaacctgatctttgctcaagtttgcagaataaaatctttgtgcgagtatggtgttggacataacggaacggcccattatagtgcggtacgcagaaggtgccacgcgggaagaaatgcggcaaacggatctaaacatggcaaggaaggtgctgtattgagttagttgtgttgtttgtactaattacactgcaagtgtgactattcttccttttgcttcgtcatcaccacctttctcttttactcagaacccgttcgaaggggcgaagaaagaagcaattgacaaataatctgtattccgtcaacagtgatatatgtcacgtgactctgataaaactccatggagtctcttcggagtgtatgtgtgaaaagaataatacatataagacatctacaggatcagtctgatagttttaatgctatggtagacttcagaatgtctttttaagtatgccatttggttaaatctgtccttttatatgtacttggtgcttcttttttctttacttttttttttttcagtgagaagctcatcgcaacaagaagaaaaaagactagttcaaaggtaaaagagttaagatgattagtgatggatttctaagtggcagcgttgaaagatcgtgcaaaggttgaaaaatggaagttgcaccggccttatcgactactcagtcggacgtggcgtttcagaaggtggagacacatgaaattgacaggtcttcatacttggggccatgttataatagcgatgagcttatgcaacttatctcggcttattacaatgtcgagcctctcgtgggttatctggaacagcacccggagtaccaaaacgtgaccttgcagtttcctgacgatttaatcaaggactcctcgttgatagtaaggctgctgcaatcgaaatttccccatgggaagataaagttttgggttttagctgacacagcgtacagtgcatgctgtgtagacgaggtcgctgctgaacacgtacatgcagaagtcgtggtacattttggtgacgcatgtttgaacgccatccaaaacttgcccgtggtttactcattcggaactccatttttggatttggcactggtggtggagaactttcagagggcattcccagacttatcctccaaaatttgtttgatggcaaacgcacccttctctaagcatttgtcacagctgtacaatattttgaagggcgacctgcactacacaaatatcatatattcccaagtgaacacctctgcggtagaagaaaaattcgtaaccatacttgacacctttcacgttcccgaagacgtagaccaggtgggtgtgttcgaaaaaaatagcgtgctgtttggtcagcacgacaaagcagacaacatctcgcccgaggactatcatcttttccatttgaccaccccacaggatccgagattactgtatttgtctactgtgtttcaatctgttcatattttcgatccggctttacctggcatggtaacggggccatttccctctctaatgaggcgttacaagtacatgcatgtggcaagaacagcgggatgtataggtattctggtcaacacgctgtcgctacgtaatacaagagaaactatcaacgagctggtcaagcttatcaaaactcgtgagaaaaaacactatttatttgttgtcggaaagccaaatgtggccaagctagcaaactttgaagatattgatatttggtgcattctcggttgtagccaaagcggtatcatcgttgatcaattcaacgagttttacaagcccattattacaccttatgaattaaacttggccttgagcgaagaggtcacatggaccgggaaatgggttgtggacttcagagacgccattgatgaaatcgagcagaatttgggcggacaagataccatctctgccagcacaacttccgatgaaccggagtttgatgtagttaggggaagatatactagcacatcaagaccactgcgagcgctaacgcacctggagttagaggcggccgacgacgacgattccaaacaactgactacaagacataccgcctcaggtgccgtcattaaaggtactgtatccacttcagcatcagcactgcagaatcgttcgtggaaaggtctaggaagcgatttcgactctactgaggttgataatactggagcggatatcgaagaaggtatttccggtgtcgcacgtggttatggatttgatcgcgaagacgctatgaaaaaggaaaacaaatgactcttataatttgtttccctcgacttctctatttaaatccaagattttaactaataaactatttaataataaaacaattaactctttatatggaagccttggaaattagccgccaaaatgggatatacattccgtgcgaagtgaccgcgtggaaggccgggtatcatcttaaaaatcactagtttcttttttagcggaatgcaataaaggtgctttgtgctggtgtggtttacacggaacatctagtagctaaaacttggtaactcaatggtgatcagaatccatagaagcatttttatttcttaaaatgggtgctgctccttccaaaattgtggatggtcttttagaagatacaaattgtatgtacacttcggagtgaggaaaagaaagaaaggggaaattaaccgattttactaacactgacactttgaacagttgatagagatgaaattgaaaggttaaggaagagattcatgaaattagatagagatagctcagggtctattgataaaaatgaatttatgagcattcctggcgtttcgtcaaaccctcttgctggacgtataatggaggttttcgatgctgataatagtggggacgtggattttcaagagttcatcacaggattatccattttcagtgggcgtgggtccaaggacgaaaagttaagattcgccttcaaaatctacgacattgacaaggacggtttcatatccaatggtgagttgttcatcgtgttgaagattatggtaggttctaatctggacgatgaacagctgcaacagatagtagataggacgatagtggaaaacgatagcgacggcgacggacgtttaagtttcgaggagtttaagaatgctatcgaaaccacagaagtggccaagagtctgacattgcaatacgatgtgtaagactaggggacacttcattcatttatggtatgccaatatttttaagaaaagaagaataatacgcgatattgttttttaaggaaggaacgcacactcgcccagttagagtgctgatgatatatacatatatatatgtatatgtaacaaacaataagaaagcaatgatacaacatagagatgagagagagcatatatgtcagcgacgagatataccaagatggaagctgatctcatgtaataactgcggggtgtactttgataatttttgggattccattgttattaatagctttgatatcagacatacagaataccagagattttcctcaaaaatatggcaatgcacaaagggggatcaatagttatataaattaagattattacttcttctttgttttatgtgttgttattcactatcccactgcattatcaatccttacatatcagcttccgttaaacccgatgactatctctcaatcatcatactatcttcttacaccgtatatgataattaccagcaatactaatgctaggagacagaccatctttgattcctattccaataaagttaaactgtgatattggtttattggataagttcatatcctaaaacgtgttgacaacacttcgggagtttccagtaagtaaaatttgtatggagggttggccgagtggtctaaggcggcagacttaagatctgttggacggttgtccgcgcgagttcgaacctcgcatccttcagtaatttttttttttaatttatttttgtgttgcaagcgttgatcctttccattatgcagccataagaggaggctggatatgaattatttattaccaatataaggagcatgtaccgttgattttgaagagccaattgctccaaattttggattttgtgttcgaaaaagggaagattgctccaaacgcaaataaggaggaaacccgctgattgcactcttggaaaaataaaaataaaaagtggtctcagaattgtttcaaaagtggcactgacacaatatttacaggcgttgatagcttcttgttttaacaatacgatttaatctcggagtagttaagccaaagaatacgtgttatccgtaagaggcttattgcacgtaatccccagtataaattatccgcaaatcgaagacaaatgtttaagaaatacaaaaatcaagacttggacatggcattttggtggaagaaaaaccccaagaccccttccgattatgccaggttgatcatcgaacaactaaataaattcagctcaccctcgctgactcaggataacaaacgaaaggtacaagaagagtgcacaaaatatctaattggcactaaacattttattgtcggtgatacggatcctcacccaactccggaagccattgacgagctttatactgccatgcatcgtgccgacgtgttctatgaactgctacttcattttgtggatttggaattcgaagcaaggagagaatgcatgcttatattctctatatgccttggatactctaaggataataaattcgtcacagtagattatttagtctcgcaaccaaagaccatatctttaatgttgaggactgcggaagttgctctacaacaaaagggttgccaagatatctttttaacggtagggaatatgattattgaatgtatcaaatacgaacaactttgtaggattatattaaaggaccctcaactatggaaattctttgagtttgcgaaactgggtaatttcgaaatcagtacggaatctttacaaatattaagtgccgcatttactgcacatcctaaattagtgtctaaggaattcttcagtaatgagattaatatcataagattcattaaatgtattaacaagttaatggctcatggaagctacgtaacgaaaaggcagagcactaaactgttggcctcattaattgtgataagatctaacaacgcgttgatgaatatatatatcaactccccagaaaacttaaagctcataatgactttaatgactgacaaatctaaaaacttacaacttgaagctttcaacgtattcaaggtgatggtagcaaacccaaggaagtcaaaacctgtttttgacattcttgttaaaaacagagataaactattgacgtattttaaaactttcggtttagattctcaggattctacttttcttgatgaaagagaattcatcgttcaagaaattgattccttgccgcgtataatttcgtccacaacagaagtttctaataataatgcatcctcaagtaacgtcgccagtataacttctccatcatcagtaatgaacaatcaatcatccatcttaacacattcaacttcacctgattcaagataactataaaacttggttcactttataaaaaatggaaagttctcaggcagtgggtcgtgacatgaatattcaaaagtaaaattatatataggaaagtgtttatttgcataaaaagggaaaaatagttcagacttttgtatttttacgtatttatacaaaaaaaggttggtaccggaggctgaggaagccagtacagttggatccggtacatggaattgagcaatcaaccgtaaatatgagcgctttctcaagatattaaattattataaaacaatttatttatccaatttatacatgatttggatcctcctttggctatgtatgttacctctcctttccttcttccttttttgttttaacttttttgttcaagcttttattgtttcttagtaaatttgatgatgctgaactagatggttgggaaaatagtggtaatctcttactagtctcctgccctgtaggtgatgtgattcgctgccctttatttgcattaaacaatgcattagatttggacgtttttggatcttcgatcttttcaaaaagattcaggttagtttctgatttacgaatgatgttggattctttagcaattgtcagatctttcaacttccgctcccaaagtggcacctgttgatccaagatggcatttagttcaagaagtttttcttcattacataacctttccttcgggttaaacggtccaaattggtatccgcctttaccatcaaattttaacagatagttatgaaaatgccataaacttgtcctgtggcaaactgatattaacgagataccaaaattttgcgcattttcgtacatcctttgttccatttctggggctactgcagatgtacattcgtcgagcacagcaaacttgggtttatgatagtacatccttgccatagctaacctttgttggacaccaattgttaattcttcggaccaatttcttactatactgaatgcatcacgaactttaatggcgcatggtgactgattgtcttccgtcgacaactgctgtgaatcatttttggaagtcctttgcgccagcagaagtgacatattttcagtgactaaatcctccaaatctaataattgcagaatttttattaaatctgcatcgcctagatcataatcattgtgatatctttctttgaattgttcaatactgtctggataaataatctgttccctgaatgtcgacctattgcccatatacggcctttggggtaaataaaatattgcgcaatctctatccacagttctacgcggcattattaacttggattgatgatttttattgggagtcgcccttatcggccaaagcccgcctagaatacgaaataatgaagatttaccgcaaccgttgggcccaataattagtagatgatttccatgcttcagatcaaaacttagctccggtactagaacttgattggcaggtgttattaaaggaatattttcaaactttatccttgaatcatcatattccactatacacctttcatctcttggttctttttcgtcatcacctttattagcatccaacaaatcattgaacttgttcaatctcaatctgataccgcgtaattgttgtatatttctcttcagttccacaaatcttccgatagagctagatgcagtgactaataatcttctatttgtgatgaaatcagccgtcatatcattcccgggttccttaagctgtaaggtgtcttcactaggtttgtttttgaaaaatattggaatcgagcatagtaccaagccagctgcgccccaagtatatttaatgacaaatgcagtagcaacatcataaatagctcttgcctttatttctctgtttaaaaatagcaccaaacggtaaaatgaataatcaacgttttctagttccctcttttgccctcttagcagtgcaatttcttcattgcttgaatgtagattcgagtgtaaagatctgaaccaactttccaaagatgcgcttgccatagttaacctagtgaaattcggttgaatcaattttagtaatgaattggaggcgtagacaattaagcccagtgccaaagttccttcacccataacactagtgtttgaggttaataatttgaatgaacagaggatcaaatccagcattggctttaatagctgattcagtaataatgacgagttcattgaaaatgtgtaaatatcttttgtcaaattatcctgaatttctgaaacagattcagcagaagctacggaatagaaagtatggtgattagatagatactttgagagtagaaagtctgaaactttcctattaatagtgacagcacaaagttttgtcgtgtaactgatcagtgaattaataaaactggcgggaattccaaggatcatccatttccccaacaatatctttgtgaagtttgcgtattgagctcttactagtgtggacactaattgaccatctaaagtagccacacgaagagacagcaatgttctgatgttcagaagaatagcctgtgtaataaataaaatgaggcacttcttatcatgaagcaaaagtttgaacaaaaaatctacctttccttttcgctctccccccttatgattagtcttgctttctttatcaattattattgcaccatcttctgaatctgtgctatgtttggagactatcgttaactcttctttgctactttcatcttcctctctatctactgcggtttcttttccctcttcaattttcttattttctaaaaccgttgactcagaatccttcttatcagttttgttgttactagaactggaatttgaattgtaaagcgtggctagcaacaatattatgtatgaagaacgcagtaaatttactctatgcttctgataaaatgcagaagctgttgagatcattataaaatctttcttcggtaacttttaattgtattattatcccttttgagtcttttccatattcaagacgaacaaaatacagataacaatgttgaagacgtttgttttgtaccggattgaggacaagatgatacttaaatataatattatctttgatcgagcaaagccatcaatatcatcatctaacattcactttactccacatttcattgccgcccttaatctttcggagggtggtaaaaactttacggtgatagttgtaattaacgccgaaggaatatacatcaaagacgaaagaacattaattgcatatattccaaaaatatgaataattaccaaattattattaatttttgttttgaaatttaaataaagctattaaataaggatgatggtgtggtatgtactataattcaatataagagattaagataacgctgtaaatggtttggtacaattgaaaaaaagtgatagagcatttacgaaaaagaaaaaaattatgctaccaaatgtgcattattgttaacaggtccatttgaatcttttggtgtcacgtcggggtgacttagctctgttctattactcgtactacctgtgacatctgtattattggcagaactactgttgtcgatagcggttatttcattacgattcacctgtttttcgaaatcagcatcatcatcatcacccaagttatggtcgccgaaacggtctgcagaaatggcagaaccatccccatacgtgtaaatttcgcctttcctattcgtcacagatccggacatgtaacgaccactccgtctgttcctccaccacgtataaattatcaatcctgtggcgataaaagacaacgcaaatgctgtccatatcagccctgtataggcgggaccggctttaaacacaacaccatatttatcatctgccgtaccgctctttataatggcaatcataacggatatgataatggctgccaatacagtggctacaccaacgcaaacgtgtagagctagggcaatgagccataatggttgtttgaacatatatctgttaaagtacagtaatataataaaaatcatggtaaagaaggaaaagatgatcgctaagaggttcaaagccaaaacagacctcactgctggcacatattggtgctctctgtgtaaaagtttcccttctaggtaaagatcgttggcgctaatattcagggcgttcagatatggttggaagtctgatgtgactaatgcgtcataaataatcgatctaaaatccaagttttgtacagcatgtggggagttacaatctaggatcttgttttccaggttagcatggcatagcgtgaaaatggataagcgatagtaaatcggaattttcagatactctagtatattcggcgtcatggcgttcaattcttctgcggaaatcggttggacggatttggcatccgctaatatatctaaaatgggcaagaaggtctgagggttttcttgagcccaggaagtcagcgtcactaaagatgaaaatgttgttttaggatcagtggatgcccctaaaagactgaagagatatggaatgtactgtacggagcttgaattaccggataggcccgattgtaattcggacaagatggacaaagtttcgttggtgttactcgaggagcttatcacatcatctaatccaattagctgttgagtagattgagttgtatttgtcaccgcagctagagattggaccgaagtgacaaccattgtcgagttgtccgaattttccatcaattgggttaaggcagcaaacgccttttttgcagatgatgactgagtgaggttttgttccagcaaatcagatagagtgctcaatgtctgatttgtagaggtggtctggtttagcagcaattccactgcatcaaatgcgggggcgcttgcctgcggcactagtggttgcaaagtactaaacgtgttatttagggaacctccgtttgaaattgtgttttgtaactgagttaatagtgtttgggctaaagaagatgaaatagtagtgttcatcaaggtcgccagagccgtcattgtagctgtttggttcgtggagaaagcgaatagcctgaataccggtaacaattgcgccttttctgacattgtcagattattcagagttagcaatgcatctgtggaattctgtgggttatcggagtcttttaataagtccagaaccaaagtagttgagtcactggaagagttagagcttgcggaagacagcgaagcagaaactaaccttgagaggccatctagtgtttcagttgcgttgtctgaatacttcagcagcccattaatctctgtcaactgcctcgtgctagaagcaggattgccgctgatcgctaagggagccaattcggtcaatgattcgatggttactgtggtgttgtcagcattagacaaaagcgtcaatagcggcgtcagcgcgggagtatcagcaatatttttcatggcgccaaaaatatcatccaaggagctgttcggagccgtcaaagcggaccctaatattgtcaaaatagggcctatctgcgggatcaccttgcttacattgatgtgtttgatatcggcttcaccgatgtatatattcgttaagggtttgtagttggcggtggagccagcagtggctacaataaccaatatcagtgtggtgaacatgaataaaaggcacacagacaatatcgtccaaataattcccttcgacaggggggtacggtgcttttcgatcctcatgtttttgttgttttctttgctttcctaactcttcgtatgaggattttcgatggagcaggatgaggagaaatagtaccacatgtatatatccattacaaaaaggtttatatacaattacaatagacccttgttggggtttctgaaaaaagaagtagtcgatgccatcggcaataatacggaattacgagaaacacaatcccgatccttttttgggtaattacttcaccgattctaccgatttatcatgccaaaaaaaattcaccgtgggttctagaagtgccctttgaggattgtagccactctaacccacacggcctccttactagctgactaaggtgacaaaaccgcaaggactggaaagtcgccactcatctgaaaattctcaagtttttcactactgagtttatgctttcgaatttttttgttcggtaatagcacggcggttcgattcaattccgccgctccgagcgatgctccgcaaaactcagtaataagctttctgatggttcaccccttttttagcacgcggggtgtaactcaacagaaaaatgtgccatagaacaagactaggcaaaagccaaggagcgtttgccatgaacttccacaagtaaagctcgttgaccagttgatcagttgaggggggtacacacgactagcgctttcagatattaaaaagtttagatgtaggttttagcggtaacagttatataaatcgtgtttcttctcttgatgaaacaaaaaaatgctagaaaaactttgtcgtttcttacttttggtgcgctttgcagttttcgtggctagacttagaatcatttctcctcagatttcttgattaaagtttggtgcgaagccctactctaacattggtgttcttcttttcattcacgcaagttaagtccaggaaggtgagcaaatgctcatccttctgttcatgcgtgacggctgaattatccttatctggcgtacccgtgcagccgtttccgtgcctcggttcctccgagatatccttagggaccgccagggaccatgattgcgtcaactgttgtcaccgctccagaggatcctctgtaaccttttcaaccataaaaatagaaagggcacagggttggggtatttgaattttttttttgggttttttcgtattacttattacttaccttcttttctatataattttgtttttccctggtagagcggaatcttcccactaaatttttagcagagaatcctcgggtttgtaaaccatgttatagttaaaccccgatattacaccattaaaatcatttctaaatatgcggtcgtcgatgatcagctgcagggaaatgccaaaatatggaccccatagaggtcttggcttgttcatatcgttgggtcgatttctgttcccagtgttatttggttgaatgggaacagtcgcgtcttgccccatcttgtctctgccgctttcgtcgaatctgactttgcaattgacgttgcatatcaacgtgccggatcccggaatagcgtgatagtctactcctgttagggcatgttgtgtttgtacgacctggttttgccacatttgcagaaaaactgttgcttgcgcgaagggggtagcattaaatattattctgcagttgtttggattaaaaagctgtacgaattgggccaatttgttggagtccggatcatccaaatgcgctaatatcttcttcgtaaatgtggccgttatttgtgcttgatttgcgtcattcattaccatagtattactattggtgttcatatttctgttattactgttattagtttggcgttttgcctgacgatcagcctggtggggccaagtatatactataaaaacaggttagttacttgctctatgcgtttgcgcatcctctttttactttttttttttcagtaaagcctaagcataaatcgttttatacgtacgacacgttcaacttttcttggttagtagtggcaatctctgcaatacatacagggagtcatggtctatcatcttgtccaatcaaagaagcatcggttcagatcgagcaaactgtagggagaaaggaaagtagaaatgcagagtgtgctatatgtccaatctcggttttgtagtttggatgtcattagagatctaccacccaaccggctgctttcatgtggaacagaaaagaaatcggggcgcttcctcttctgtattcctttaattaacgtttttattcagccatctaaccatcatacccccatacggtaacaaaacctcttctaagaaaagaagtctctgctcctccgccatcttatttttattcgctgcgcgcgtttattgtcgcatcgctagccagcaaaaagttggttgcctttttttacctaaaaaagacacatctaactgattagttttccgttttaggatattgacgccaagcgtgcgtctgatttctacgatatgtctctaattttggaagggccattttatttttgaggattgggctgatcattttccttacgtggattgagccagcaatacagatcattattaaactgttttgtacatgatgttagtatataatcgtaaagcttttctaatatgtataccttatacatggaactccacagaacttgcaaacataccaaaaatcctttattcttgttcactcattttacatcaaaaaataatatttcagttattaaggaaaataaaaaaatagattagagaagcattttgaagaaatagtatattcttttattgaacctaagagcgtgatatttttactcgaaataaaatacgaaaaatctatacactcatctttccgactactattggctcctgctcaaaaaaagagggaaaaaaagctccaaaattctatcttttcctatcgctcctgtcctatccttattacgttcattactattttaatactatccattcttttattttcagtctaaaaaaaacatttctcataacgggaaaagcaaaaaaatgtcaagcttatacatcaaaacaccactgcatgcattatctgctggtccggattctcatgcaaatagctcctattatgacaatcttttattgccttcattttccaatttatccagtaatatcagcaggaacaatatcacaaccgataacaatataaattcagcaagtcctaggaagtattcgtttcattcgctcaatgtgtcgccaattctttccccaatatctttggctaacgaaatacttggaaaaaaatcaaatactgcaccagcatcgccacatcatatggattacaatccaatttcctcattaacaccaggcaattcaccagaattcaacaaggcaagcttatctcagattagttttacaaatccattgaactatgggtctggcttaggtttttcctctaattcacaacctcgactaccattgttagacaggctatcgtccgtctctttatctaagagaccggagcgcccacaacaaagcctaccatcactaaggcatctgcaattattacccagtcctcttttacaagaaaacgcagcacgcttccctgatacatcaaaacgtacatctaattggaaaactgatcttacccattggtgtaaggatacaaactatcaagactatgttaaaatacgcgaagaagtggctcatttcaagccattaagtatacccaacttaactaataatcaaaataatgatagtttcaattacggcaaggaattggaatcgactaggtcgtccaagttccattccccgtctaaggaatcatttgatcgtaccaaactaattccttcgattctagaagctaaagatcaatttaaagatctttccaacaatgcatggagtattactcctcccgtcacaccgccgatgagtccaccaaccaatagaaccatggagcgcacgacgcttagaggagtagaggcctctttttttgaggggaaatccagcaataacgattcaatattcaatccaattattagtgaaaaattggttcaagaagttaaacatcaaagacaattacgtggaaattcatttcccatgccaaatgccagtcacaaaaagacgaacagtttcaaagctttgcaaataaaaaaattgcttgcgaatagagacattctatcgaacaattccaaatctaatgtaaggaaaccatctaagaacaaaatctcaaagcaagcatcaaatgttttcggtaacactgcaagacaattggtgatgaaactcgacaacgctagttacagttctgtctctgcatcttcatctccatctccctccacaccgacgaaaagtggcaagatgagatcaagatcatcctcacctgtgcgtcccaaggcatacactccaagcccaaggtcacccaattatcatagatttgctctcgactctccccctcaaagccctcgaagatcatcaaattcaagcataacgaaaaagggaagtagaaggtccagtggctcatcacccactcgtcacaccacaagagtgtgcgtgtcgtgtcattcgagtgattcgccctgttggaggccatcgtggtcgccaagaaagcaagatcagctatgtaactcttgtggtcttcgatataaaaaaacacatacaagatgtttgaacgatttatgtcgtaagatccccacaaagggtgaaataaacattatgaaatccaatggaatagacaaagaattcgtccccgaacgcaactgcgaaattgaagggtaccgttgcttattttgtaattacataactgagacagtagagaattgatacatggataactgaatctctttcaactaataagagacattatcacgaaacaattgtacatttctctccttgtctgtgctaaataaactacaaataaaaattcattttctttcattttcattcgacacgccgcggcatcttcgttttcttcaccgattaattttaatctgcgccgtgcagatattttcgcccatttcgaagtgaaatcattctaataacttctcctgcgcaatagattggtcatcctgatttttattctgaaatcgaaaatgaaaagcatttattgcactgaaatagcggaacctgcttctaataagcttaaaattcaatcataatagtgtagttaatagaaaggacagaagaacttttcgttccttggtttatcatccaggtttcagcacggcttttgtttcaagtttaagtaggtaagattttttgattgttctacaactttttcatagtaatcaaaacctttgaatttcaaacttactatgtctagtactcaagtaggaaatgctctatctagttccactactactttagtggacttgtctaattctacggttacccaaaagaagcaatattataaagatggcgagacgctgcacaatcttttgcttgaactaaagaataaccaagatttggaacttttaccgcatgaacaagcgcatcctaaaatatttcaagcgctcaaggctcgtattggtagaattaataatgaaacgtgcgaccccggtgaggagaactcgtttttcatatgcgatttgggagaagtcaagagattattcaacaactgggtgaaggagcttcctagaattaagccattttatgccgtcaaatgtaatcctgataccaaggttttgtcattattagcagagttgggcgttaatttcgattgcgcttccaaagtggaaattgacagagtattatcgatgaacatctcgccggatagaattgtttacgctaatccttgtaaagtagcatctttcattagatatgcagcttcaaaaaatgtaatgaagtctacttttgacaatgtagaagaattgcataaaatcaaaaagtttcatcctgagtctcagttgttattaagaatcgctaccgatgactctaccgctcaatgtcgactttccaccaaatatggctgtgaaatggaaaacgtagacgttttattaaaggctataaaggaactaggtttaaacctggctggtgtttctttccacgtcggttcaggcgcttctgattttacaagcttatacaaagccgttagagatgcaagaacggtatttgacaaagctgctaacgaatacgggttgccccctttgaagattttggatgtaggtggtggatttcaatttgaatccttcaaagaatcaactgctgttttgcgtctagcgctagaggaatttttccctgtaggttgtggtgttgatataattgcagagcctggcagatactttgtagctacagcgttcactttggcatctcatgtgattgcgaagagaaaactgtctgagaatgaagcaatgatttacactaacgatggtgtatacgggaacatgaattgtattttattcgatcatcaagagccccatccaagaaccctttatcataatttggaatttcattacgacgattttgaatccactactgcggtcctcgactctatcaacaaaacaagatctgagtatccatataaagtttccatctggggacccacatgtgatggtttggattgtattgccaaagagtattacatgaagcatgatgttatagtcggtgattggttttattttcctgccctgggtgcctacacatcatcggcggctactcaattcaacggctttgagcagactgcggatatagtatacatagactctgaactcgattgaaggatatatttaaccacgactttcgcaagagagacggagggggtgggaaaaggctgaatgcaaccattgtcactaagaatttgagtgttcatgaacgagttatacacgctatttaagagtcagagaatgatgattcaagaaaattctggcatttttcctgtccaccactgtacgccattgtacacaaaagtatttttttatattttttttacaattttttataatttttttttatgtttagtgtatatttgctagaaagaaacaagatcttttttggtagtgtaaatgcttaaactttgtctctttttcctttttactttggaaaaatgccgacgcaagaacatagacatctgcgaaaaccaaaaataaagtaccaattgtacatacaaaaacagagaaaaagttcatgaacagaacgttactacggtatagcaagatctttgaatacatccattacttcggattgttcaccatacttcaacacaggccaagatagaccatagctacagtgatagacgaatatttatttcaaaagaagcatcaaccataaaataaaaagaaaaatgatgaaaaaaaaaccaaagtgccaaattgcaaggaccaaaccatcggtcgaaaacgtcataccatataaccaattcaagaagacgcagccgcgattcaacggcaacttttctgcactgaataatgaagaatacataatactctttggcggaggtcgggacctgatactaggctccctgacaccttgttcgagctctcatttgtccaatcaagccaacccacaagacaccagtgagtatggcacagacctgtttatactcaacagctgcattatcatttggttcaatggcttgggatatgggctggaaattccctacagcagcgttttgtaccatgcatcaagacggctaccagatggtagggaagggcttcaattagaaattttgctgactttggaaagagacgaagtgttggacatgctctaccaaagcctcgcgccacaggcctgcgaattcgacggcgaagaagcacatgccttcaccgtgcgcagcgtggaattgactatcaggcccaaatattcaatatacgatcgccattataacaacgaaatcgaaacccttttcaccttcgaaaacttcggcgtgaacaggggcgatgacctggtaaacaattgtaacgaagcactagccgtatgcatggacctgcacggtgaggacgtacaagatcaagaccaggaacaataccaagatccaagcatggcgtttgagggtgcgcaagatctcaacgccacgtattctgggcttggagacacccttcacgggccgcccgtgtatcagaacgacgggctggcagacgatctggatggcgacctcgttatggacaacgtggtctctaggggtggtccagaagcaagtatgtctatggagttctacgcaaatcaaaatcttgctggcagaaagaactccagagacaatgaatgaacaacatctattatgggaacatcccgctgtactatgcggtctcgtcctctacgaatatggctatttgccttcgtatatacctttctataccaagtaatgaatgtcttgagggcccgtatggccgcgcgaaggcttagttaagatgtttcagcaaacggcagcatgtgaaaaaacccgtagaaggtccgcatcagccttccatgcccgtgcacccacggctcctcggaggccgggttatagcagcgtctgctccgcatcacgatacacgaggtgcaggcacggttcactactcccctggcctccaacaaacgacggccaaaaacttcacatgccgcccagccaagcataattacgcaacagcgatctttccgtcgcacaagttaaaagaaattgttgaaaaatacaaataatcgcgaacaatacgttgttgctatttaacgcttttggtctgacagtaagtgtgcctttcccaatcaccgaaaagtgttgaacgattcactgcgacaataatcagagattacagtcggcattttggcatttttggcatactttttatcgattgaaccatcttctccaaacacttttcctttttccttctattctgcaggaccaactaaaactgggtatatatatcattatctatatatataaacggctttcaacaaagttataggggaaaactaaaaatataagaaaaaaaaaggtattgattgataaggaaaaagaaccaagggaaaaatataaaaaagtacattgggccttttcatacttgttatcacttacattacaaagaagaacaaacaacttttttaaacgaattttctttcttcctttttcaatttattaattctttttttccatacaattcaaggtcaaatatattcttatatgctctttgaatatttctgaaaaatatataaagaaaagaaactacaagaacatcatccggaaaatcagattatagactaggattccgctctttttagtatatttattcgccacacctaactgctctattattcgctcattatggacgcttactccacaagaccattaaccctatctcacggttctttagagcacgtgcttctggtaccaaccgcttcatttttcattgcttcgcaattacaagaacaatttaataaaattttgcccgaacccactgaagggtttgctgcagatgacgagcctaccacacctgctgaactagtggggaaattccttggctacgtatcttctctagtcgaaccttccaaggtcggtcaattcgatcaggtcttgaacctttgcttaacagaatttgaaaactgttatttagaaggcaatgacattcacgccttggctgctaaactattacaggaaaacgacacaactttagtgaagactaaagaactaattaaaaattatattaccgccagaataatggctaagagaccatttgacaaaaaatccaactctgctctttttagggccgtcggcgagggtaacgcacaattggtagccattttcggtggtcaaggtaacaccgacgactactttgaagaattgcgtgatctatatcaaacttatcatgtcttagtgggagatttaatcaagttctccgctgaaactttaagtgaactgattagaactactttagatgctgaaaaagtctttactcaaggtttaaacatattggaatggttggagaacccttcaaataccccagacaaggactatttactttccattccaatttcatgccccttaattggtgtcattcaattggctcactacgtagttactgccaagcttttgggtttcactccaggtgagttaagatcttacttaaaaggtgctacaggtcactctcaaggtttggttactgctgtcgccatagctgagacggattcctgggaatccttcttcgtctccgtaagaaaagcaattactgtattattcttcatcggtgttcgttgttacgaagcatacccaaacacttccctaccaccatccatcttggaagattccttggaaaacaatgaaggtgttccatctccaatgttgtccatttccaatctaactcaagaacaagttcaagactatgtaaataagactaactctcatttgccagctggtaaacaagttgaaatttctctagtcaatggtgcgaagaatctagtcgtatcgggcccaccacaatcattatatggtttaaacttgactttaagaaaggccaaggccccatctggactggatcaatcaagaatcccattcagcgaaagaaaattgaagttctccaataggttcttacctgttgcatcaccattccattcccatctattggttccagcttcagatttgattaacaaagacttagtcaaaaacaatgtcagctttaacgctaaagatattcaaatccccgtttacgacacttttgatggttcagatctaagagtcctttcaggttccatttccgagagaatcgtcgactgcatcattagattacctgtcaaatgggaaactactacacaattcaaagccacccacatattagactttggtccaggtggagcttccggtttaggtgttttaacccatcgtaataaagatggtactggtgttcgtgttatcgttgccggtactctcgacattaacccagatgatgattacggattcaagcaagaaatctttgatgttactagtaatggtttgaagaaaaatccaaactggttggaagaataccatccaaaattaattaagaacaaatcaggcaaaatttttgtcgaaacaaaattttctaaattaatcggtagaccacctttattggttcctggtatgacaccatgtactgtttctccagatttcgtagctgctaccacaaatgctggttataccattgagttggccggtggtggttacttttccgcagcaggtatgaccgccgctattgattctgtggtttctcagatagaaaagggtagtaccttcggtatcaacttgatctacgtcaatccatttatgttacaatggggtattccattaatcaaggaactaagaagcaaaggttatccaattcaattcttgaccattggtgctggtgtcccatcattggaagttgctagtgaatacatagagacattaggtttgaagtacttgggtttgaaaccaggttccattgatgctatttcgcaagttataaacattgctaaagcacatccaaacttcccaatagctttacaatggaccggtggtagaggtggtggtcatcattctttcgaagatgcccacactccaatgttacaaatgtactccaagattagaagacatccaaacattatgttgatattcggttctggtttcggttctgctgatgacacttacccatacttaaccggtgaatggtccacaaaattcgattatccaccaatgccattcgatggtttcctatttggttcgagggtcatgattgctaaggaagttaaaacttctcctgatgctaagaagtgtattgctgcttgtactggtgttcctgatgataaatgggaacaaacctacaagaagccaactggtggtattgtcactgttcgctctgaaatgggtgaaccaattcacaaaattgccactcgtggtgttatgctatggaaggaattcgacgaaaccatcttcaacttaccaaagaataagttggtaccaactttggaagcaaagagagattacattatctcaagattgaacgccgatttccaaaaaccatggtttgctaccgtcaacggtcaagcccgtgacctagccacaatgacatacgaagaagttgcaaagagattggtggaattaatgttcatcagatctaccaactcttggtttgatgtcacatggagaacctttactggtgatttcctacgtcgtgtcgaagaacgtttcactaaaagtaagacattgtctttaatccaatcctattctctactagacaagcctgatgaagctattgaaaaagtatttaatgcttatcctgccgctagggaacagttcttgaatgcgcaagatattgatcactttttgagcatgtgtcaaaatccaatgcaaaaaccagtgccttttgttccagttttggatcgtagattcgagatttttttcaaaaaagattcgttatggcaatctgagcacttggaagccgtcgtcgaccaagacgttcaaagaacatgtatcctacatggacctgttgcagcacaattcactaaagtcatcgatgaaccaattaagagcattatggatggtattcacgatggtcacatcaaaaagttactacatcaatattacggtgacgatgagtcaaagattccagcagttgagtactttggtggtgaaagccctgtagacgtacaaagtcaagttgattcttcctctgtatctgaagactcagctgtttttaaggcaacatcctctactgatgaagaaagctggtttaaggctttggcgggatccgaaattaactggagacatgcaagtttcttatgttcctttatcactcaagataaaatgtttgtttctaacccaattagaaaagttttcaagccaagccaaggaatggttgttgagatttccaacggcaatacttcttcaaagactgttgtcactctttcagaacctgttcaaggtgaattgaaaccaactgttattttgaagttgttgaaggagaacataatccaaatggaaatgattgagaacagaactatggatggtaagcccgtcagcttgccattgttgtacaacttcaacccagataatggttttgctccaatctctgaagttatggaggacagaaaccaaagaattaaggaaatgtactggaaattatggattgatgagcctttcaatttggactttgacccaagagatgtcattaagggcaaagatttcgagatcaccgctaaagaagtttatgactttacacacgctgttggaaacaattgtgaagacttcgtttctagacctgatagaacgatgttggccccaatggactttgctattgttgtcggatggagagccatcatcaaggccattttccctaatacggtcgatggtgacttattgaagttggttcatttgtctaacggctacaagatgattcctggcgctaagccactgcaagttggtgatgttgtttcaactactgctgttattgaatctgtcgtcaaccaacctacaggaaagattgtcgatgtggtaggtacattatcgagaaatggcaagcctgtcatggaagtcacctcctcattcttctacagaggcaactatactgactttgaaaacactttccaaaagactgttgaacctgtttatcaaatgcacatcaaaacttctaaagatatagctgtcttgcgctctaaggagtggttccaattggacgatgaagacttcgatctgttaaacaaaactttgactttcgaaactgaaactgaagttactttcaagaatgctaacatcttctcttcagtgaaatgttttggcccaattaaagttgaattgccaaccaaagaaaccgtggagatcggtattgtcgattacgaagccggtgcctctcacggtaaccctgttgttgatttcttgaagagaaacggttccacattggaacaaaaggtcaatctagaaaatcctattccaattgcagtacttgattcgtacactccaagtaccaacgaaccatacgctagagtttctggtgatttgaatccaattcacgtttcacgtcattttgcctcttacgcaaacttgccaggtactatcacgcacggtatgttttcttctgcttccgtccgtgctttgattgaaaactgggctgctgacagtgtttcatccagggtacgtggctacacttgtcaatttgttgacatggttttgcctaacactgctttgaaaacatcgattcaacatgttggtatgatcaatggtagaaaattgataaagtttgaaactagaaatgaagatgacgttgtagttttgactggtgaagccgaaattgaacaacctgttactaccttcgttttcactggtcaaggttcacaagaacaaggtatgggtatggacttatacaaaacttctaaagctgctcaagatgtttggaatagagctgacaaccatttcaaggacacttatggtttctctatcttagacattgtcattaacaacccagttaacttaacaattcacttcggtggtgaaaagggtaagaggatcagagaaaactattctgctatgatctttgagactatcgtggatggaaaattgaagactgaaaaaattttcaaggaaattaatgagcacagtacttcttacacatttagatctgaaaaaggtttattgtctgctactcaatttacacaaccagctttaactttgatggaaaaagctgctttcgaagacttgaaatctaaaggtttgatcccagccgatgctacttttgctggtcactctttaggtgagtatgctgctttggcctctttggctgatgttatgtctatcgaatctttagttgaagttgtgttctacagaggtatgactatgcaagttgctgttccaagagatgagttgggcagatccaactatggtatgattgccattaacccaggtagagtcgctgcatcattctctcaagaagctttgcaatatgttgttgagagagttggtaagagaaccggctggttggttgaaatcgtcaactacaacgttgaaaaccaacaatatgttgcagctggtgatctaagagctttagacaccgttaccaatgttctaaacttcatcaaattacaaaaaattgatattattgaactacaaaagtccttatctttggaagaagttgaaggtcatttgtttgagatcattgacgaagcttccaagaaatctgctgtcaagcctcgcccacttaaattggagagaggttttgcttgtatcccattagttggtatttctgttcctttccattccacctacttgatgaatggtgttaaaccattcaagagtttcttgaagaagaatatcataaaagaaaatgtgaaggttgctagattggccggaaagtacattccaaacttgactgcaaaaccattccaggttactaaggaatatttccaggacgtttatgatttgactggctccgaacctatcaaggaaatcatcgacaactgggaaaagtatgaacaatcctaatttcttaagtgattatataaccgtaagaaatatttaactttgaaactcctgtatactaatgtttaatatagctggcttatgattttagttctcttctcctattataaatagatacattgattaggtatttttataatatacttgggattaacagatgctatatgaatttttttttccgccgcaagccctcgctagggcggggcagatgctgaagaaaaaattttctgttccattgggttatgtttaaaaatcaacgatattcgaacataatcgatgaccttgatgattagcgaagttctgctctaaagaaattagctttaaaaacagctccattattagtgtaaactgctacttcaactctttactcgaaaagttgaaacaagtgtctattccgcacatctctgcaataaccgaaccttcacgatttagctacaatcccacatctgcagattctaccgtttaatagtcttaatttgaagagaaataaaaatgcgtaagtgtaaaatttttgttggtaactctcacccagagttgggtaatatggtttgccaaagattaggtatcgaaccagctccatgtacattaaaaaaatttgcaaatggtgaaacgtcagttcaaatcggtgtatctgttcgtgacgaagatgtgtatgtcattcaatctggttctccatccataaatgatgacattatggaactgttgattttagtttctgcctgtaggggcggatctgctaggaaaattacagcagtcattcctcaatttccttactctaaacaatgtaaaatgaagagacacagaggcgctattactgcaaggatgttggccaatctgttggtcatggctggcgctgatcatgttgtgtctatggaccttcatgcttctcaaatgcaggggtttttcaccaaaccagtcgataacctatacgggggccctagtttagcgaaatggattagagaaaatgttgaagactatgaagatgcagtagttgtctctaagaatccaggtggtactaaaagagttacagccctggcggattctttgaagatcaactttgctatgatccatactgatcgtcgtcgttctaaggatctgtattctcaaaacaaggatttgcaacaactaaagttgagaaagcaatcaatgttgaggaaaaatagaccgatcatcagacaaggtgaccatccaaatgaggaggaaaacattattttaagtaacggtattcaaactgctaggatccgtaacggccacgttatcggtgacgatgaggcagacgatgatgaagacgctatcttagaatctgacagcgaattgcattctattgatggcttagactcgcatggcttgggcggtacatatgatgctgtcgactccgaagacgaagaggaaatcccagttctctatagggaacaactgattacattggtcggaaacgtccgtggtcgctctgccatcattctagatgatatgattgatagacctgggtcatttattagcgctgctgaacatttggtgcaaaattgtggtgccaaaaaggtttatgttgttgctactcacggtatattcactggagactgtttggaagaacttgaaaagtccgatgccattgacacaattgtggtcacaaatacatatccgatttctggcgaacgcatagctgggtccaagaaattggttactatcgatgtttctccaattttcgcagaatgtatccgtcgtgatcattatggtgagagtatttccgttttatttgactctttggcagctctgtaaacagaagagagtgtgcgcaatattttagttcttaaatatgacatagattatcaaaaaactttgtatgtttgccagatttcagtgaatctgcaagagtataaattataggaatttgggtgaattaaaccatttattatgttttatgtatcatggaaaaaacagaacctttatcaaatcatctatgaaattttgacaggttagccattttcctcattttattgctctgcaatagtaaattatatagatttatgcaatgctctaggttccggcggcttttcatttaatgtgaactcaagactattatcatccaaacacattacaacatccgtacatttagttggctccattttttgaaaaaatacttccgagtaagatgctgaaagtaatcaaattccgtgaaaaaggaaccgatttggtaagggcggacctgccggaagaaaatcgctcccgcgtgtctactggactttgcttctttgccaggcgggagaatgaagcccaccggcctagctctatgggcgcagacagggatggtctcgatttgctttctcactgcaatggaaatttctaacattagagcttcaacggctagcataaaacaactactaacgttttcagtgctatattcgaaagagcaaacaaagagtcctcaagaactactaatagattaaaatggctagatacggtgctacttccactaaccctgctaaatccgcttctgctcgtggttcctacttgcgtgtttctttcaagaacaccagagaaactgctcaagctattaacggttgggaattgaccaaggctcaaaaatacttggaacaagttttggaccaccaaagagctattcctttcagaagatttaactcttccatcggtagaactgctcaaggtaaggaatttggtgtcaccaaggctagatggccagctaagtctgttaagttcgttcaaggtttgttgcaaaacgccgctgccaacgctgaagtatgtcaagaatattatatgtttagtaccagatgaaacaagaatgagttgaaattcaaaatgcgcggaaaatccattatgatcaagggaaattgaatatgataaatgaattattcagaaagtcacaattaccagattggaatgaactgtcaagctgaaaagcaactaaggattaccattacgtgtttatgattttgttagaaaaatattgaaaacttgatatttctttccgctagtttcatctttttcaattacttaaccggatcaaaattttttttactaacaacataactatttttattacaggctaaaggtttggatgctactaaattgtacgtttctcatatccaagttaaccaagctccaaagcaaagaagaagaacttacagagctcacggtagaatcaacaagtacgaatcttctccatcccacattgaattagttgtcactgaaaaggaagaagctgtcgccaaggctgctgaaaagaaggtcgttagattgacttctagacaaagaggtagaatcgccgcccaaaagcgtattgctgcttaaatagaagatgaaaaataatgataatataattctctgttaattttaatcttttatctatgtaattttatctccccgtcatatcacataactctaaaataagttttttattaatattattatattatatcggataatcctacgttcaaagtattgaacatagttttataatgaacaaaggtataagaaatgctcataaactgaaaaaatcccgtagataagataataagaaatgctactgtctatatcaatatgtcaatcgttactcattccctctctagtacggaacgtgtgcgttcttcataccgagctattagaatttagtgaataaaggcatctatcgatttatgccatgaactgaaccaacgcctgcagctactttttctgctcccccaagtcctccgttgagatttgaagaagactttgccgattgtactataccaacctcaggtgtcatgtagccgctaatattaatcacatacatgctcatcatgaatacgagtccgtgtaaaccgatacagtaaaagaggaataccatccttgtcattttattttgtaaaatgacttttgcaaaactggaaaataacttctctaaagctgataatttcttgtttttgtagtggtttaattcgttctgtctaaaatttgccattggatgcaacgattcatcatacacccttgagtattgggattccacgtcaatacgctctgtactttgattaacgggagcgttgttattattataggattgcagatacctaatccgttcataaagcttcgtattgtcgccttttagcttcgaaatttctagtttaagcttacccttttctgagtttccttgtcttagttgcttttccagatccatatttctcgaacgaaatctgtctctttgtttagtaactattggtaaaatggttgattggtttccagaaagttccccatcttctggaataccaataatagaactcgttggggacattttatgggacgtacgattgttcatttgtcttgttacaccagacatcatacttgcagtctcgttgaagtgaggactgacgttctctactttttctaggtccgtctctaatttttcatttgcttctttgagagtagctatttgctgcttcaattggtccacagattttttcaattcgtttcgttcttcctcttgagccgtactttttgagcggtattccgccaaagtagcctggagcttcttatttgcagatagtaaggaactttcgaaagtattatcattcttgtcttcagagcgaatgtcattatcagaatcatcttcgtttaccccaaactcaatttttttcaatgcagaaagttcttcttttatcttattgtaatcagaataattgtttagttttcttctaacagtttctagctccgacttgtaagattccgattccgccacaacgctatttaattgttcttttaactcatttattgcatgtgatgttgatttccgttcctgctcataggatgcactcaacaatgcattttcgctttccagctggttaagttttagttcctttgcatgtaactcagtttctttttctgcttcactagttgcctttgcaagagcaccacttagttcctcatttcttttctctaactgatatattctagcctgcgtagtttccaactcctgtgttactagattatattcagcaatccttgtagatacttctttttgattgttttcttggtcaccatcttcgtttccattaccttctatatctatatttttagatattttggcctctagtgccttgttttgctcctgtacatttgttaattgtttcaatagatctgcttctctctctttccaatttcttcctttttcctcccaggtagaattgatttcttgagttttcgcagtcagtctttttgccaatgtttttgcagagctttgctctaggtccagtaaccttgatttcaaagtctcataatctgcatatttggctagcttatcttctaggtagcttattttttccttaagttccttcgagtcatcaattttgcccaatttttccaacgaactttgtagtagcggctgtggatcaggagcctctgaaagcttttcgtatacgtcaaaaagaaccttttcagagaattttgatctctgtgtcaaattatcaatttcacgttggtactgcttaattattttattcacattgttcaatttttcctcaggttcgagttttttaaattttttagtctcagtggctaatgactttcttgaattcaaggacagggtttctttatccttaatctctataacatcagcatccaattctctttgaagattcgttaaatctgccttggcccaaatatccaatgcatgagaatatactgacgtatccattgtcaaattatttttgacgagctaatataacagagtgaagaaatgaagcaattacgcacaatttattgtactgtgttcattcaaaactcttaaacatattattttggcattttcatgagccccaagataatatcatttgttacgtaacattctctatgacagtaatggttttcttgaatgacacaagtaaccactacaacttggtgtgcagaatagtgatagagcgaactgaaattgtgggtacctaaatattctttgattatgagcggagatatgatgctctttcatgttttcctggcctgaattttggtatgctcctaaaaaaatggccaattaagtgatcgtgccaattctctcgtttattaaagactgttctgctaatcgacttttggagcaaaagcttacttttgtttcgagcttaaaaaatttttcttgtgtggaacttgtatcaatttctccttatatttatatataatacagacgttattgcttttctatagaaaaaaatagaaaccaaagtagcaaaaaagcagtaaatattaaagtaaagtttacacacaattcgtcatttttaccgctaagccacatattagctgatgagctcatcgttacattatttgagccacaattcactaaaaagcagtatttcaatcctagtcctgtaaaaataaaatactcctagtccagtaaatataatgcgacactcttgtgttaagggcctgcagtattttctgaactatgttcgtttgagcttgaattctcttcttttgaagctggagagtagcaaagactttccccttcaaaattggagcttgcagaattatgaagcttttctgaataatcgagagtaacttttgagaatcctccaagtgatatttcgtcgtcaaagctctgtccttgcgtgacgtaagggatgtgcctactttcttttaggtctatttcatcaagaatatcatctgtttctttatcagcaaacaaatattttttgcttttattttgagattttctaggatcatctggaatcctatagtcgacatagaaatgcgcttgtgatattggtgtacctacacagggagaatagttttctgtacacgtggagatatagttctcagagtctgtagaaaatgggttacggctctctttgcgtgaggacagcttgtttagcaatatgcctactcgtttttccttattcttatcaatgaatcttttccacatgtcaagtacaaatcctagtttgatggaacgcaggaatttagagtacatatgcaaagcatcagaacctaagccaaagattagaaatactaggtaagacatcaaaacataaagccatatattataaattggtctgccagggtcaaatttaataatggtattccagatggtgctggaatgggtatttttaaaagtatagtgtccttctacctgctgtaaatcttgaacaaaggtgtaaacagaaaaagggaacatgactaaaataataatgaaacagaatatcaacagccttgcgaaccttgtcaggtttaaacctgaattggtacagtgtaaaatatccctaacgtccttgcgttttttataaaacacgaacagtactaaggtggcataaacagcgcccacaaatgaccatataagcatccacatggtatacaaaacagtggtaatccatgtcggagacaataagttttggcaaccgttgtaacgagcgataccatatctaaatacttgtaacagatatgaaaatcccatgaccatgacaggtgtgaacaagctaatcacaaggtccttgacgattttcgtccatgatgaaagatccggtaaaacactatctgccttcaaaattgtatgcaagttgtaaatgatgttggtaacggcacatgatatgccaatattcgcaccaacctgcaacttgatgacaatatcacaccaacctttaccatcccatctcgtgaggaaatcgtcgtcactccatattgccgcatctacaatacacgttaaattcattgtaagaagccatgttatcaaaatgattgctggaatattcttggtatgtgaatgccatgctaaagggggagctaatagtatcacagctagcaaacaaagccctattattgctgacttgtatgacatgaaaattttgatagtattttgcctttcctacacaaatttaattgcctctaaagttaaaaagcaataaaatagaatatgtgaatactgcacaaaatgaatacttgggaattcagaaattattcttaccttaagcatccactcatatacatatatatatatatatatgtcttttcaaaagacttctgcccaaattgtggagagaactctgcctctccgtgataacggccaaatgaaacgcatccaatgatgcaattattgacaaagtttcaaagtttccgccattattccttcatttacacattgatagtcgagaagtttcctaattagtgtcacaatgacagagaaaattgtaccagcgcttctaacgaaaattagcacccatacccagagttcataaatctggcaatgtggtacaataatataggattggtaacatttcaattgtaaaatgtttaacgtttagagaaaaggggagccagaacgcttctggtggtgtaaatacggagaagtcaccttaaatagttttgttctgataattgcatttttttggaaagatttggctgcttaaaagattcaagcaatcaagagaaacattacaaggcctgcttggccggtctactaggctgaaataataagtttctgattatggttatcacggtaaatgattacgaaagggtaaagcaacgaatggttgttttatggtaagaatactttggcgaatcaacaaattgaagttgcgcaatgtgcgattcgcttatgtatcaaaaaaaactaaaaaatgaatagagaaaatcatatatataaaagaaaaaaatatcgtacacctcttaggtaacttggaatatattaaacatgtaaagaaggagaaaacattaacctgcattacaataatgaacaagagatgaaaaaatccgtaaagcttctgaatcgcgaagctcactatctattccattatcatcatataacatcattgcactctttatactattttcaacaaaattaacgcagttttccaaactagtacttagcttgccaatcttgccacaggaaaagatttttctggtcttctgtttcaacacgtacttcctttttccgacaaaattctcatcatagatattctggttgctgttattgttgttattgccagtaaactctcttttcaatgcgacatccctaatgtcccttgaacgtaacgatactaatagacttcttgtgtaatccgcctttaacaggtcaatcttcatagaatttgttattctgctctctgattcttgaccagcaggacatgcttgcaactggaaaaaattgttaaaatgggttaaatacattgtatatttcggcaatagttccagaggtttattcatcaagccatcatcaatatcagaatcagtagtcaaaatatccgcataagaagagttacctggaaaaatttcgtaagtggaattaaggtcagccaaagagggctgacatattctttcaaaagcctcatccaaaagatcatcctgagagatcctttggcaatctcttttcaactcaacgttctttagtggaaatttatatgatatattcttaaccaatgggggtgcgtgagacacatctccaacattaggagagccaggtgtgcccatccaaggatactcatcatattcgctgatagacggtgattgttgcggagtggttagtgataacctggaggttgcttgctgcaaagaagacgaacttgaagtcctttgcatatttccagcagttgtttgcagcctctcccacgactcgttgtgttttaaagaagggcttggttgaaagaactgagaaattgttggccttttgttgaaccaagaaccgtacgaaccaggttggcttgagatagaagacgatagataatgcaatgaactactcccacttttgaaggaagatggctgaataacttccgctaaagactcactagaagacacagatactgaagtgttcgagttcctccgattgggtatttgccatcctttcctcaaagaatggaaattgggtgatccaatgctgttagagctcacattactgttgttgtaattatgattgctattattttctgtgcgactcaaaaggttgtctgttgaagtcagtgtgctcaattccgtctcaggcttatcgacaaaattattgttagacttatttcttgatacagcggacgaatccgatcttatgttttcccgccgtatcgttatttgtcccttgtactttggctccaataaagccgataagatgaacagtaacttgttagcaaccaccatgtttcctgacaggattacgatcttggatgtctttagttctcttatagtgtgcctgtaatcagatataatcattgccattaggagaggaaggaagcctagtttcggtccatctttgatttcaatccaattaaatatacttttgaaccaaacgtgaacgaattctttaaatgtctcagggtaaaggaaaagcctaggaatctcagacatagaacgtaaacctggtatgactcttttttgtaaagtttgcaccattatttcaatttccttgggataatgcgtcctgatgtcaatatttgacaattttatgactgaattattgctgtaattgccagtattttcttgcataatacggtttttagtcaagaaaccaatgagcattttttgagtctgggtcaaccatgatgaaatggaagaccacgactctgcaactacgggcaacaatatcctcggtatgcataagctaattgcgatgcggttgtattggtgtgtgtaatagaaaattctagttatgagtaccaaatccgagttaggaatcgtccttatcttgtcgcactgcgtcaaatcggaagatcttacgggagaaccaaatatatattccttcaattcactcggccgtatctgctccatcgaatttgaaatctttgacgtagtgtaatcgaagatatcacggtagttgttcctacacgccatttgacccgcttcctcaatgatcaaaatcctgaatgcatacgttttttcgttaatagacgtgattttatcagtaccaagacctccgttgttttgtaacgtatcgataggacgactataaggaatatccctcgagccgaaaagcttcagttttaagtcatccgatatatgatctaaaatgggcggagaagtcgttgatagcatttccgaaggcttttccacattgactgcagtatctaaaagagctccagcagcggtcttagtagttcctgtgcttgccgctttgcagtatacagggacattgggaactacggaggaaaaatcggaatgctctgagctcttctcaaaaccagacgaactcgtcttatttctcagtaaattacccaacatataaactctccctcttcaccttctctacaaggccacacacaagacagttttaacaggcaaatggtactggaggctctcaccaatggggtttaagacgctccaaacacacgctctcctttttttctttatatatcggtagcaacgaaagctagtcgcagaacgttacacactaaagcagatcaatcaatcaatcctgagaacctgcttcgttcaaaccatccactagaagaaacacgcacgtgtacccaaaaatagagacaaacaaacagacaaaaataacaatgattcctaccgactaaagtaaaacaacactcacgtaataaaaaatcctagatacaactcacttgtattcctctcttctttgaccatcactaaagcttctctcttactatattcctcaaataaaaaaaagttgcaatgattacttaccaatgtgccataaactccgtgcaccacactagccttcgatttgacacatctctaagctgaaactgagaatactgttgtaaaacaggtattggctgcttcatagtacacccaattgcccacaacccaagttaatcataagctcttgttgtcgatgaattgctcaaaatgtggccattctttcaattttgcacctctaaaactgctccgtgggttgtgacaacaaccttaagggtaatggacttttttagaaagacaaatgagatgatttcacctactggtatatcatttatttatacacgaccgttttgacatttcagagttgcacgttggtatatcctaatattctcacaagcatcacagtgaagaaacgcaagaaaatggaaaaaattcccaggtggttgttgttttctcttatatcgtcggtgctgtgcatacttggggccctgtgtgtgccgttgttatcggttgccttcgatagcaagcgcaatagccaatctaagttggtcaactatggtctttctctaagtgccggatctatgatcactacttcactatacatgctattgcctcggatcgaaaaatcaaaccggttcaaggtttttcctggattgcttttgggtatttgcctcagttttttcttaaactacctagtccacgctttcgccagcgaatcgttggtacactgtgctgatagcggtgaccatgctacaggttcacatatacactccaaatcacattcgcattcgcactcacactcacatgcggattcgcattcgaattttagcaacgatcatgatttagaaaatgctccctctgagcatggttatgcaacatcttcttccagtgtttctgaaaatgacccgttgattacaaaggatagcgatagaccccaaatgaaaaagaaaatgtccctaattgacttattaaccagaaggaaatcagaaggcgagtgttgtgacctaaacaagtgcactccgctcttgcaatcagagcagccagaatatattgcatgtgtcccaccagtgataaagtcttctcaaagtgaaagaaacgtgccacatggatgcgagggatcagaagataatggacaatccgatgacaaggatcatcgtggccttgtatgcgtggaaaataatatcggttacgatcttgaaaacctatcgttgtaccgtaagaattttctttcgagccgccatcatcattcctctgaatcgcccgaaaattatggttccaaccagttgtcgcactctttttcgtcacctttgggaaatgatgtaactgagaatccggccgcattggcagacacacaataccatcccgaaaatggttcattatacccccaccatcatcacttagagacccctttttccaaattactgtctattggtatgcaaacttgtctagtccttgcattacacaaatttcccgaagggtttattattttttacactaacaggtcagattcgtcaaagtccttgggattttccatttttttaagtttgacgatccataattttgtcgaaggatttgcaatgacgttaccattctacactgttttcgaatctaaatgggttgccattttgattactgccgttctcggtggtggatctcaaccattaggtgcattgataggttatttcatctttaaaggtagtactccaagggatcacgaacccaacatggattttttactgagcgttactgcagggttcctattagtaattggtttacaaatgttccaaactggtatcggatttagcgatggacatcatcatcatcaaggagaaggtgatgaagaaatgaaacagtcccatagctcaggcacaacttgcttgaaatggtgctgcactggcgttttgctaattctagcgagtgcccttttcacttgataaattaaaactacgtatattctttctatataagtcttttcccattaaataacggtgtataatcacgatcatatatcatatatcatatctacgatcatcggcaagatcaaattcttgttctgctgtatggtgctcatcaccataatcggttatcacgttttcctcattttcctcaaagggattttctgtactacttttaggatgcaccttgatgaaaccttcttcagaattattttctacagactctttcactgtggttcccgagtttagagtatgttcaacattgctatcctctagttcaaaaacagtttcttccgcatcactgggaattggagccttgatgtcatctgccaagggtaatctaaaattatacttcccccatttgaaataaagaccagtgataactaaaatgcagaatacgtacaccattaaagcataattcattgttttgaaagttacaggcacttgcgttggtaggcaaacagaaaccatagataacaagagccacacaatagaaacaatgttgatgaaccaaccaaacttatacctgatttttactggcgcgcttcggatagctcttcttctcgtaaacagcaccaagactaacggaatgaaagtcgcagaacaaagacagagcactgcagcgcctataaaagcattaaatgcggccgttgaaatcaaagctagcagacctaaaaagtatgatattatcatactcaatacaacagaattcttggggacttttgactgagaatccggttcgacgtaggtccatttatcgtagtatggtatagcctggtcacgactaaaactatataccgcacgagaagatgtagtaatcgagccaattccggaaaacagtaagtttcctaaaattaggagcactaaaaaaaaagacaagaccaccgaatcagtcgattttgtaaaaatgttcactattggtagaaccttatgattggtaaaaagcaaatcattatctggcaggattaacattattggtataagaaaaatgactccagagaacgcggataacaataccgcattcgacataccacgtggaatatccttctcaggaactttgacttcgtcagctaaagcaggtaacatactgaaaccttgtaacgtgaaattagactgttggaatccaatgatgaaggaaagaaatgcgcttttataccctgatagattattatcaaagtgaaatagcgcgtacttcaaagatcgaaatttacctttgtggaatactagtagaagaatatcaataaatataatggcatatatgatccaataaacacagactttgtttattgtttcaataaatcttgcaaatttcaaattcacgaggcctacaacagtcacaactaagtaaaatacaatgactgtgtaaaaaatcaagtgtgcctcggatattaggttggagttcgtcatcagaatcaaagaaatggtaagttgagcgcctgcaaaagtaatactggtactcatagtccaattccctatgagcattaaccagccagtgtaccacgaacatactaatttcaatttctccggggccaacatggcactcccaacatgcagttccatcggaaattttgaaacaatctcaccaagagaaagcgacgaaaaccatatacacactccactgattaaaaaacctagcattatagttaacggaccaccattaattagcccaatggccatactagtgcacattcctaaaacgggactcattagtcctaaaccgagaccgacaatagaacctcttgacaataacgatttatccaacacctgatcataattgaaatgctcggcctcctcgttctcttgactgtcatcttcatgaacaatggtgtgcaagttatcaaacaaaccattcggatcgaaatgaacgatattctcccttatattatcagccagtagcgtatactctggcatttttcatttatttgacttatttttatttattttattgtacaatggcaaacaaatacacggactggtatgttcttcgtcaaattgatgatctgttcttttggcttatccttatgggatgattaatgattgttaaagcctcattgcggaaattttaatgccggaaaggcctgaaaaatttcaaagtggcagaaaacaaggctttggggcattacttgccaacggctgacgattgctagctgcttttacagaagcgatacacaatagctcctaacatagcaaaatggaaggtgacgatttattcgatgagtttggaaatttgatcggagttgatccttttgactcggatgaagaagaaagtgtgctggatgagcaagaacaatatcaaaccaatacgtttgaggggagcggcaacaacaatgagattgagagcagacaacttacctcgttaggaagtaaaaaggaacttggaatttccttagagcacccttatggtaaggaagtggaagtattaatggaaactaagaacacacagtcaccacagactccactggtagagccggttacagaacgaacaaagttgcaagagcatacaatttttacacaattaaaaaaaaacattccgaagactagatataatcgagactatatgttatcaatggctaacattccggagaggataataaatgttggtgtcattggacctcttcactcaggtaagacctctttgatggatctcctagtaatcgactcacacaaacgcataccagatatgtctaagaatgtagaacttggatggaaaccgctaagatacctggataatttgaaacaagagattgaccggggtctttccattaaacttaatggttccactctactctgcaccgatttagaatccaagtctagaatgataaactttttggatgcaccagggcatgttaattttatggatgaaacggcagtcgcacttgcagcaagtgatttggttttaatcgtgatagatgttgtagaaggtgttacatttgtggtagagcaattgataaaacaaagtattaaaaataatgtagcaatgtgttttgttataaataaactcgacagattgattctagatttaaagttgccaccaatggacgcatacttgaagttaaatcatataattgcaaatatcaattcctttacgaagggaaacgtgttttcaccaatagacaataacataatatttgcgtctacaaagctgggcttcacattcactatcaaggaatttgtttcttattattacgcccactccataccttcttctaagatagacgactttaccacaaggctatggggtagcgtatattaccataaaggtaatttcaggacaaaaccatttgaaaatgtagagaagtacccgactttcgttgaatttatcctcatcccgctttataaaatattttcctacgctttatctatggagaaagataaattaaagaatttgttaaggtctaactttagagttaatttaagtcaagaggccctccagtacgatccgcaaccttttttaaaacacgttctacagttaatatttaggcaacaaaccggtcttgtagatgcgataaccagatgttatcaaccatttgaattattcgacaataagacagctcatctttcaattccaggaaaatctacaccagaaggcactctttgggctcatgtactgaaaactgtggattacggtggagcagagtggtcccttgtacggatatactctggacttttgaagagaggggatacagtacgtatacttgatacatcacaatctgaatctcgccaaaaaagacagttgcatgatatctcaaagacggaaacctccaacgaagatgaagatgaagatgacgaaacgccttcatgtgaggtcgaagaaattggcttattaggtggcagatatgtctatccggttcatgaagcacacaaaggacagatagtattaataaaaggtatttcaagtgcatatattaaatccgcgacgttgtactctgtaaagagtaaggaggacatgaaacagctaaaatttttcaaacctttagattatattaccgaggcagttttcaaaattgttcttcaacctttactgccaagggaattacccaagttattggatgccctgaacaaaatttcgaaatactacccaggcgttattattaaagttgaggaatctggagaacatgtaatactaggaaatggagagctgtatatggactgtttgttgtatgatctaagagcgagttatgcaaagatagaaattaaaatatctgatcctttaactgttttttctgaaagttgctcaaatgaatcgttcgcttcaatacctgtaagtaattcgatatctcgccttggtgaggaaaatttaccaggtctgtcgattagtgtagccgctgaaccaatggactctaaaatgattcaggatttgagcaggaacacattgggaaagggtcaaaactgcttggatattgacggaataatggacaacccaaggaaactatccaaaatattgagaaccgagtatgggtgggattcgttggcatcaagaaacgtttggtctttttataatggcaacgtgttgattaatgacactttgccagatgaaatcagtcctgaattattatccaaatataaggaacaaataatacaaggattttactgggctgtaaaagaggggcctttggcagaagaaccaatttatggtgtacagtataaattgttatcgatctcagtaccttccgacgtaaacattgacgttatgaaaagtcaaattattccgctaatgaaaaaagcctgttacgttggcttactgacagcaatcccaattttattggaacccatctatgaagttgacatcacggtccacgcccccttgctgccaatagtagaggaacttatgaagaagagacgtggaagcaggatatacaaaacaataaaagtggcagggacaccattgttggaggttcgtggacaagttccggttattgaatctgcaggattcgagacagatttgagattatctacgaatggtcttggtatgtgtcagctgtacttttggcacaagatatggaggaaggttcctggtgatgttttggataaagatgcgtttattccaaaattgaaacccgcacctatcaacagtttaagtcgtgatttcgtgatgaaaacaagaaggcggaagggtatttctacaggtggatttatgtcaaatgatggtcctacgcttgaaaagtatataagcgctgaattatacgctcaattaagagaaaatggcttagtaccgtgaaaatcttggcgcataagaattaagcaatatgtccacaatatttttattcagcagaatttacatatgacttcgtatttagtgatataactactcatcgggactgaaaattttttatttctgcctaaatacagatgagatgagctttatagaattttacgctgttaaaaagttaaacggtaacaaagcacagttagttgaacaacggtatatagagaatggctaaaggtttcaagttgaaggagttgctttcgcatcaaaaggaaattgaaaaagctgaaaagcttgaaaatgacctaaagaaaaagaaatcccaagaattgaagaaagaagaaccaactatcgttacagcttctaatttgaaaaagcttgagaagaaagaaaagaaggccgatgttaagaaggaagttgctgcagatactgaagaatatcaaagccaagccctttctaaaaaagagaaaagaaagttgaaaaaagaattgaaaaaaatgcaagaacaggacgctaccgaagctcaaaagcatatgtctggcgatgaagatgaatctggcgacgatagagaggaagaagaagaagaagaagaagaagaagaaggaagactggatcttgagaaattggccaaaagtgactctgagtctgaagatgattctgagtctgaaaatgattctgaagaggatgaggatgtcgttgctaaagaagaaagcgaggaaaaggaagagcaagaagaagaacaagacgttccattgtcagacgtggaatttgattctgatgcagatgtcgttccacatcataaactaaccgtcaacaacacaaaagcgatgaaacatgccttagaaagggtacaattgccatggaaaaaacattcattccaagagcaccaaagcgttacatcagaaactaatacggatgaacatattaaggacatatacgatgatactgaaagggaattagcattttacaagcaatcactggacgctgttttagtagcacgtgacgaattgaaacgactaaaagtacccttcaaaagaccattggattattttgctgaaatggtgaaaagtgatgaacatatggacaagattaagggtaagttgattgaagaagccagtgacaagaaggcacgtgaagaagctagaagacaaaggcaattgaagaaatttggtaagcaagtccaaaacgctaccttacagaaacgtcaattggagaaaagagaaacactggaaaagatcaaatctttgaagaacaaaagaaagcacaacgagatcgatcactccgagttcaacgtcggtgtagaggaagaagttgaaggaaaaaggttcgatagaggcaggcctaacggaaagagagccgcaaaaaacgctaagtatggccaaggaggcatgaagagattcaagaggaagaatgatgctacctcttctgctgatgtcagcggcttttcttccagaaaaatgaaggggaagaccaatagaccaggaaagagtagacgtgccagaagattctaagccgttatgtcggcaagaacactgtatatatccagaacgtaaagtatatacaactatctatcatctctttgtacactagtataaaatagaattaaatccaacgaagccctaaaaggcttttgtaaccctgccaagatgacgggaaaataaagggaaagaccttatgtttttgcccaaaaaccctagcgccggcgctaatattaatggccggaatgaaaaggtcccggaactttgtgtatggcgttgcgctcttcctgtgagtggggggaaacagattagataattgaattcaataacaacagtcaatgggggacggagggtcttatgttccctttgggtcatcggggacgcaagtaagaagatacgcaatcagcaagcgctgttattactctaacgaagaaatcttttcagcaaaacggtccaaaagaacgaatgtttacgtcgcagcgacagcttcgacaaaatgggagtccgatgtcatcatcacgttcatcacaacattcctctggtacagcgtcgccgatatcagactctccagcatcgaatcgcagctatggaagagatctacgaggcttaatgggaattgatatacctgctaacgaaccagcttttaacagggccaatagcagtgatacaatctatttcaggcctaagaagatttacaaaatggaacatgagcacccatcacgatctactttagtacaactgcagacaagatcgcagccggacgatgtcgcaagtagtcaagtaaaccctgaaggcggaaccgacgatctagagctgggcgatccgtgtggcaatcaatctttatacactataggggcggagtacgttccagatttagactttacaaagctagtgaatgagtggcaaaagtccaccgaggatttgtatgagttcagaagcagtgccactccgcaggtacaaatcaaagacagtggaaagggaaactacgaactttggagctcaccggatgcaatattgactcaaaacaaacttcgaagagatagtttttcgcaagagaacagtgattcgttaagtccagaagattctattttatcaagaaatttgcattctaaggtcaaacccatccctctgcccagaaacagccagcaaatatttacacccctgtccaacttagaagcggaaaggagatcctcatatacaactagtagcaacaacaatagcataacacagaataataaattctcttttgcgaagttaaagtattcacttccaactcaaagttctgcagttcctgcgtcgttcgattcaaatgcttcgtcactaaattttcttccgactactacattatcgaccttatcagagctacaaataagccccaacgatatgatggatttgattcagaagcttcccagaaattttttgaacttgccgtatactcaaaggaaaaaggtgattatcgagcatgcaccatctcatgactacaaggccatgatgtccctagttaagaagtttatgttaacatcttctagaagtaacttttctctcgctgggtttgccaataatgcttcagtttcgcaggccacggctaatgatgataacatcaatagtaggaacacgcccaataatagcaatgacacctacgtaaatacgcgtccacttcaaagatctaggcacggttccattgcatcccaatttttaagttctttttcaccttcgatgacgtcaatagctaaaatgaattcgaacccattgagtggaagcgcaggtggcagtgcgagaccagacgataagggtatggaaatactaggtcatcggttgggtaaaatcataggtttcggcgcatgggggatcatacgggaatgctttgatattgaaactggtgttggtagagtgataaaaattgtgaagttcaaaggacaccaaaatatcaagaaacatgtgctgagagaagtagccatatggaggactttgaagcataacagaatactcccccttttagattggaagcttgatgacaactatgcaatgtattgtttaacggaaagaattaacgatggtaccttatacgacttggtaatatcttgggacgaattcaaacgttcgaagataccatttgcagagagatgcagattgaccatttttttaagcttacaactattatctgcattaaagtacatgcattccaaaacgattgttcatggtgacatcaaattagaaaactgtctgttacaaaaagaaggtaaaaaatcggattggaaggttttcctatgcgattttggaatgagttgccacttcgatgagaagcatgtttatcgtaacgatacttttgatgaaaacttgagtagtggcaacagccatagaaagagaaaaagtattgaacaaactaatttgataaagtatcccacaaccaattttttacctgacgaccgaactaatgattttgacgctagtgaaaacttaaaataccaatttgaaaatcgaaagcatcaaccgtttacaccaaaaggaatggttagctccagttcacattcattaaagcatctcaatcaaccatcctcttcttcttcttctaatctatttcacaagccagcctctcaacctcaaccacagcatcggagtccctttcatgggaggcacaagacaaccgatttttcaaacctggaacccgaaccttctaaatatatcggatctctgccttacgcttcgccagaacttctaagatactcagatgcaagacgttcaaaatcagttgaaatgcatatttatgattcaccagactcctctcaatcggaaattagcgcagcatcatcatcttcctctaatttatcttctctatcatcctctacaaaggcgtccgcagtcacgaattccggtgtaactacaagttcaccgtctggttcatcgactgattttccatgtattgtttctcctttaggaccagcatccgatatttgggccttgggagtaatgctatatacaatgttagtaggaaaattaccctttaatcatgagttcgaacctaggttacgctctctgattaaagtaggcgaatttgaccgattttctttagctcaggtctgtaaatttgacaggaaaaaaaatgaaggaacgattggtcaaggcttgtatgacacagtcattggatgtttgacgattgacttggataagaggtggaaattgaaaaggattgaagaagtccttcaaaacgaaatgaacctaagcgaggccattcacgataataatggctcatgacttatgattaatgatattgattgcattgaaaaaatacatacattgtgcttacttttttttctcccattttataaattataacgaacttcataattactattacgaaatatgtaaataagtatttttatcgcatatttgatgcctctatcacttatttggcgctattcattgcgactcgtgcaacgtgcgaaaactcagaatatttttttgaacagccttaaatcatgttgctaaatgacggatggaagaaaagggacctatagaagagttcggataaattgtgaagcgtggatattggcatagcggatttgtagaacggtgtgtcgtcaaccctttgagatctggataagccatattttctaacatcacaacatgatatttctaaaatctgtcatcaaggtaatcgacaattcaggtgcacaattagcagaatgtattaaagtaataaggaaagggtcccccaagagtcctgcaatggttggagacagaatagtctgtgttatacagaaagcaaagcccttgactcaaaacattacggggacagccaacaccaaccgtgtcaaaaaaggtgatatttgtcacgcaattgtcgtaaggtctaaacagcgtaacatgtgcagaaaggatggctccaccgttgcattcggagatactgcttgcgttttgattaataaaaataccggtgaacctctggggacaagaattatggctaatgatggttgtgtagatagaacactgaaagacaagggatacaataagatatgctctttggcaagtagggtcatataagaataaaagtacccccattttccattcattaacgttataatcaagggactgtaaaccagcaaaagagctttgtcgtcattatttaattaaccacctgtatatattgcttaaattttaatgtatgactttaactttgaaaacgcatgaacgtgctgctgacgttctactcattggagttgtattctttttcttgtcttattctataattgcatgccgtgaatattgtatacaagatatttatgtggaatcatatattaggcagcaattcgtacttttcatccactgcatatctaaaagtttgccaacagaaatcctttttcttggttcccattgaaagatgcgatataatgcgatttttctatttgtggccaactctgagtttacgtgctttaattcttcgaataccctaaactggtttttacgctgcatttccttgtaaaattcatcataagacatatctttttctctcgaagctactttccaaagataatgccccaatatcattgttatataaacaacgccacaactccaacagtcaatcagtcttggatcgtaatactccccatcaacaaactcttctggagctacgtaaggctctgatccaattatacccttttgagcatgaaccctcctttcccaagcggtttgaaatacagaacttgtaccgaagtcacatattttcaatagaccatgcggataaaagagaatattttcaggttttaaatcacaatgagcgataccatgatcatgcatgaacttaacaccatgaagcagttgcttcatgaaacaatcggcttctaacggatgtaatcggccctttaatttcgacttaccgaccagcataccataaaggtcaccagcagggcaaaattccattacttcaataaacgaagaactgtcttctagaatatcaaatacgtttagaatattgggggctggttttttaccatttttgtggtagtggctcaaggaatgcccaataataaactcagaggtgatctttgtacagaacttctctaaatcactgtctggtttgggtttcaattctttcacagcatagtatatgtatttgctatcatgatatgtttcaaatgggggggagtccttttcattccgtagtctggcacacagcttaacttcaccgtaagctccagcgccaacgagaccaacaggatggccataattatcttgaaaagtaggtgcttgctcgccgatacactcagccggttttagatttttttcttgcaaataattttgtaaacttttatgaattctgcttgataatgaattaatcaacttcaactcatcactgcccaatgatgcgtcgggattcactatttttagataatcttcccttccttgcgtgggcgagctgcggttgctatcgttaggactttgaccggttcttttctcatggtttgtctgagatttttctacgtttggcagaagagataaagcgttttcaatatcgcattcatttttatgatgtttgaatagaccagaaagagtaatacctaatcttggtctagataatgatccctgtcgatgtgccggtaaggagttacctttctctaatttcgcaattacccctgataactttatattatgttcatgacttccgtcttcgtaaactttgaagccattttgctcaattatacattgcacatctgctcctgcaaatcgaggcaagctctccaaactttcttcatctggatgtgacctcctggtgtataacctttcattatagaattgcttggaggggagaggatttggatatgatgttgctctgcgtaaagccttcttattgtagtcatctatgtaattatacggcgcccggtctttacttttcagtatatctttgttcgagccacgataaggtgtgaggtcattgtctgaatcatctagtaaagaatccatagcccattgactgtctgatgaacttgtcgttccatttgaactgtcacatgacgaaacagatgaacttcttgaacgtggacgccgtatgccatgaaaagtatgagaagcagatcttttgtattctggtaaactgttaacaatttcctgttcttccccagatatagagcgatgtctggtaggactattactagcaccacttcctgtctgtctaaatggatgtgacaggcccggggtgcaacacttcaatgtataactacgctggcgtattggagaattttttggatctaaaatttgtgcggatacggttgatcgtcttggtggctcagagcttctcttgggtgaggtagaagacgatcgataaggaattcgggtgacattaataggacttgaatctcttgaacgaggcggcctgaaaaggtttttaaaggactcagaaaatgaccttactcttcttgtcacaggttgttgccgcttcttctcctcctgcattaccattgatgctgtcaatgtttttgagtccatcatgcaattaaactagctagttgaagtgaaaatgaaatttccttattttccacaagaaatacgcggagggcaaaaaaagggacccaagggctgacaatattcagcacaatcctacttattgtactctaaattatatacttatatgccccataagtgagttttgaatttacatatttccatgaagggcaatgttttttgatatatacatgaacaaacttatcgagagaaagcttatataatactttcttgcggtccaactcttatgatctcattttcaggaagaggaacgtgctctattttgtcaagtaagtctttcattatatcttcatgcattttattacgcatatcaatagtctctacaacggagccttcatgagataaaatctccagtttgcatggaacgcttttttgcttgtcttcgttctttatccttatcacgtcaaacttcattcttggattatagaactgcaaagtgggtaggtagttatgccaaaaaactctggcacccatatgtccattgtggtttttcgtttgaaaagtcaatctaagacctgagtattttttaggatcgactagaatctgcggtagtctggtagtggcgctaattttattcaaaaattttaactgttgtgcaaccttagacatcttcttattgtagcaggctcacttatgttatactgttcttctattaatgagttttatggccgattcttacagatatcctgttttccctgggtgaaaagtcctagatcactttgaacgtcccagtcttctgaggacgcaaatgtagtcacaatatggcgtatatgaatgctcctttatttatctgtatacacctctattgaatagacgtacgtagatatatacatgtacatatatgcatgtgtcacttttttatcatggccctgttagactcaccaagaatctataaccaggtttgtttgtgctttttcttgttcttgtttttacttttattgattttttttttttttcaattacaattatcccactgaacctccttaaaattctttcattaaatccatatatggatcctccccttgaattccatagttgaattcctcttcagggtatctgtcaaattgagaagtgtcaccttggccctgttggattggtggttcgtacggcgtttctatgtatcttgctaacaatttctcccatatcacttcgttaaaccacggatggttcttgacatcttcacttccattttgtaagttacccaacctttcacttaagtctctggtaattagcttcttcaataagtcctgcgcgtctggatggaaaaatggtgggaacttcaattcggcgttcagtatattttcgtaagttttcatggtgttcgaattgtaaaatggagtgtatccggcaagcatttcatagattagcacaccaaaactccaccaatccactgatttattatacggttttgtactgaccacttccggcgctatgtaatctggtgtgccacataatgtgtatgtgacatcgggaacgtattttgcgaagccaaagtcggttatcttgatatggccgtttttatctagaaggatattttctggtttcaagtctctatatattatatccttactgtgcaaatattccaacgctaagcatacctctgcggcataaaatttggctactgggttgggaaatctttgagatttacgtagtaaagaaaataattcaccaccttcaatgtagtccattaccatgaaaacttgctgagaatcttggaacgttccccacattcgaatgatgaatggatgtgaaacaattgaaagcattcggcgttcgtcattggtgtgttcaacctgcttcagcttcactatagtgtgctttttcaatgtcttcaaagcgtaaaacctcccattgtgattggaacgaattaggtgaactctcccaaatgagccagttcccaaagttcttaaaatctgaaagtcacttagggaatactttcctgaggtatctctatattgtagcattggttttttaaccaaacaaatacctgcagacgcttcttctttcaactttccgctgtttcttccatttatctccacgggtgtgttggaagaacattcctcatgcaccgaatgtgcgtttacaggaatgtcttgtccaacgttatctggagttgtttctgtcttggcagtaatgcttaatttcctgatttcattgttgttcatcggatcaacatacattttgtgcaggctcgctctttccttgtacaaccaccgatatacaatatgattaatgtattattcaataatatacgtgaaactttcttattgcttaaagagtgatcgcctataaattttctccgacgactgcacaaagtgtctcgtatgtccactcgagtttcttaccgatagaagtaataaagcagacaaaacttttaagatcagctggtaaaaagtgtcttttctttccatattctcattgaacacaactttatttttcaatggcatcgaagaaatcccgtagctgaagcaacggaaaaaaaataccggaaactgcataatgaggctattcactaaaaagaaagtggttcaccagtatgcgtcggaaacgtcatataaatctatatatgtatatgtacatatatatatatatatatatatattagtgagtattttaatgtatatcaagttttgataaagattgcaacttggcttgaaataaacgcatttttgcgcaccagagagtatctgaaacgttgacgcaattttgcaaaaatgcatagtcgcttttcttcagaccttcctaaatcactcgtacctggaacgactttttgaagaatgaagtcgttgtcctcttgaaaaaaatagtaaatgatacggttgatcggccggtggccaccgtcgtgacaaacctaggaactcaattaggaccatggcatataagtatatgtggtccaagcttcgctgtgtaggccgtaattttgccggcatttactatattgttgacgaataagtgatagatttgccatatttatccctcctaaagctcggtaaagggaactatctgagatggatagcttgaagaaaaaaaaatacttgctgatggacctccatgtacaacttttgaaatagttgggacattaaatggagtatggtatgcggttataaaagtaactccccgaagctcacttagagaagaaattgtcttgctaaggtaatagatcttggaaagtttaaacaatcgtcaattttttcgctccttaagcaattgatgttgttgcgttattttctggcaacgacgactggcaggtcatagagacctacccaaaccaataaagtctcaaaaattccacttttcatcaaaaactaaggaattagtcttcctgcgggcagtgaatgcttttatcgttatgactttagtgcaaattgtagatatttcgaatgctttttgcatttaaaaatgaaaatctatggccatttcttgttttaaactcattgaactttcaaggtaaattcacgagcaatatattggcattgtcaccacgctacaattcggtaagtttctcgattcaaactagtaaatacaactattggaagggcacccggtgctaaggcgagaaaactgctgattgtgtacattattaggtgtgattaggaaaaatgaacgcgaatagtaatttatttcaaagatgtgcttttttttttcgctgtatagctgttacaagacctgctattaaaaaattcactagcaaaaattgctagtataaagctattgaagtacttgatgagtttaaatttttccttgccgccatttctttcgacaggagtactttatcgaaaagataaaggcaaaagttatatatttttaaaaacgctccaaatggatagtacttagacaaagctcaagtaatgtattccttaatgtgtcaaaattggccactatggttgtgattatatttgaattaaactcgtgagagtgttgaagtattcaattcagtatcattaaatgcctcttttgtttgttagttcgaaaatgagaaattgagacataaaatactgtcttcaaacaatcggaaaataacacattgatttaccatcacagaagatttttacctcagtacagtgtcggtggccaacgtgtaaagacttcttatatatccgaatttttttcttttcagatttattttttagaatgaattccaagaccttgattcccttattcttttctccgcaatagttgcctactaactgggcataacttaaaagaagcagataataagataaccggaaaaaacaggaacattttctttgatacatttctactaacttgaataaggttataggttagtatttccccttgattttgcctcctttgaggcatttatagaattattcaacaggtagattgcccctgtctttcttaatatacatataggaaaatatatacatagcggtgggtatgtgaatctattgtgtttttttggttttatcctgtatgatgacattttttagcaacacatgaccgagtacttccaaaataagcatgaacaaagatgataggatcgccaaacaatagttggaaatggttatgccaatatccaaccacgacccctccgttcttaaaaggtagaaaaaattcaacgacagaatatcactcatggaaataattaatgatgagattgtgtagtccttgaagttaagttttaaattcagtatacctaggcatgtggacaatagcccgtagggaattatcaatttcaacatcaataatgcgcccatcaggaaaggatcaaaaattggcaacaatctacaaacagactccaatgaaaatgaagagattgaagcgacgttaccagttccaaagaatgcgacttgaagtaaaaagaacccgattactgaaactcttagcacttgtaaccaattttcatctttttgggtcttcatttctttgattttgttctcaatttcaatccattgtaccatgtaactagtgaacaagaagtagaaaagggattcgaatgatatagtcaaaatgataaaggatggtgcgaaggttaaataaatgatcaataatctcactttgtaatcattgttgggcttcctataatgtaaaattggcattacaaaaagagatacaaaaaaaattatccatccagcgacctgtgactctcttggtaacccttgtcttagctgtaaagagataactgaacgatgagtaaccgccaacatggcagccaccaaggaaatttgaatggcaaatatagcacgcgtgtaggaatttatcctggaatgtattttgtaaagagcataaaaggcactgagaatgattaataaccctgctagatgtatctggttcaagtcctcaattttaacagcgtcaaataaggtaaatgtagataaaagaacactagttatgatccacaatatattcacggatagctctctcaccccacaaataaacgggtaaaacgccaatatatttgtaattagcgtaaacgtccatctatggaaaaatccatatacaattccctcataaactgatataatagagattgttattaaaactcttttccaaggagaggtacctttgaagaattccttgatacctgaacgtagtacggatctatttgtaaaaatatagctccaaaagtataatgggaaaagaaggtacatgtaaaaattgaacggagaatgttggtagaacaaaatccaatttagtaaaattcctatggaaccaaatactgcatggcttaatggtgacgctttttggtcatcaattacattctctaatatgaatgatttcaaaaatattataaaagaaaaaaagatccacccaacaaacccaaatgtaacaatagttctaatgaatctccaattataggttgtcaaataatgtaaaccttccaatgttatctgcattaattcctctgtaagggtgattgcttcttgttccaaatagttttctccttcagatatacgctgaattaaggtttctatctcttctaagtaatgtgaatgagacttttcaacaaacttgaagtattccttataaaaaaattgagagtctattacctcatcttgcttgactaagtactgctctaaaatgcttcttgcgttgttgtacaatgcggcaagcttgtcactttcttttccatcgatatatgctattggtaactcaccaactgaatttttaggatagttcacaccaatcaagtatgacattaaagaagcaatatctgcttgcttgacatcatttcttttaatgctcgaaagctcccaattttcagtatagttgtcggataccggaaaaggattatgtactggtttattcaaacccgcaccccaagcaacaagaggggtccttgtgttgttaggatgaccgtcaccatgtgatccaaatgcactcataccatgatctgctgtaaaaataaatgcggttttgtcgtccgcaaaaaacttgttgactttgtctataaggatagggatttgatcatcaatatatttgacattgtcataatactcggcagaatatggtctataagaatgtccggcagtatcgcaacctagtagatgtagaaagaatacattaccgtcttgcctaatttcataatccaatgttgagttcagtgtggaattgtggaataattgatccaagtgtctaaagacaaaagcatccagctcgatggaagattgcgtaaaatcctcgaaagtatgatcatacatccaagtgtcaactttatttgggtcagaagcgccatctttgaacataggtaaaatgtcaggtgaaccgaatgaataagtatgagtagattggttgaaaaaactatcgaaattgacagggtttgacttccaaccttttgtgacggcactaacatcttcgtaaaacccagcaatcatagcaacatgaccaggacgggattcagttggcattctggtatgtgatataccgtaggtggcattattcattaccaaagatctaataaaaggtgccagaaattctgtttttccggatactggatgagtgactttatcaaaagtggtatctgcacgtaaaccatcaccgacaatcaaaaacaatctctttgcaggaggggttggagtactttgatatgggctcataccatgaacgagcggtgaaatgaaatagatatcaaaaatagaccataggtaaaataaatgaaataagacaccaacagccagaagcgtcgttctggttttgttccacattttttacagatttcagttgtatgagtcctaaggctcttcaatgctttggtcgaagatgggttgttgaatatatagtaaagaacggttctttttacctttaaggtttttttttcgcgtttaatgacagcgatgcaaaaagaatacacatattatttacgtggcatcaacatatacatattcaacgattaacatcctgtagtttaggacgaaaagacacatatgaaatacatatctatgaaaagtactgcaccataatgattcaacaaaataaaatgagtaacattaacatcacgctagtactgctagattaaaaataataatgaaaactccgatacggggagtcgaaccccggtctccacggtgaaagcgtgatgtgatagccgttacactatatcggattacaaaggatagaaaattgaaacgtaatggaattactcatgtaaatattaaagaactcttttcatttacatggataattggtgaatgttgtggggaatgttggatttcattgctgttaaaggctataatattatgtgtacagaatacaccgtgtgtgataatatactagtaacacgtatactactaaatggatgataatatgcatgtcaattttcttaaattttgactgagatagtgacgaatatatggcattataagatgacaacaatttgtttccttctcaaatgagaaagggctccacggtacacaaagtaatgtctgagaaatattctgtcccaggaatagttgaagttgcatccgatttcaatcccgtgaagtcttggtactatcaaattcgttggttttttttctgggaaaactctatcaaagtataaggtgcgcttttaacgtaatttataatgattttttagaaataataatgtatatagtataaaaaaataaacaaactttaaaaaaaagagtgaagaactgtaaagctcatttcataggtttcaaaagaaagctttatgaaatgaagagacgaattaagaagaaaaaaatgaaccgacccaaattatgccctttggagacagaaatgactaatgtacagaatatgctacgatgactttatgttttcatgcgactatgagaggtaaacttatgattaacagttgagcaaatcgatagcttgtaggtggactgcattacattgagttccaatgtgctcatcgtataagttgtagaagtttcctgacaaacattggtaaaaagtatcctggtcaccgatggccaagttaccttctggggtgatggaccaaccagcagcatagatagcaccagcttgtggtggaggaccatcgaattggaattgtctgttggcaacgatagaaccaattctacctttaccgtcagtcaggataccaccctttaagttcatttctaaagtgccactgcttttacatgtttcagcagttactgggtcagtgccattagtaattggagctggagctggagatggtataatggttgcagaagttaaagttgtggcttggatttggccatcagtgatttgggagactggagcaacagtagtattggtggtggcttggatttgaccgtcaccaatttgagaaacagcagcagcagtggttttagtagtggcttggatttgaccgtcaccaatttgagagacagctgcagcagttgttttggtagtggcttggatttgaccgtcaccaatttgagagacagcagcagctttggttttagtagtggcttgaatttgaccgtcaccaatttgggagacggctgcagcggtagtcttagctgaggtagtcttggtggtggcttggatttggccgtcaccaatttgagagacagcagcagctttggttttagtagtggcttggatttgaccgtcaccaatttgagaaacagcagcagcagtggttttggtagtggcttggatttgaccgtcaccaatttgagagatagcagcggctctcttagccttggaggaagcagtagtggcaattggttcaacagcaataccgaaagtagaagagtaatcagttataccacccttgtaagtagctgatggagttaaagtggaccacgggtcctttggagcataggcagctaaagatgtagcaactaaggcggaggcaactaatgattttttgtattgcattttctagaatatactattaggggagttttgtagtttgtttttttttaataccagtgtattaacttttgttttcttgatgatattattcttatacagtaatagagaagataggacaactatgcataaagtagtaaagatcttgctcctttttatatgtgagaattgtagcattacgatcttcttattgaaagaataattagtataccagcgttctaatatttgggcaggagagattgactggacacagtctaaaccctttcagatacatgggctaaatgatggtccatcgtattattaaagcaagtaatcgagctccaagaaggatttacgtccgccatctcaatttcttttattagcgttgcttctataattggcaggacataaaaaggctgctaataataaatgatgatataattaagagcaagctggccgatctctccatttttatgcgctccaagccacgtcattttccgatgacaggaatgctttgcatatttcatatgagatatacattgactccttttcgaccaaccgtttcattaaaggggcagcagctgtcaaaaaagtagccgaaaaaggcgtctggcttcgaggaattattacctaaataggaaaggcagaatatattagaaaaaaaagaaaaaccaaatgagaaaagtgctggtgctaaataaaacattattgaggggccaagaggggacaaaagaagatataactagatcattaagttttcgctctagtaacaggaacaaagattgtgagatacactgttatgctaagagacggtgcgatattctgtacgaaaattatttaactattaactaaatgtataccacttcacgtgccaccgagtaggtttctaaaatgtgcaaccattttaggtatgtgcgcagctctttattctaaacgggagtcactacattactattatcgtgtttttgcccatgtactttcttataatcttaagacaacaacgggatgataggcgcattcggactttcattgatgcaaatgtgtgaaaaatgcatccaaaagacaacttttgtacagaatacaattgcaaaaatactttacgggcatagatcggtaaggtcaccgggaagctagcgtaagagaccttattcggaaccgagcaaccatttccgaatgtagtagtagttgaaggagtaaatcgaccttattgtacactacttcctttaaatttgatttctggccccgcgcaatttcttggcggttaagctgtatttttacctcatcgggaaaagttattgcaagttaaaggggatcaaacgattagcaaactaattatagatcaaaggccgagggctttctaaatttggcatatttcgccgtcgactgaaatagaagggataaatcatgcatctccaggattatccctactccattcattacaacatgcgccaaatcaagcctatataagattctcgtcatttagcatgctctattgatttgtgtcttgttttgtctaacactgaaactgtaacctaagatttctttagataattattacatttacatcaataagaaatctcataaaacaagtactgtttataagtaaaaatgcaatataaaaagccattagtcgtctccgctttagctgctacatctttagctgcctatgctccaaaggacccgtggtccactttaactccatcagctacttacaagggtggtataacagattactcttcgagtttcggtattgctattgaagccgtggctaccagtgcttcctccgtcgcctcatctaaagcaaagagagccgcctctcagataggtgatggtcaagtacaggctgccactactactgctgctgtttctaagaaatccaccgctgctgctgtttctcaaataactgacggtcaagttcaagctgctaagtctactgccgctgctgtttcccaaataactgacggtcaagttcaagctgctaagtctactgccgctgccgtttctcaaataactgacggtcaagttcaagctgctaagtctactgccgctgccgtttctcaaataactgatggtcaagttcaagctgccaagtctactgctgccgctgcctctcagatttctgacggccaagttcaggccactacctctactaaggctgctgcatcccaaattacagatgggcagatacaagcatctaaaactaccagtggcgctagtcaagtaagtgatggccaagtccaggctactgctgaagtgaaagacgctaacgatccagtcgatgttgtttcctgtaataacaatagtaccttgtcaatgagtttaagcaagggtatcttaaccgataggaagggtagaattggctctatcgttgccaacagacagttccaattcgatggtcctccaccacaagctggtgctatctatgctgctggttggtccatcaccccagaaggtaacttagctcttggtgaccaggatactttttaccaatgtttgtctggtgacttctataacttgtatgataagcacattggttctcagtgccatgaagtttatttgcaagctatagatttaattgactgttgaacgatgcatcgatcaatcggagtcgtcctcctttaacttcacgaattagttgccactctcattccccacacataaacttgttttatggcatccttttcatttagcatgtctttatttccaaacctttcctcgttctttgcattcatttagcgtttgctcgagaaagcatcacgttttcacacattatcgttcgtcgctataataaaaatagttatagaatttactcagatttacatgtcgtacctttttaattgtaaaaaaaaaaattttatgatacataattacctaaatataattcagaatcaaacatacttatagctatttgtatgctattaggtggtcctgctataaaaatatcgtttataatactttatattttatctttcaacttagtcgcaattgcagaagctttccctgagaaaaaatttgtgaagctagctgcgatagcaaaggagcgcttaaggtatagaaaagcactcagctggaatgccaaaagatagtttagcaactgaccaaggaaaaagcttgtaggtagacttaacttcattgttctctaatcctttcgtcgtgtatattgtaaaaactgctgaacgagtattgataaaagatatcttggccactaaggggcagatccccttctggtgtgatagacaaccccaggagcatagataacaccaacttgtggtggagggtcatcgaattggaattgtctgttggcaacagtagaacagatgctgcccttgctatctgtcaaaatgccgctcttcaaagttactttcaaagcgctgtcactgctacgacagctttttttttagaaacagcagcaatgccttgacatgtaacgtaagaaaagaaaaaagagatggcagaagaaatactaagcgataacggcaatgtagaggtgctttttttatcggaataaatagagaagtcagtaacagtgattgctgtggctccctctttaatcgtatctatgtaggttccgattaaagtggtcgtgattcagtattttttttactaatcaaagtacatgcactgttttttgtggggatagcaatgatttcaatttggccgtcaacgatctaagaaaaaacgtctctcttaaccgtggtagatcctgttgtaattgtttggacagtgataccgaagaaggaagtaaattcagtagcgccgcatgaggtagtagcagaaggagttaaggttgaccatggctcacttggcatatactgttgggcagaaacagtatagtgaaactgttatcaaaccaatatatttgggctacatggctttcctttcccgaaaaagacaccatttagtaattatgttgtacttttactctctgaacttctgtgaatataaaaaatatactaaataaaaggatgcaacttccttaaagagggcaagatagcgacataaagtggaaaagtgttagcaacattgcgcaggcatcgattaatatatgcatatatactttttacgtagtctacgttaaattgtcaatagatcaagcagaatcggtagctctgttaagcgattaagcccagtggctttttgtcgcaccgtttaggttcgcgttagcaagatggaaaaaaaagaacgcgaatcatgtattgacgtatgacgtattaggcaatttacaagattaaacttaaatttgcgacggagttttgaagtagaacgaacaccttactcatccgcaacaggaaattttcacgcagaacgtgcctaagaaaaaaaaatcatatgcgtttacaggcacaaatgaagaaaatgaccggatatggatataagcttatggaagaaattgctcctattgagttaagaatatgcgagcgagacctgcataaggctaattataactcttcaacccaaatttgtctttctcttcacacccatctcttatagtcccatatattcatatgaaagttcaatgcttagactcagtgtgtacttatgatgtcgttgaaggctatttggtctactgaaaatcctacctcgtacgaatacccttatagtattatttaaatatggggttactattcgcattcgttagagtggtgggaaattgatatcttgtttgggagttgcgaaacaaaagaggagaagatatgcgcgctatgtttttcttaaaagaatgcctactgcctatgaaatgaatatactaaacgtaaaagtgtagataatagaaacaaagattaaggtcgcttactgtaaaaaacgtcttcattttaattcaacgaaataaaagaaatcacgtggagtgtagcaccgccaaagagctattttttatgtcttctagttgaggcctatttccattctgcgacgaaagtgtgcttctctcacttgggctaatccatttttcaacaaaatcagcaacgtcttcgacttcgcagctactagaagaactgttaataccattataaatgttctgtaactgtaagaagtccgtcatgaagcatattcttccactccgtttgtctgaaaatattgaatccgaatatggctgtactatctggctagatcccgtcggccgtgggcttattaaactctttaataacgatattattgttgggctcgatctttgcggggtgtctacaatgaaaagtctatgttctggaatattattcttgattgtcatcaatatctcaattaatttagtggggatataaagttctttaccaggacttacatgggatcgatcattgaacatttgttctaatgcaagttcacatgagtagtcaatggcgctatcaaagctcttggatttttgtccattcttattgatatccacaaagcactgttgccaccctttgtcatctgaagagtaccttactaaatcgtgggttgtgtattttataacatcattaagcatcaaaatttggattggatcctctatgtgaaattttttctgtaaaaaatatggggaaaccggataatcttgtaccaaactgactgatccaggtattccgtctaagagcttcgaaggtattttgtcacacttgtatagaggtaccatgaaatattttattttctggaacatgttatcagataaagtagacttgagatatgacattaaatttttgcaaatctgaattgcttggggtaaatccgtgtaaatattcacaatgttaagatcgtaataaggatagtcatttaatttgtaattaaccagtagccatttggcaaggcatttgctaaattgtggctcacagtcaagaatgttatcaaatgaaaagggttcttcttttgcggttgtagttacaggcttcctttgcgtaaaaaaattttctcttttcattatgtttgggaaattttgccactctatgtaatctttcaaagaaattctcgcagtttggcctcttcttatcccatttgtagagagtaattgctcgaaagtaaacagtgggtaatcagatttcagatgaacttgaattctcaaggggtgtaatcttttcatcattcaatcccgccaaaagcacctttaaatgatatcaacttttttgtgaaaatattagtaagctatttaaaacgggaaagaaaacttgagagaggactgacgagggaatcatgtttatattcggatcatcgcgaatctacgcaatggtgtatcctactttctcacattttggtttttcccgctttcggaaggaactgcaaaaccgccgagaggactttctctttttgcaatatttgaagtatataccaataattaagaaggtgaacaggcattttacatattcattatagatagtgtatgtgcgcatctattagttgtggttttctgctacaaaaatttatcgtctaaataattcaagttctttttctaggtcgaagaaaaaatcgctgtcatcctcatttgtattttggtttgtaccatcattgacatttatatcgtgacctgggggagacgatgaaactgggctcatttttgttatatttggctcagtaggtccgttcagtagttcactattttcatgcttagtatcttgtttgaaggtgttttccttttagttaacaccctgaaatgaattagagcttattcccataaggttttgatatggctgggttgtagttagtgatggaagttggcttacataggaaaattcaggactataactgggtaaaactttcctagaaggatggacctgtacaacttcttgaggaatggcatcctctaaagatagtgatgatgatggggaatcaccgctaataggatgttttctaacaactttcctgaaatcaaatacttcctttataacttcgtttcctaattccgccatactttcgatatgctcgaattcgaatctaaaggtcttttgacatgagaattcctcatctatatcatgccacattgacaaatatggatgctctagtgcatcctctacagtaatcctttttttaggatcaaattctagcattttctttagcaattcaagcgcttctggattagcaccaggtagtatgctttcaaacgatcttcccgggatattaccgaactgaaagatataattatacaccttttgagaggcaatttcctgcaatgtttcctcaggtggtgttccaagtatttgtagaatatgattcaaatgatctacataatccttcccttcaaacattggtttcctaccaagtagttcggccaagatacagcctgttgaccaaatatcgacagcttttgtgcattcttgataattcagcaaaatttctggtgctttataccatatcgaggttatataacccttaatgaagccgtcgttaaccttgtggttttctgaataactacacgatagcccaaaattacaaatttttagttggcaatcactattaacaagtaagttttttggtttcaggtcacaatgtaaaacattagcagaatgtatgtatttcagagcacacagtatctgatatatgaagctttgaaagtgtgcgtcttccaggcgttgttcggaccttataatttgagaaaggtcacattccattagttcttcatataaataaacgccatttagtgccccatttgggtaaaatactatatcagtatcgaagagccacactatatttgggtgccctcttaaatgtcttagtagtttcaattcacgaagagttctcttgcaagatagtttattgccaaacgcgtttggtatttttctgatagccacgtgagtttcctcgttcgattctgtgtaagttgaagaacaaataaggctgtgtgagccccgaccaatcttacctgtcaaatgaaaatgtttatttaggataaaatcttggccgaatgcacggaaaatacacctctcggtgtcagtcgccatttaattgtgaatctttcttcgatatcaaactattccaggccgaattaatctggcggtaagtcacctttagttatccttccattttgtcccttttcatccagtctcaaacgacaattaggacttacattaaataggctttttgcctagtataacatcataaaagtaccttcttttgtttcttccaaaaaaagacagtaaccatctgaaaagaacgtcattgtcgaaaattacaaagtttgtggcagcgctttttactgcagcaagtcaattgctttcatggcattttcaatcaaaatacgagttcttactaattcctacggtgcttcctgcattgattgatcgcgagttactatttttaactcgaatgggtctgcgcgtgtttctccggtgttgttcaaaataatctgtttgctgcgtttaataactacaacagttaacggaaacagtgaaatttattggggactttcaagtaacgaataatcatgctggtagaaatatttctatttttataattaacaaatcttttaatgacgtcttgtgggctgaaaactacggcgtttattttttagataggttattccttcgttggattgagtaagaaaatgtcgatactgtgttacgtttgcaaggaaaagatttagttgcgattagccattcattcttgtggaaacttctttaaaaagggatggcgatggagtacttatgtccaattatgaagtcaaatttattttcaaaccgttacacgtagattattttcctgcagtggtaagtatctttgaagtgttgaaagttttttggcacatatttttttgcggatgtgggcctgagtttcctgttagaaacaaagatatgcttaaaactaaataacattggaaattagggcatagtcttcaatgttatacttaaacatcacagcaggagattgagatgattgaaagaatggtgcaagaaatgattcattaacattcttccaagttttgcaatatttgcaagtattactatcagactttagttgaagtgactatgctattaccaaatttcactggagccagaaaaataaagatcacttagagacaaagaaaagtaacatcttcaacataagccggagctcaaaagtaggaaatcggataagaaacttgattctgttatttcaagtgattttttgctgtatcgcccacgttcttgttgtagatgttttgtagatgtgggaccgaaagtaagtgaacagtgaagtaaacagaataggattctaaaaaagagcttataaactgttctttaaaattttttctttcgtgaatgtcctcgagctatctcaaagaaaacgaaatcttcattcaacttaagtgtaggtattatttgctgtttcatcaaatgcggcaccaaagtggaagtattctagtcagttagtttttcattgtgaggaattgatatgtcgttctctgatagaaccacgctaagttggtgttcaattttttgcaattcggtagtaattatgccttgcaacatgttttattcttttatagtgtgataccgtcaatatgatgatttgcggtggagcatgcatgtgcttactagaagtgctgctctggtgggcattttagggacaagaataaattcttctctccactatctgaacttccgttattcttctgcacgtaattgccgtttttaggattttttggagttgtcacggtatagatatgtcttattgcgtgatttcacggtgtcttgcacacaacatttccaggtcacaatatttggttcgaggttcccagcaagaattcattatccttttcaatgtgtcgcattaaatcattatccaaaaacaaaagaacttaagaagtacaaaagacacttgaagtatgctagcgtaagaaatacggtaaccaatatttatatgtaacatgcttattctgtcatgatttcacagttcaaactacattcctattcaaaatcatcgcgttagtgagacaaaatcggtgggagagatgttagacaaaaagatgacaacattggaaataaaccacgacgaaaaatacctttgaaaggatcttttttcgattttcctgtgaatttgtaggcttttgatggtacgagggtaaaccaaactggacgggaaatcaccattattagtcctatgtagagcctcgtcaccatacctatataaacataactattcttttaagtacttaaacggcttttttctgaaacaaatagccaatgttttcataacgaagattccaaagttacttaacgctcttcaggcacttccttatttattatgacacgtacaaaataataaattcgtagttataagattatcttatcatatttaaaatatctcttctttcagttgaaattgggcccaaaatttttaccccatagcgttaaaattaaacaaaaactgctatttcggtgacaaattgtaaaaattctgaaaacggaagaaacaaaaacgtttaaaatgattaaactttggtaaagcaataatctacaaataattggaaaaggaatagtaataaagatggggagaattatgaagaagaatgtcataaaaaacactgaaaacaattaacgagccatgggtaaaagaaagaagtcaacaagaaagcctaccaagagactggtccaaaaattagatacgaaattcaattgtttattttgtaatcatgaaaaatcagtttcatgcactctggacaaaaaaaatagtataggaactttatcgtgcaagatttgtgggcagtcgttccaaacgcgcataaattcattatcacagcctgttgatgtatatagtgattggtttgacgccgtcgaagaagtcaattctggccgtggaagtgacacagatgatggtgacgaaggttctgatagtgattacgaaagtgattcagagcaagatgctaaaacgcaaaatgatggcgaaatagattctgatgaagaggaggtagactcggacgaggagaggataggccaagttaaaagaggcagaggcgccttggtagatagtgacgatgaataatccggtcctgagaaaaaaccatatttacttaggtcatatatattttatattttaaagcaaccacccgtaagcatttaagtctcttaagccaacaaatcgcctcgccatcttaatcatcgtcatcagtatcgaatatagattttggtgggaaagcggttttaacgtggtccgctaattgcatctgtccatttccatcgttcgtgggacatctatcaatggtaattgcgcccacctttgatttcaataacgtgaaagtaccattgttatttttgtctggattattaggcaatagttggctagcttccaaccgctgctgctggtcctgttgtatatgactttgtatatgcctttgtggcgcatcctcacatttgctgaaatcgaattcgggaggtggtgatgctgggggcgatatcaggaacattttttcactctctggtaccttcaagtattgtttagttaaattcctttgtccgtcttgcaaggagtagctgaagttaaaattttccatttctaaagcacgagacgcatccataacatgctgagatatatcatgactggggcagatcaacagtattcttttaaaccttttcaaaataatcaactgtagtggttcattttcattgatttgaaacttccttaagatattcttggatagccaaacctggattctttcaacattatcattatcaacaatgtcgcacttatccgaggttataattatcgtatccgttataatattacccatctgcagttctgtgttttatatatcggttggtttattgcttgatctttttggccctctttttttcatggaattactgtatttaaaaagaaaaccatactttatatagaagtcattgggcagaagggtcttgtcaacgagccgcctaggaactacacctgacagcaacttgcggcaagatagtaagatagcataattcaaagcctcttgaaccttacagcgccttgccgcggtttggtaaacttctaaactgtgtatgttacacgtgaagcgaggcttggaacacctaagaagagatccttttcatatttactatccatcaacactgcgccttttcgtgatgatgcatttgatagtatggcagatgtgctacggtacttcgatctaatgtgctcttagacagatatgctaaataatttcaatctaattcgtccgcgttgtaaattaagaaatcatgtaaacgttatatcaagaaataacaatcgaaggatagttcaaaaaatctgacataaaaaggtacttaaaaacacaggttgcataatatgccaattgttcggtggctattattgaaaagcgcagttagaggttcttctctaataggcaaagctcacccttgtttaaggtctattgctgcacaccctaggtatttatctaatgtgtactcaccaccagcaggcgtcagtagatcactgcgcatcaatgtaatgtggaagcagagtaaattaactcccccaagatttgtgaagatcatgaatagacgccctctgttcacagaaactagtcacgcctgtgcgaagtgccaaaaaacgtcacaattactaaagtatgtttacacaaaagcttaacaaagaaacaaggaaaagatatacataatataaattaccactgattattttgaacatgagaccgaaataccaggatgtattactagccttgtttaccattcttcaactggtgattacaaagtgagttctcattcattgttaccctcatattcttatcttctgcagcaggaaaaagggatttacccaactaattgactttgatagaattgtgattgcaatagcttaggtaatatttcagttagactacgacatccagttatttttttctatttctctgctcgttaccgacctttgagttcttactaacttacattctctattaattgtacccaaaagtacgaaggacaactaaaatgaccagtaaaaccccaaatcgtgaaattcttcctgataatgtcgttcctttacactacgatttaaccgtggaacctgatttcaaaacattcaaatttgaaggctcagtcaaaattgagctaaaaattaataatcctgcaattgatacggtaacattgaacaccgtcgataccgacatccattctgcaaaaatcggtgatgtcacatcttccgagattatctctgaagaggagcaacaagtcaccacatttgcgtttcctaaagggaccatgtcttctttcaagggtaatgcatttttggatataaaatttactggtattttaaatgataatatggctggcttttacagagccaaatatgaggacaagttaacaggtgagacaaaatacatggctactactcagatggaacctactgatgctagaagggccttcccatgttttgatgagcctaacttgaaagcctcttttgctattactttagtttcagacccatctttgacacacctatccaatatggacgtcaagaacgaatacgtaaaggatggaaaaaaggtcactttgttcaatacgacccctaaaatgtcaacttaccttgttgcttttattgttgctgaattgaagtacgttgaatccaagaactttcgtattcctgtcagagtttacgccaccccaggtaacgaaaaacatggtcagtttgccgcggatttgactgccaagactttggcattttttgaaaaaacttttggcatccaatatcctctacctaaaatggacaatgttgctgttcacgaattttctgcaggagctatggaaaattgggggttagtcacttatagagtggttgatctactactagacaaagataactctacattagatcgtattcaaagagtggctgaggtagttcaacatgaattagctcaccaatggtttggtaacttagttactatggactggtgggaaggcttatggctaaatgaaggttttgctacttggatgtcatggtattcatgtaatgagtttcaaccagaatggaaagtttgggaacagtatgttactgataccttacaacatgcattaagccttgactctttaaggtcctctcatccgatcgaagtacctgtaaaaaaagctgacgaaattaaccaaatctttgatgccatctcttactcaaagggtgcttctttattaaggatgatttcgaaatggttaggtgaagaaacttttattaaaggtgtatcccaatacctgaataaatttaaatacggtaatgcgaagactgaagacctatgggatgctttagcggacgcctccggtaaagacgttcgttctgtgatgaacatctggactaaaaaagttggtttcccagtcatttcagttagcgaagatggtaacggtaaaataacatttcgccaaaaccgttacttaagcacagctgatgtcaagcccgacgaggacaaaaccatctatcctgtatttttggctttgaagactaaaaatggagttgacagttccgttgtattgagtgaaagaagcaaaactattgaattagaagatcctacctttttcaaagttaacagcgaacaatccggaatttatataacatcctacaccgatgaaagatgggcaaaactgggtcaacaagctgacttattgtctgttgaggaccgtgtcggtctggttgctgatgtcaagacactatctgcttctggctacacttcaactactaattttttgaacttagtctccaaatggaataatgaaaagtcatttgtcgtctgggaccaaataatcaacagcatatcttcaatgaaatctacttggttattcgaaccaaaggaaacccaggatgcgcttgataacttcacgaagcaactaataagcggtatgacacaccacttgggttgggaattcaaatcttctgattcgttctccactcaacgtttgaaagtgaccatgtttggtgctgcttgtgccgcaagggacgcagacgttgaaaaagctgctctaaaaatgtttactgattattgcagcggtaataaggaagccatcccagcattgattaaaccaattgtatttaacactgtggcaagagttggtggtgcagaaaactatgaaaaagtttacaaaatctacttagatccaatctctaacgatgaaaaattagccgcattaagatctttaggcagatttaaagaacctaaattattagaaagaaccttaggatatttgtttgatggcactgtcttaaaccaagacatttatattccaatgcaaggaatgagagctcatcaagaaggtgtagaggctttgtggaattgggttaaaaagaactgggacgaactcgtaaagagactacctcctggtctttcaatgctaggctccgtcgtcacattaggtacctctggctttacatcaatgcaaaaaatagatgagattaagaaattctttgccactaaatccacgaaaggtttcgatcaaagtttggctcaatcactggacactattacttcgaaagcgcagtggggttaacagagaccgtgatgtcgtcaacaagtatttgaaggaaaatggttactattaagaaaaaatctcttttctagccattttgcctttttatatagtcaagtatctatatgtgacaaatacttcttctaagcttggccttctgataggcttagcttgcagtggttgcaaacatacataaatcaacaaaaaagtacggcttaaaattttggtattcatttatttcaacccgtgcacactggaaataaatctgtacataacagcatattttgtttttgaaaaaatttctgtgttcctccgatgtgggaagaattttaggatcggctaaatttcgtaaagtatcagtaacttggtatctctgtataagcggagtctaatttcgataacaagcaacttcatcgtaacaccttccaacaaagcaaagatagatatcccaaaatggtatgttagtatccaataaatgcagcgcaactggaccagtgaatagaacaatacatatagataagtcgcaaaagaaaagaatacatgtggtggaaaattttgcaccaagagaggcaagaactatgaagaaagacttttgaaatatttcaagcggttgctacatatagtggataagattcaggatggacgtatgagcttacagttcattgtaggggaatataaaattctgatgatggcgaacttcattcccagcaactcaagctattgttatttttctattctgcaccgagatgaggagaaaaaaggaagtttactaacagttagatttatttcttattcgtctacaacaggttttagttcaagatttattgcacccaactgcagcttctgaagcaagaaagcacaaattaaagacattagtccaaggtccaagatcgtacttcctagacgttaagtgcccaggttgtttgaacatcactacagttttctcacacgcccaaactgcagttacctgcgaatcctgctcaacaattttgtgcaccccaactggtggtaaggcaaagctttctgagggtacatctttcagaagaaagtaatttcattactagacagatgaaacgaaatttacttcaaaagaagagcattaataaagtgattcaattatggaaccagcagggtaggttttatcatatataatatacactcagttgtcatctttattggctttttagaaacgctgcaacaaactgtactatatatatatcatattcacgtatgtagaatattaaagtattgaatatattaatattattactttatttccagttacttacaatttcctattttctatttacatgttgtaaaaaatcgttgccgtgaaaagtggacaatttcttcattacctcaaagtttgagaactgatgatcatcaaattgaagagagtcctccaattcattataagattccatagcctttctagctttttgacgttcttcctttttcaactgcttgattctctccttttctagcttgtggaacttcttaacattcaagtctcccagccctttaatctgtgttttggccgctgaggcccataaatcacctttcttactctttctggcatcgtggtatatttgtttagaaaacgaccgcgaaaccgtccatttttcaagttctcctgatggcgcacataaatccatcataacatgacctttacgtttgacaggatcattgataattctaggccaggaattttgcgtgtcatcacccagtgatccaatgtcatatttgccgttcacattttcattccgtaatttcttaatttctttcaacgtattttcgtccttatgtgatctctcgaatattaaataggagtagtttaaaatttcatagtcacgaccatttcttcttcccgttccttttagcctcgacgcatttccttgagaaccatcccatgaagtagcgagaagtttacccttctttaactctatactgaatttgggacgcttgatgcttttttgaaaattgcagaactttaagtctttaccctctttatgagtataaaagttaggatttccaacctgtaagggacatttcctttgatgtggacaaggtgcaatcaccttcagaaaataattactggaaatgtttcctaattcagcatcttttttgcctctgactgttactcccctagaccaaggtcttggtatttttccgaattcatctggaaagttttcaggtctaagcgtaatttgccttgccctggctataatctcgaatcccattgggttgcctcgttcaataataacaatgtggcctccaggcgctagaatatttaagtagtgctcaatattttcatccacctgaattggaaattgattcccgtcatgaagaagttgatgcgttaatattatgaggtcatattccttagatgcgggaatagaagaccgcaagttagtcataatgtttatcttttttgtcatcacttctccaatatgttcatcctcttgaaagtttttgttccgtctatctgtttcctgctctttctctgtagacacattttcttctacagtatcgaccacctcgttaagttgtctgctcaaaatgattttggctctttcttgcatctccgcattccctaaaataacggcatcttttagatcaggtctataatttgggcctaaaatatcattcaaggcaactataccagtcgctgggccatatccaacatcaaggattctttgaggtttaaaattatcaggacctacccttttttgtaattctttcagactttggaaaatagaaccataattttgtaaaaaaatggacgctatatgtgcatccacttccattttggttctacagggacgatgtaatgaatttggttcctgaatctctttgtaataatttgtagcaacccttctaagattattgggaatatgtacagccataatattattgttgattgctttgcttacatcaggattcaactctaattggtcccggtacgactggccctgaagtgttttggaaagtaatctgagctctttagaattagttgcttgagtggtgctagcggtttcatctctgtacgacggaagaacattgattcctcttttatttgagtctataaaatccgccaaatctaactttggtaagtttaaacttgtgaactttgagctgaaccggacattttgtggtaggatactgaagcatcttttcatcattttacctaaactagacgggccaccttatgtcctaaagtgtcagaggttttgctgcaatactgttcttaatttttcaccattcacttttttcatctagtggcggaaaaaaataagagatatggaaaacaaatatgaaccatcattaaacttgaaaaagatgagaagaaaagaaatagttaggctttaagtgtctgtattgatcaattaattattactttaccactgctgtttattagcataatagcacacgggatcagaatgcttagtaatacacttattattgcctgtttattggtgatagggacaaccatagcgctaatagcagtgcaaaaggcatcctccaagacagggatcaagcaaaaaagttatcaaccatctattatcattgcaggtcctcaaaattctggaaaaacgagcttgcttacgctgctaaccacagattcagtaagaccaactgttgtttctcaagaaccgttatcagcagcggattacgatggttccggcgtcacgttagtggacttcccaggccatgtcaagttgcgttataaactctcagattatttgaaaacaagagccaaatttgttaaagggttgatatttatggtagactcaacagttgatcctaagaaattaacaacaacagctgagttcttggtagacatattatcaattactgaatctagttgcgaaaatggtattgatatcttaattgcatgcaataaaagcgaattgttcactgcaagaccaccatcaaagatcaaggatgctttagaaagcgaaattcaaaaggttattgaaagaaggaaaaaatcgttgaacgaggttgaaagaaaaattaacgaagaagattatgcagagaatacactagacgttttacagtctaccgacgggttcaaatttgcaaatttggaagcatctgtagttgcttttgagggcagtattaataaaagaaaaatttcccaatggcgcgaatggatagatgaaaaactgtaatataattataatttataactagatgaacgatagatagtttaaaaacaagcatttaacatagctctagattccgtacgcagagaaagacatagttgcatcatcgacacatgcaatatcaaaagtaactctttttgactgctggtgtaaaaaacactcacgatgggggtcgaacccataatcttctgattagaagtcagacgcgttgccattacgccacgcgagctaatatttgtttgatgttccagcagttatatgatctaattatgcgggaaaataattgaagataagtagtttgatgtatttttattatagtattatattttctgatttggttatagcaagcagcgttttttttcttctttaccataatcattgtaccaggaaattttgttcataattattgtgttgattgtcaatggtcaaaggtacaactaatgaagattaaatatggtgaataggaggcctgctagccaccgtacatttaatatgtccgcgtgttggaataaaaatcaactatcgtcatcaactagtggttatactaccagtatattatcttatatggtgtcaaatgtggacatgatgacataaggtatgagaaactgtcatcgaagttagagaaagctgaaatacaaggatcaataatgtaataggataatgaaacatatgaaatggaatgaggaacaatcgtgatattattatgtagaaatatcgattcctttttggggatgcctatatcctcgaggagacacttccagtatattctgtatacataatataacagcctttatcaacattggaatcccaacaattatctcaaaattcaccaacctctcatggcgcatattcatcatgcatgtaactaccacatcaatgttcaatcatggacttttaactaatcttaagtactattcgaactgcccattcagcttttccctttgcaattggtgcactcctacttgaacgaattcgcggggtgtacattaaactacgatgtaaacatcaaggttattgctataacatgtcatgtcaccattaattaccactcattccaacatactgtccctgacgaaaactgtttatgcgagcgcaaaatgaacctattcaattaataatactcctcaaattgctaccacgacaggctgaaaaaagatgtcgacgaataatgtaatcgtgtcaaacaaacgttatcttgactatatatagctacttaatttgaaataataaactatacaagtctatatcattgatatattcagtaagaaaaatggagggaaaaagaaatcatcaaatcattcattcttcagacttatttcttaccttggttggcaacagcagcggcaccagcagcggcagcttctgggtccaagtagtaagatggcttagatggcttcaagttttcgtccaattcgaagaccaatggaataccagttgggatgttcaacttagcaatgtcagcatcagagataccttccaagtgcttaaccaaacctctcaaggagttaccgtgagcggcgatcatgacggtcttaccactcaacaagtccttggcaatgacatcttgccagtatggcaacaatctgtcaatgaccaaagccaaagattcagtttctggcaagacatttgggtcaacgtacttgtatctttcatcacccttttgagagaatggagaagaagcgtcgattgggggaggtggaacatcgaaggatcttctgtaggtgttgaatttttcttcaccgaacttcttcaaagtttcagccttgtccttaccttgtaagtcaccgtaatgtctttcgttcaatctccaggatctgttgactggaatccataatctgtcagccttttccaaagcaatgttagcagtttggatagctctggacaacttggaagtgtacaagacgtctgggtagaccttcttttccttcaacaattcaccggctctagcggcttcttgttgacccttggcagacaatttaacatcaacccaaccggtgaataagttcttttcgttccattcggattgaccgtgtctaactaaaactaactttggcattattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcatgatatagctcctgtcaaagtatcaccttggcctcctaccctcttgttgctgccctcttcgctgttcgtcaacatgtctttttcactatcgggtgagaatatcttatctgactgacctttctccaccacaatacaattcaattcctgggcgatcaagctgcccatctcggagtgagagtctcccttcttgcctatggcatcacatagtcttttgaattctaccacattgggcgtcaagatcactctacctttggggtagcttttcagcatttctttgacttcgctatcttgagttactaagaacagtccatcagcatcaattactaacgggatcttgccctcatgtttttcaagtatatatcttatgatatccttaatggattttaacattagggggtccctacccaagccgggtccaattaccacaacgtggattctatccaataaggaattgattttcttcctttgttcgtccatatcaacgtctaatttggtgttactcatacgaaggtatggatgaaccattaggtttggggtgtacgatttaatgaccgtaccagcgttgtattcgcagatgacatgtgtcaaatcacagcccatcaaggctgtagcattggcgctgaaatacggtgcccctgtataatcttcgcatcctccaataatgcaaactctcccaccagactgtcccttatgaaactttggcaataaaggtggtatacatcttttctgcgccaactttatcaattctctatgagacaattctgctaacatttccagtgatacggtagtgatcgtattgaactggtgttgctaataaaatttcaccgacgcctatatacctatttacacctttacatatatatctactagatcacgttgcaagacccatcacatcgcatcacatcacatcactccctattctgccctttacagcgcaaaggagtcgtgtgtgggtgtgtgctccttttgacgatcataagagtccatttctagtatgcaagctggtaacaataggtgaatgaattaggttcatttgcgatgaccttcagtatccctccacgcaatgctaaactatccccctcattatgacgcctatatcgtataaggaacttgttacccctgacaattcaaacttcaaaggtctaagaccaaacaagcgtaggaactatcgctcggagtgtttctccgtttgaaaaaagaagagaaataagggcccttgattggtgtcttgtcgagagaggtacgtatataagaatgcagtttgctcgcaatgcccgcttgtgttaagtactcttaccttttccctcaatactaacgttttgaagcagccaaactaacaatagtataacgtatataggttaaaataatattccaagtcaaaaacatgttttccagattatccagatctcactcaaaagcattaccgattgctctaggtacagttgctatagcagctgctaccgcattctattttgcaaaccgtaaccaacattcctttgtcttcaatgaatctaataaagtgttcaaaggtgatgacaaatggatcgacttgccaatatctaaaatagaggaggaatcccacgacaccagaaggtttacttttaagctgcctaccgaagactcagaaatggggttggtcctagcatctgctctgtttgctaaatttgtcacaccaaagggatccaatgtggtgagaccatacactcctgtgagtgatctttcccagaagggtcacttccagctggtcgtcaagcattatgaaggtggtaaaatgacctcacatttatttggtcttaaaccaaatgacaccgtttctttcaagggtcctattatgaaatggaagtggcaacctaatcagttcaagtcaatcaccttgttaggtgccggtaccggtatcaaccctctgtaccaattagctcatcatatagttgaaaacccaaacgacaagaccaaagttaacttgctatatgggaacaagactcctcaggacattttactaaggaaggaactggatgcgttgaaggaaaagtatcctgacaagttcaatgttacttactttgttgacgacaagcaagatgaccaagactttgatggtgaaattagtttcatctccaaagattttattcaggagcatgttccaggtccaaaggaaagcacacatttgtttgtctgcggtcccccaccatttatgaacgcttactcaggtgagaagaagtcacctaaggaccaaggtgaattgatcggtatcttgaacaatttgggctactccaaggaccaagttttcaaattttaagcatggaggaaagtaattgatattttttttaatttcggatcgttcaaattagtaaatatataaaaaatatatatatattcatgtgtatgactaaaaattctctcaagaaggcttggctttaagctctaattccgtctgcattcgtaatagaaatatctctcaagtcatgaatttagagataaatgctttagtttgtcgtacttcatctttctgaatatctaaggtgtatgcaggaatggcataattttcccaatcaatatcccttccttcctctctattagattgagacagttctatccaattgacgctattaaacggtttattgcttaggagattcttatttttttgacaaattaccaaattattgataaattcaggatcccagaacatacggtgattctcgtccttccacgaagcatgcgatgtatccggttctatttccagaatttctaaccaacgtcttcttggcaggcacttgtccaacgccaagaaccgtgtctcgccgtatttggaatcatactcattctcttcttggcaattcataataccagacctttcgtcctcgtcactggataaatccaaatctatttcattattgtttttttttgtctttgaagttgacttattaggcggttcgtggcttcttttattatgcttaatggaggccatgaacctgacatgcaaatgggcgctcaaccaccattgaggccgcaaatctcttagtagttgccaggtcactgggctgcctagttttccctctttaatatcttgctcaaaaaaaggcttaagcttcaacaagtgcttagtatcgccatgataaacgactccattgggccaatcgtggctcagcataatatcaatacgatgcttgatcataaaaagaggagcaatatcagaaattcttacatgatacagatttcttatgttagctttccaattgttattttctaggtcattccaatctggtcgttgcttattgaaatcccactctttccatatcccgctcaatgaacctatccttatgcctttaaaccatataacgttagagtatcccatataaaaaatgttctttgctacataaccaccatgtggcagaagcattaaatgtctcatcgattcatgattaccgccaataaaaatagtagggactggggcttcaatctcattattgtagtatgatatgaaatcaccgagtctttgatattttggtggtatggctattgacttaaaatcctgaccatcacgaatactttgaaaatctccaagaataattaatagatcgatgggagtcttcgcatggattcgtgacacttctttataaatttggtttagctgaccatgacagcacccttgtacagcaattcgcaatttagtcataagcaaaatgataaatgtctgcccatcttaatttttagttacatatttacgttcgccatatgactttctcctgctcattttttgtgagggccagaaaaacacacatctggctaatgagaaaaaaaattggagaactaaggaaatgcctcgataaaaaattgaaagtaataaataaataaataaataaataaataaatagtaagttaataaataactaaataaatagagtatgtataagaagaaactttatgtaaatgtatattaataggtatatatacaaattagtgagtcagtggtaaaaaagtgcaaacgcacaaaaaaagtgcaattaaagaagagtatgatattcttttccgtaaaatacaatgaggttcaaattagtaggctcttacagttggaggtacggaaggacattccttttcgtccaaagtgtgatcgataacccttctgtatttcaaagtcactggggcagcgacgtccttttgccaggataatgtatgcttcatccaatgttcgtcatctctatttggataatcctctcttgcatgagcaccacgggattcctttctattagcagcggaaacagctgtttgggaggcacaggttaataagttctgtagctccagagtttcaaccaagtcagaattccagatcattgatctatcggtcgtcttcacatcatcaaaggtcttctctactgcagtaatgttccgaacaccttcatctaaagatgattgtgttctaaagacggaaacatccttttgcatagtttgtttcatattcattctaatttctgccgtagatcttgaaccattagcatttcttagtttatccaagtttgcgatggattctttacccaaatcagaaggtagtggtttgtgtggcaacccaggctgtaaagtgtcagcaaccgtatgggcaacagcacgaccaaagacaacaagatccaacaaggaattggcacctaatctattggcaccatggacagaaacacaagcggcttcaccacaagccattaaaccgggaataaccttgtcttcgccagtttcttcatcaatggttaatgcctcaccattccacttcgtgggaataccacccatgttatagtggacggtaggaataatgggaataggttccttggtgacgtctacaccagcaaaaatggctgctgtttcagagatacctggcaatctttcctttagaacttccggaggtagatggctcaattgtaagtacatgtggtcctttttcttaccaacacctctgccttctctgatctccatggtgattgctctggaaacgacatctctacaagctagatccttggccgtaggagcgtaacgttccatgaatctttcaccttcagaattaaccaaaaaaccaccttcaccacgagcaccttcagtgattaagcaaccagacccatatatacctgaaggatggaattgaacaaactctaaatcttgcaaggggaaaccagcacgcgaaaccatggcattaccgtcacccgtacatgtgtgagcagaggtacaagagaagtatgctctaccatagccaccagtggcaataatggtcttgtgtgctctgaatctgtggatggtaccgtcttcctgattataagcgatgacaccaacgacctcgccattatgggtcaacagatcgagggcaaagtactcaataaagaaatgtgtgtcatgtcttaaagcttggccataaagcgtgtgtaaaagagcatgtcctgtcctgtctgcgacagcgcatgttctataggcctgagcacccttaccgtactccttggtctgaccaccaaaggctctttggtagatcttaccgttttcagttcttgaaaaaggaacaccatagtgttccagttcaatgatcgatttgggcgcttccctggtcatgtaatggatggagtcctggtcacctagccaatcagatcctttcacagtatcgtacatatgccatttccagttatccttgtgcatatttcccagagcggcattgataccaccctgagcagcaacagtgtgggatctggtggggaaaagcttggatatacaagcagtcttgtagcccgcctcggcaagaccaaaggccgctctaaggccggcaccaccggcaccgattaccacacagtcatactcgtgatctattatgtggtacttcccgtctgcagatctggacgcggaaccgtttacagagccctgcgtttggcgcaccaaagctgacgatgtaaatgttcttgtgtttctgagcaaagtcaacttggagagcgctgatttttttagcgatagcatctttattctcgttcttcttcgtactatgaaattggatttttttctttctttctttctttctttttatcttcaataaggggttggggaggagattagtgaaaagaatatcgaaagtgcaaagtatactactggttagttataatgtgtctactagtttattagtgctatttaagcttcaagccgcctcgacgtggcaaaaggttagagtcgaggatgcctgaatatataacgggtttgagcaaacaaacaaccaatagaagaggcccggatcccttggtccagcgcttgctcggcgccgcgttctgcgctgtgattggtccacccccgccctcaaagccgtgactccataacgactttccagcgagcttggtacctggcaatagaggatgatcctcacctccgctacttttgggagctacttttagcacggaaaggtatattttggactactgtatgagtaaatccttatatagacgacattattactaaaggtagagcgagagatagtaaaagggttggttacccggtcgggcctttttctcgtattatcatttgtgctcgtgaggctatgaaataagaaggatcgatggtcagtagtgaaagagtgggaagcaaagtttattaagaagcgtataagggattgcatcgcggatatgaatggaaaagaggtttcaagtggctctggaagaacgcagagcaacaacaacaaaaaaaataacaacggaggcagtacaggaatctcgcatgcgtctggctcacctttaacggacggcaacggtggcaatagcaacggtaatagtagaagtagaagcagaagtagaaaatctagtggaactacaggtggtttgctaaaaaagccgccgctgcttgtgaacaatgaagcggtgcatgctagcgtacccgacgcgtcgcacacttcctgtaacaatggcacgcttgaagtgagcataaataaccctgagccacatgtggtagatgccgtggcacgccacttgataagaaacccgagtaacagcctacaattgcaaggcggagacattacaagagatctgtataagtggacaaacgaccatccttcatcaccatcgcagtatcagtacccaagtcaacctgcactttccacctcaataccttcacaagcgccctcattctcgaatcgtaaaaggtctatgagcttttctgccgcttctatagcatcttcctctcaccttaacaacaactcggaggcgaatgggaatcctctagcggcaataggcctggcgcccgcaccgatgacgcacgaagaaatcagggctcctggtggattcagaagatcttttataatacagaagcgcaggaaacataacgttgatgcgcccataccgaattttttcaccaggaactttattgaatttttgaccttgtatggccacttcgctggtgaagatttatcggaagaagaggaggaggaggaagaaactgaagaggagccagaggaggaagctttggaaacggaaagcacccagctagtttctcgtgaacacgggcgccatcctcacaaatcatctacggtaaaggcggtgctgctcttgttaaagtcatttgttgggacaggtgtgcttttcctaccaaaggctttccataacggtggttggggatttagcgccctttgtctactctcgtgtgccctcatttcttatggatgtttcgtatcattgattaccaccaaggacaaagtaggcgtagatgggtacggtgacatgggtcgtatactatatgggcccaaaatgaaatttgccattctttcgtctatcgccttgtcacaaatcgggttttctgctgcatacactgttttcactgcaactaatttgcaggtcttttctgaaaatttcttccatttgaaaccgggcagcatcagtctagccacctatatctttgcacaagtactcatctttgtcccactatctttgacaagaaacatagccaagttaagtgggaccgcgttaatagcagatctatttattctactgggattggtttatgtttacgtttactccatttattatattgctgttaatggtgtcgcatccgatacaatgcttatgttcaataaagcggactggtcgttgttcatcggtaccgccatattcacctttgaaggtataggcctacttatccccattcaggagtcaatgaaacacccgaagcatttccggccatcgttgtccgcggtgatgtgtatcgtggcagtgattttcatatcatgtggtctcttatgctatgccgcttttggatctgacgtgaaaactgttgttttattgaattttccgcaggacacttcctatactctcactgttcaattactgtatgcattagccattttgttatccacgccgttgcagctatttcccgcgatacgtattttggaaaactggacttttccctcaaatgcatctggtaaatacaacccgaaagtcaaatggttgaaaaactatttccgttgcgctattgtcgtcctgacatctatcctcgcttgggtaggcgccaacgatttggacaaatttgtatcactggtaggctccttcgcgtgtatcccattgatctacatatacccgccattgttgcactataaggcgtccatcttatctggaacctcgagagccaggcttcttttagatttaatcgtcatagtatttggagttgctgtcatggcctacacgtcatggcagacgattaaaatgtggagccagtaatccgccatttttgaccgagtacatcatgtacagacacatatatatatatttatatatgactcgttatctatatgcatctggaacacacataccttgttttaattatgattagcataaatgtactatccttgtcaatttggtatggctgagtttacccggacgagaggaaaaggtatagtgaataggattaccgaattttgccacccgaaaactaaactagcatgcagcttactatacaaagaactgggtatatacagtattttccaaggagatgagaattcaaagcaatattcaattgagatatttttttgaaccatcgtaataaatcaaggaagttaggaactatacggaatgccaccaaaagaagactgggaaaaatacaaggcacctttggaagacgatgataaaaaacctgatgatgacaagatcgtacccttaacagaaggtgacattcaagtcttaaaatcatacggtgcagctccatacgcagccaaattaaagcaaactgagaatgacttaaaagacattgaagcgagaatcaaagaaaaggccggtgtgaaagaaagcgatacagggttagcaccctcccatctatgggatattatgggtgataggcagagactgggcgaagaacatcccttacaagtcgctcgttgcacgaagatcattaaggggaatggtgaaagtgacgaaactacgacagataataataacagcggcaatagcaatagtaatagcaatcaacagtctactgatgcagacgaagacgatgaagatgccaagtacgtgataaatcttaagcaaattgccaaatttgtcgtcggattaggtgaacgtgtttctccaacagatatagaagaaggtatgcgtgtaggtgtcgataggtcgaaatataatattgaacttccattgcctccaaggattgacccatcagttactatgatgaccgttgaagaaaagcctgacgttacttatagcgatgtcggtggctgtaaagaccaaattgaaaagctgagagaagttgtcgagctgcccttattatctccagaaagatttgctactcttggtattgatccaccaaagggtatcttattatatgggccacctggtactggtaagacattatgtgctcgtgctgttgctaatagaactgatgcaacttttattagggtcattgggtctgagctagtgcaaaaatatgtcggtgaaggtgctcgtatggttagagaattatttgaaatggctcgtaccaaaaaggcttgcattatattcttcgatgaaatcgacgctgttggtggtgctcgttttgatgatggtgctggtggtgataatgaagttcaaagaactatgttagaactgattacacagttagacgggtttgaccctcgtggtaacattaaagtgatgtttgccaccaataggcccaacactttagatccagctttattgagacccggtagaattgatcgtaaggtagagttttcattacctgacttggaaggtcgtgcaaatatcttccgtattcactctaaatcaatgagtgtggaacgtggcatcagatgggaacttatctccagactgtgtccaaactctaccggtgcagaattaagatctgtttgcacagaagccggtatgtttgccattagagcaagaagaaaggtggctactgaaaaggatttcctgaaggctgttgataaagttattagcggatacaagaagtttagttccacatcgcgttatatgcaatataattgacgtcaatgtacttttttattatatattatgagaagggttaataaaaacaacaagtacaactacaactatcgagataaaaaggatacgagagtatcccctcaaatagagaaagaattagcgtatataatgctaaagaaaattcacgtttattatatattattatcctcattattactgttactattattattaaatgttttattgaagtcagtggcgtccttatctatcattcccaccaactaacgagtcccatgccatcagtttgacaactacctaatagggcatatgctggaggtttttcgttttgaggagtttcttcattcttaccctcaatctcattctctaattgagctctttcctccaattctcgttctttgggtgattttggcttcacatcaacaaaaacttctctttcgattctgaatctaattttttcatttacatcgaaatatagtttcgtctcttcatccatgggccaaatccatgcactttcttcaggggtataatagcacccttcgaataacatattttgtgggataaaaatgtcatcaaatatacctaacagtgaaacttttatgccttctgctgtacatttagaaatccatccagttactatctcacctagaaacggtttgaaaacaacggctcgaaatgtaacgttaatataggatgatccatcgcctggcttcaattggccttcctcgacggttaataagtcgtaaatcgtaatacatagaccgacattgggaataatcttgttggcgaacttattatttaactgatgtgtgattgccgatattgtatcgcgatggaattgatcgggcgggattcgtaccaagtcagcgatttttgaaaggataaacatattaccttgttcaatgaattttctaatttaaatagtactacagaatgtctttatactacccgatagtttcttccgaataacgcttcttgcgtctatttctgcacatggcttgaatattcgttattatgatacgaaattaactaatccgtataacgcgactgaaaatttgtcaaataaaaattttaagcgatgagcatcgcctgaatattatgagcatctaaatcagggttcttaccgaatcctacgagcaaccagtatagtatttcaaagactttaaggggaatataaaaagcacgaagatgtcgaagaaatttagctctaaaaactcccaaaggtacgtggtggtacacagaccccatgatgatccttcattttatgatacagatgcctctgcgcacgttttggttcctgtctccaatccaaataaaacttctccagaagcagatcttcgaaaaaaagacgtgagttcaacaaaaccaaagggtaggagggctcatgtgggagaagcagctttatatggtattaattttgatgattctgaatacgattatactcaacatttgaagccaataggtctcgaccctgaaaactccatctttatagcatccaaaggcaatgaacagaaggtcgaaaaaaaaaacattgaagatttattcatcgaacctaagtatagacgtgatgaaattgagaaggatgacgcgctacctgtgtttcaaagagggatggcaaagccagaatatttactacaccaacaagataccaccgatgaaattagaggtttcaaacctgatatgaatcctgcattaagagaggtgcttgaagctttagaagatgaagcatatgttgttaatgatgatgttgtggttgaagacatcagcaaaaagacacaacttcaaggcgataactatggagaagaagaaaaggaagatgacattttcgcacaattactagggagcggtgaagcaaaagatgaagacgaattcgaggatgagtttgatgagtgggatattgataatgtagaaaattttgaagatgaaaactacgttaaggaaatggcgcaatttgataacatcgaaaacctggaggacttggaaaatatcgattatcaagctgatgttcgaagatttcaaaaagataactctatactagaaaagcataactcggatgatgaattttctaatgcaggtttagacagtgtaaatccctctgaagaggaagatgtgctgggcgaattgccctctatccaagacaaaagcaagacggggaagaagaaaagaaagagccgtcaaaaaaagggtgccatgtcagatgtatctggattttccatgagttcaagtgccattgcgcgtacagagacgatgacagtactggatgatcagtacgatcaaatcatcaatggttacgaaaattatgaggaagaactagaagaggacgaagaacaaaattaccaaccatttgacatgtcagcagaaagatctgattttgagtcaatgcttgatgactttttggacaattacgaactggagagtggtggccgtaaactggctaagaaagataaagaaattgaaaggctgaaggaagctgctgatgaagtaagcaaaggtaaactgtctcagagaagaaatcgtgaaaggcaagagaaaaagaaacttgagaaggtcaccaatacactaagcagcttaaaattttagaggagtagaatgagatgagaaagcacctacattacaagtactgtgtagacatgtatacttagcctagaatgcattgatgctaaaatacatcctgcccaccgggtaataattatgaaacgcggcggtgctctttgtggatttcggagaaagggggtggaggaaggaggtcgattttcattattcaaatattgttttagtataaagaaaaccggcgtgcattgcttcaaagagccgttcaaattagtaaccgtttgagatatcttgtcttactactcgtattccgcagataaagtacattttaagaaaggaagtaaatacacataaataaatagcaggaagaaaatgtctaacgaaattgaattactgcagaagcaagtctctgaattacaagacttagtgaagaagcaaagtctgattatctctaagacaggagagcgtgtgctggaattgcagttagataaacaaaagcacgacgtaactgattttgattcgaaattctctaaatctatctcgaagaaatcaggatccgctactcaattcgatgccactgattttgccacaaatgaagatctagtggaattagtcaaagaactacagggtgagctaaatttcatcgaggaaaggtctatcagaagacttgttaactctttgaaaaaagatgatgatgacgttatagcgccactgcctaatgcagatggtgatattcctgctatttcagacggagtgttccctaagtcgttgaaagaatttaaagacatcccagacttaaaactggtaagacttgctaaattctacgaaagattgccaccaactctaaaggaacaagaagattttgaaaacttcctggaaggtaaggtggaagcctttcacattaatgagaccactgatgaagagatttctaaggagttggaaaagttctccaaagatgagctagatgatgcatttaatgatgttgcccgctatctaggtctctcccttagaagaggaaccgaaatatggtaaacagaaaatgaaaaaaaatgaaaaatcaatgaataagagggcttgagttccaggttctagaaatttccctcacttatatatatatatatatctatatacatatagttttgagtatatcataacaggattctctttcaatgaaacctatgttttccgcggcattgcagttaaaggatgttctagtggtgaaaaagagaagaaaagaattcaaagttttcctcccataagtatacctatactttttatctgtgattgaaagctgtataccaacagccttctatatattaccttgtataccattcagtagtcttaagcatcatctaacttttgaccaggtccattctgattggctgcggtagcccgctccgttttccgctctaagcgtttggtacttgtataaatgtgcactggcattatgatatcgagatccccgcatagaaatctcaggaccaaccaaaaattgccaatcacaagctctaagaataataaacgatgtctgcaatgatggtcaagttaggactgaataagtcggctctattactgaaaccctccgccttttcaagagcagctgccttgagctcctcgaggaggctgctttttaatacagctagaacaaacttcctttctacctcaccattgaagaatgtggccagtgaaatgaacaccaaagcggcaattgctgaagaacaaatattaaacaagcaaagagcaaagagacctatttctccacatctgaccatttaccagccacaattaacttggtacctgtcttctcttcaccgtatttcgttggtgcttatgggactaggtttctacttgtttactatactcttcggagtctctggtttattaggtcttggattgactaccgaaaaggtttctaattggtaccatcagaagttttccaagattaccgaatggtccatcaagggttcctttgcttacttatttgcaattcactatggtggcgccattagacacttgatctgggataccgctaaggaattgacattgaaaggcgtttacagaactggttacgctctcattggtttcaccgccgttctcggtacttatttattaactttatgattctttaaggcgacgcacctgtttctacacacaaatatatatatagccaattttatatatacgttcctatatatgacccaataccgcacttatttattctttaagatctttataacccaaaatgccgattaacacaaacctatatttactaggggcacattttttatttttttgcctttctgtaaaatacaatagagaaaataaaggaacaaacaagaggaaaaacaggaaaagatagcgcaagagtaatcatattcaacaaaatatcagtgattttttacagatatcaagataatttctttccggatacttattgaagctattatttgttactggcaagaaaaagcaaacataggcggtcatttttcttttgtataaagtaaatacaagaagaattattttcgaggaataactaggtgtgcagagatattaaggaacaaggaaagaagaaagaaaacaattcgaacaaaactttattattctagcactattttaaaaaactgtcttttggcaaaatgtacttcccctttttaggcagattatcgataacagattacattatagtcgtcttggtatacatagaaagcattatttcatcagtccttaaacttataccacaaccaatgattaaccttttcgaatggctaataaatttctcaacgtcctccgatgacaataccatcgaagaaaagttaaggtcagctccaactatccatgaaatgtgtgcaatttttgatatatctgtcgaggatcatttggtaagaactgaagacaattatatcttgacactgcatagaatcccaccgatttctaaaaacagatttaacaataaagtggtatacttacatcacggtcttttgatgtgttctgatgtttggtgttgcaatattgaaagacataaaaacttaccgtttgtattgcatgatttaggttacgacgtctggatgggaaataatagaggtaataaatattcaactgcccacttgaacaaaccaccaaaatcgaacaagttttgggatttttctatcgacgaatttgcgttctttgacattccaaactcaattgaattcatcttagatataacaaaagtggacaaggtcatctgcatcggattctctcaaggctctgctcaaatgtttgctgcattttcgttgagtgaaaaattgaatcgaaaagtctcccattttatagccatagcacccgctatgactccaaaggggttgcacaacagaattgtcgataccttggccaaatcatcgcccggctttatgtatcttttctttggtaggaaaattgtgttaccttcagctgtcatttggcaaagaactttacatccaacacttttcaatttgtgtatcgatatcgcaaacaagatactgttcaattggaagtcgtttaacattctaccgagacaaaagattgcttcttacgcaaaactttattcaacgaccagtgtaaaatccattgttcactggttccaaatattaagatctcagaaatttcaaatgtttgaagagtctgataacatgctaaattccttaactaggccttaccaaattgctaattttcctactagaacaaatatcaagattcccattcttttaatttatggtggcatagattctttagttgatattgatgtgatgaaaaaaaatctacccttcaactccgtctttgatgttaaagttgacaattatgaacacctggatttgatttggggcaaagatgccgataccttggtcattgctaaagtcttgaggtttattgaattttttaaccctggtaatgtttcagtgaagactaaccagttactaccatcagcaagtctggttgaggaattaccaagcacgacatggaagacaactcatccaacgcatggtctcagttatagaactcactcggcagaccgttctccgttgtctgtacaagctgatgaagcggatgaggtccacaatgctgacaattcaaggttcttaagacgagtgttttctactagtgccatagacgaggacaacgaaaatgagcaccaggatgatacagaagatcaaatccataaggagcagcaaagacggttaagtgcctatctggaatcatccaaagatttacgacaactagatgccaactcttcgacaactgcgctggatgctctaaataaagaatgaaaagaatgcgagagaaaccctattaaactattttttgtctaggataataatattagcgctaatctaaaaatcgatgaactaaagaaagaatatacgtacgttttatacacaataaatggatttcataagaagtccttaatatcctcatgcttgtggatactggaaattagtaaagtaattaacttccttttagcattattcttatttggcttaaaaaggtcacgtgaagctctatttttttcgtttttttttttcactgatggaagagaaaaacctctacataataaggtaactttacatattgattgccaatgagatgttaaaaaatggacggttcagacagtaaaatacatttagaaaaaaagagaaggtcttatcagtgtatttattcactgtgcatattagctttttttggactttttttgttccattagtacttttaaaaaacctatttgtaaataaaactaattctagcactattctttgcactagaataacacagggaccatacagcataaattatttggtaacaatgtcctacaataatggcaatacttattcaaagagttatagcagaaataataagagacccttgttcggaaagaggtcgccaaatcctcagtccctagcgagaccaccgccaccaaagagaatacggactgatagtggttaccagtcgaatatggacaatatatcttctcatagggtaaattcaaatgaccaaccaggccacacgaaaagtcgtggtaacaataatttatctcgctataacgatacatcctttcaaacaagttccagatatcaaggttcaagatacaacaataataatacgtcgtatgaaaataggcctaaaagcataaaaagggatgaaacaaaggctgaattcctgtctcatttgccaaaggggcccaaatctgttgagaaatcaagatataataattcatccaatactagtaatgatataaaaaatggctatcatgcttcaaaatactataaccacaaaggccaggaagggcggtctgtcatagctaagaaagttccagtttcggttctaacgcagcaaaggagcacgtcagtttacctaaggataatgcaagtcggagaaggaacatatggtaaagtttacaaggcaaaaaacacgaatacagagaagttagtagcgctgaaaaaattgagattacaaggagagagggaaggctttcccataacctctatacgagagattaaactactacaaagttttgatcatccaaatgtctctactataaaagaaataatggtcgaatctcaaaaaactgtatatatgatatttgaatatgctgacaacgacttaagtggattactattaaataaggaagtccaaatttctcactcacaatgcaaacatctcttcaaacaattgctattaggaatggaatatttacatgataataagattttacaccgtgatgttaaaggctcaaacatcttaatcgataaccaggggaatctaaaaataacagattttggactagcgaggaaaatgaattcgcgagctgattacactaaccgtgtcattacgttgtggtacagaccaccagaactattgttgggaactacaaattatggaacagaagttgacatgtggggttgtggctgcctcctggtggaattattcaataaaactgcaattttccagggctctaatgaattagagcaaatagaatcaattttcaagattatgggaactcctacaataaatagctggccaacgctttacgatatgccgtggttttttatgattatgccacagcaaactaccaagtatgtcaacaatttttctgagaaatttaaaagcgttttaccatcttcaaaatgtctgcaattggcgattaatttgttatgttatgatcagacgaaaaggtttagtgcaaccgaagctttacaaagcgactatttcaaggaagaaccaaagcctgaacctttagttcttgatggattggtaagttgccacgaatatgaagtcaaattggcaagaaaacaaaagcgtcctaacatactatccaccaacacaaacaataagggtaatggtaatagtaataataataataataataataatgacgatgatgataaataaggatatatagccaattgaaataagtagacacaaaaaatagattaataacttatttattacgcgatacccgtaaatatgatacgaacatctaatttcatgtgaagcggcctagtgaatagaaggtttgcctattttcactcgttcactatacgtaacttggttgtctttttatgcaagctgtttgtccatcgtaccaacaccatctcatttcacatcttataaattagcctggccactaactgtcttacctcttatgccttattgcgtttttccaagcatctgctccatataataaatgtaactacctatcaaccaacttccatgtaccttacccaattggcctaccaagttttcgttacattgtttcgacatgatatctagttgttttgtcgtttcctgtaaattcgtttgaagctctctaagttcgtgtgcaagctgattatactgcctttgtttgttagcgttcattctcttgcctgaaattctttgtgtcctcttcgttttgaagttcaaatgttctgatatgttctatttcgccatttatcttgttgatctttcttcccacctttacaaaaaaataacgttgatttcaatgggcatgatataatatgagcaatacaaaacatcaaagccttcttaggagtgttactttcaaacatggatctataaacaagttattcaatgattaaactatatacagatgaaatttttatatcaataaaacgatcttttacgtatcattcaaaagaattttggggcctttctaatggaaatcttcgtccacttgggcaccttatgaatacccttcctataaccaacagcttttttatcaaaagtccaatatttatctttagaagacatttgattctcctttggaaagactgatggtttgtttaacaaccttaacgatttacttcttggcttgtatttctttttgctctccatggcttcttgataagtaagacctttatcctgacatctttggacgtggagacctaaagttaattgctttatgacttgatcaacgtttcttaatctttccctttgacgggttttttgatgtgtggacattctccatggaattttccatagtaggccaccagcgacggggcttgttaatttgaatgggccaaacattggagtcttataacttgggtagccttttaaatacgtctccttcctacaaagtacggatatcttttttccctctttggcttccctttgtccttttgttataccgttctcttgaactttttgaatgctcttgtacttctccgattataaagttgaaaacggagtgccctgtatttatacctatgatagtttaggaagatttaaccataattaaagccagagatacaaaagtcgaatatcttcaagttatctggaacaactttcatatatttgataagatggagcaaaacaaagaatccgcagaatgatctcgaaacatagttctaggctacctatatgggtgctaagtcctcgcgaagaacaacaggctcgcaagaacttgaagacggaaacatacaaaaaatgtgcaaattttgttcaagcaatggcagattgtgctaaggcaaatggaatgaaagtttttcccacttgtgataagcaacgagatgaaatgaaatcgtgcctcctgttttatcaaacagatgagaaatatttagatggtgaaagggataaaattgttttagaaaaaatcaacaagcttgaaaagttatgtcaaaaacaaagctctacaaaataagctgtgttgattgatgtttttgatttacatcttttaaggattttttgatatatccattcttgtacataaattatatacacacagcccaacaataaaaaggaaaaattaatacgaagggtatatatgtatggtataatacttaagttcactacaacggacgtttatagtcagaataaatcgaggagatcctgtgacactatattgccgcccgaaacatcgggattgtttttaccaccagaagatataccgtttgagtcgccacctagtttcagctccttcaacccttgtacagccttggtatcatttgtatttatttgtgtggcatcctcagatggtccgaaatcaaataaatcatccaaatcgcctaaagttgttaaagtattcagcattcctgcatttgtatttgttacatcatctctttcatcaaaatccaatagcacatcatcgttagccttgctagaaatttcattttttgccatgctttctaattcctctatatgttttcctttaactatattttgaacatactttttgccttttctcctatttgagtcgggcttgaaataaatggaacttatagtacccaattccattaatagtttctctagcacttctggtgaaaacttctccagtgtattggagatcattggaagtttattttgacatagatcattaaccaaactttcattatttggcatcgaaaggcatctccaatacatcatagccatatctcgcacatctaattcatgtgtctgttgtgtggccaattctaggacgctttgtagcatactacccgttaaagtagcatgtagtctgactattgtcattagtaaagacatctgtgttaaagcttcctcttgaacaaagttctctataaaaatattgatttttgactccaaatctgagaaattgttgggatgctgtcctagcaaccagacatagttgcacttcgcaatatctgattgtaataacacctctggatttgaccaagtattaaatactgcacaaacttgtttggccatcttatcgtttccggggcaatgtcttaataaatcacataatgatatacagcagtcgtcttttattgtgtcttgtctttctaacaattctaggagaatatccaagactttactgacgaatgattcttgtgcatatttaatacccaactgggacaaagcttgaatagctcttgaaacaaactcaggttcatattccattgcgtattcctttaattctgtcaacaacaaagtacattgtttcaagttggaaggatcgactagtcttacaaggatatcgatcttctctaacttgacgtaaagaggatcgttgaacttgacataaaatattctcaattctttggttaacagctctggatatttctccaatatgatcctaatatttttcaaagcaacatattgcatttcaggcggcgtagacatcagtgatacaaaagcagatgataatcttttcattatcagactgttcgaggaatattcaatttgaggcaagttccttacgattacctttattgtagctaaaacaacggctggattaacgtgttgtaaatgcgcagttactcgatcaatgatatcttgtgcctctaaagaatcttttgccgaatattccgaaagagttcctagtatgataattctagcccattccgtacattcgttcaaagctaataagaattgtgaaacgtgggactggatcaaacttgaaagatcaacggcatccatatccatattgtgaatttcaattaatgctgctgttgcgtttgcaatgactaaaggatttgagtcatctagggcattgaccaaatcttcgacgacacccaactcaacgcataaatccttgtttaattggaaaagttttgcgacacatatcactgcggtttttctaacatatgcattatcatcatgcaaggtacggcggagtggtgtttcaatgtattccaggattttgtcaactcttatcattgacatcgttctgattgccatgcagcgaattaagggatttggatcttgtgcatcagtaatgaatgtgttaacggcaagaatacataattcgggatgcgtctcagcataattcatcacataaagataaaccagttttttttgttcaacgtcaattgtggcaatgtttttcaagacgtctgggaacagcgaagagacatcttttcccaacgtcatttgctggatcgttttctttattgcatctttccgagtctgtgggtattgagatactaatccagttcttaattcacttagttcacccttaccggatatttttggcgcaattctaatggagtcttttagaaacttcttgattcttttatccaatggtggcatagttgaaactgttttttaagtgcagtgggaagctgagcaaaaaaaaaaactaagctgcaggaagtgagttcgtacccagataattggtgtattatgacaataaagctacaacagataacgcttagtcattgggaaagtgttctttatatcgtaggctttcttcactgaaaagagctctttctgatattactacaagatttgaaactcataatatcattctgtacgcgaaaacagtagatgtgacaataagacatgaagtatataaaagaataacaataattatgctctgtttgtaaagcgttaattaacatatgcatgttcgtttttcaggcaatatgatcgatggttttcagacccttttaaataatgggtcttagtatttataagattatgcaatttttttttcttggtgaaaagaattcttcagctatgaataaacgtcgttggcaaataatggcctcgattaagcacctactctgttctctaagacttgtgagactgtgctataaattccatcgcatcgctaccgcctttctctagcatggggcattctaaaacatcagcgatacatttccaagggtcttttagccctccccattttagtaaatgctttttaaatttatcaccattttttcgactgtacggatcatcctcgaaaagggcgtaccagattttagaagctatcgtcctatcaaaataagtagctgtaataagttgccccgatccaaataaatggccgaatcttccacaccaattactctgatcgtccactaggacctttaaacgtcgttctagtgcttgatagttttccacaacgtcaaagttatcaatatcagaaatgattttttcatcatgaaatgattgatccagcatagccatctttgcttgagagtatgtttcacaattttgaaggaagttagtgcttttcatgaagcgctgtaacatatcagcctgaattgtttctccagtcccgtaatgtttgccaatctttgtcagaattcgtatatccttagcgaagtgctccatcaggatacttggtaactctacaaaatcagtagcacatcttgtaccacttatgttttgcatatgagttctccctaacattgagtgcattgcatgtcccatttcatggaagagcgtttcaacttcactaagctgcaaaaaacaaagactttttttagaagcgattagtattggagaaaaattacacaccaaagaaataacaggtaattgaaagtaggtaccgtctggattctcaccgacttggatggttgagaaatcagtttcactgggatatatttgcctagagcaacaaactgtgaaatgagccggatttgaagtcttgccatttcgttcgaataaatcacaataaattatgccgatgattccttcctcttcagatatcacattcaatcttctcacgtctggggaccatgtttctccctcatcagtaattgctggctctaatctaataccatatatttgctgaaacaaatctgacaagccctgaatgacatttcctaatgtaaaataatagcttatttctttggcattgggagagtttgacgggttgagctggaaatatttgccagtatagtaatccctatcccatggtctcacgagcttcaatatttcgtccgtgtttgtagtcaacggcttcttaagatctttggccttgagttcagctataaatttcaattcatttgctgtcttctctatagtattgttcattaacgtcaaaataaaatcttgacatcttcgatcttgccatttaccttccaattgatactctgcgtaacttgttttgtgcattaaattagccaagattgcccttagtttgattaagtgactcaatcttttaacctgtttgtcagaacaactgtgaagagcggtccacaacttttttcttaccatctcattttcacaactttttaataatgcataagctgcatacccaaatgtaggtactttataattttgcccttttacatctttatttaattgcttcaatagaaatgtactcactttactattatccagatctttacatggtatcttcacagaatttgaaccaggatagtctgtatggttgatgaattcttgacctactaaactgatttcctgagataactggataaacttttctctaacatctggattcatatagattcctgacttttcaaaatcatccaataatattttaccaactttaagttcttctgcgcttaacttcgaagacacttctggattgtttaaaaccgactttagtatgttacataaggaaacatcagtgttcaagacattcatgaattcaaacatttgttcatggcaatcttgtgctgccctaacaaatgcatcatctggatgtgttgacctaataaactcgcacaaatcaataactcgacatagcgtatcgcttaatctgtccaggttcataatataggttaatttaccactctcgctaaaatcattcctcattttgtcgagaagttcttgtgcttgctgcaaagaaacctggctaaacttacgcaaaccatctggagaagtcaaataagggttcttgaaaagtccggttttattttttttaaaaagatattgtgagatcttgctattattagcatcctgaccattaatatttctccaatatgaattgtcgtcgaaaatcttcttaatgcttcctggactggtcctagagactgcgccggctgtggcgaagaacctgagtaacttattttggcgggaaggtgacggtatggaggcattggacccggctttcaatattatcgtgcgaagcattactgatattactttcggcgccttcacttaatgttctgatacctattcccttacacatttagtctttgcaagtaaattcatcatttgttttgattttgacgctatatatgtatttttctcacttttgttcatgaggcggtgacgtaaaattcgccatatccaatgaggaatcgacatctttcggcatttcaacatattgatgaaaatttagaagaatatatatacaaatgtaagatttatataggcgtaccatcaacctttttaagttcacgttgagcttcctcaatgagttcattaaatctaatcatctctgaaatacgaatagcctttttaagttccttcttagatgccctcaagcgtcccttatgcaaatttatcacaccaataccgtagtgagcaagggataatgccttaagtattctctgatccatttcgctttccattgcaacttttggatattgattttcattggcaaagctgataatacttttatagcagtcagccgagtactgtaagcaggaattctggttttcttgtaacctggaccgaataagttctaaaggttctgattttttgtacggttcattatcaatagcgtatagacttccttcgaacttctctgaatttagataaaaaatcgacccgagctctgcctgggcaagcaagatgtcgtccagaggactatccgctagtaacatccattctagtgttgttattttgctattcaaggccccagaaagattactccgattgagacagtaacgagtatataaatctcttgcagtcagaagttctttcatgaaaacgcattgttcgctttcaggttcctttatcttcaactcctgttttcttttagagtttaaatgcatttggatgtcaggtttggatttaccaataaatggtagacccttgaaattcttccagtcaagctgttggttgtttaaaagttctgatttggaaagaacatttttgaactccggtgagttctccaaaaattctcgttgagctaataaaaggtgcattatcaataacgttgcattagtttcagagtctttatttatttcattgaaccttaccaaaatttgaaggtctcttttcaacaaaaagaattttctcttcgttgacttatcagtagttttgcttagttcattatagaactttttcagcatgtctccatataaagctgtagcatcattatacatatgtaatttctcatacatttctccgattttgatttcaataccggtatattcatccgaaagtagatccacgttttcggctttacattcttctaaagcttcgaggtagtactcaaggcttttttggtagttcgcaccttctttcttaatttctgaatgtaaccccttccttaatattttagcaacgggtttgggaaaagtatgatgtggccaataaacccaccatatgttaaaagcgatgaaacttacgatgcctgtcgataacacccatttctgtaatttgctccttcttttgaatggtattctccaaaaactttgttcctttaatgtagaataaaacttgaaacggtgattggtaaataagttgaggttagtgagccgttctacggtcccttcatttttgactgatctatgaaggtatttccacatactaaatgagcataaatttcttcattacaatatctttataatgctgtttttacgttctcactttgtgcccttttatatatcctaaaggatttagttcaattttagaaattttcgtgcggctgagtatccgcaaatcgttctttgtttggtatgtattactagtcaaggattatttaatggtatttgttacgagaaccaaattacacacaaatctcctcaatcgttttctcatcaagataaatatgagagaatcaatttataaggtaattgttttatctatatcaggtacaaagtatcaaaatgtggtcggaaaaactttataagtaatgaatcactaataactcttgaaaagctggaatgtaatgccatagtttaaagtaaaagtaaagttacatgccgttataaaagaaggaaaatatgatatatccccggatgcccttggcagactggtcctctatcaatatcggtaattgcattgtaggatatgatcatatatctaaaaactatactggcaagtgacagttgtgtaagcgcaatagctctttgcagatatacagtgatccacatacgataacaggaacaatcgtctttaacccacttgtttcaaggaaggtccagacactttgaagatccggctgcatgttaacatttctcgtataccggtttttgataaatgcgagaagattcaccggttctagggattggatccacggcattccaaccactgacccaaatctagtcacaataacataatcttgtggacgtattagcggatcaagtaagggagacacctttttcccagttgttatagcaatgacaaatgttaatggcgtatcaccgtacgtggtccttaaatggcaggctaaatttcgagctgccttcgcattatttgcgttgtctaatagtaatgcgattttctttccactagtagattcataacagtaatccaagcgatgtaaacttcttggccaatccacagatattaaaccttgggatagttgatcctttgaaatacaaacctttttttccttgctcaaaaagtctaaaaccgctatcgcaactctcaaattaaatatttgatattcttcttcactgtatggcaggcgaacttcaagagtgccccatgtgtctgtgtgtacattgtaatccctaagagaagggtcggtgatttctaatggacatccaacatcatggcaccgtttcgttatcgtatttcgtacaaattcgtcattagaaccgtctaatagaaaaattgctttatttgtggaactttcagtaatttgagacaaaaacttgcataaaaaagcttcatcgctaatgcccacgttagtaatggcgcaacagactctactttgaccagcaattatacttccagggtcctgttttccagctaaaccagtttctattatgcaccattggcaatttttcttagcgaagtatacgagagctacgcttgttagcagttcgaggttgttgcactgtaatttcaaagaactatctgcttctataagttccttctcgatcctagaatactctatcaaggaaatggcttcattattaatgctaatatcctcttctttggcgtttagcaaggaagatgtagtatacctaccaatcaagaccctttgccgctgttgccccggatgctgcaatatggatgtcaaaaatttagatactgtctccttaccatttgttcccgctatatgtaggattgacaaactatcttggggatttcccacgtgctccaacaaacggtttattcgaggtaaagtttgccttccgcttatatcatccatctgcttcttatgtaatctgttgccggccaaacgagcaatattattctatatcaaaatcgtcaggaaactggtcgacttgactcaagtttcattaagacaagaatataaatttaaaaaatcattattgacctaaattggggtccctcccacatcagaggaggcttcattttaggctatagttcctcatattttttttccttggcacacctgccattctcctttgcatacctattgtatcaaaaagtgagaaaaaaacagcgcggtttgagatgctgaaaatgagtacgccagaataagagccgatcatcagtgttttgaaagcttactttctgtgctatgtgatgaggctattcatgtatatatatatgttctattaactagtggtacttatttgctctttttgagctaaaaactgaaggcctcagtttttcaatttaccaaatttgtcatgccatttagtagcgacaacatcaaattcttcgtccaaggcgctcagcttaccatctaaaatggagtgccacgcagctgacaaggtctgaaattcttcttcggagttgacaggaagaatctcctgcaagaagatattatcagtttctccgatattcgttccgtcctcatctgcgcatttaatggcaaattgaacaacttctaaatctagcaggttgctgcctatacgcaaagactcaatcatccattgagaaaatttcacgaaatgattgtaggtatcgtcaatggctaatatggactctgctgttagcgttaggtcctcgttcaaagttttagataaaatttccttttgtaatgactgcgttagataatagttcagtaagtcaaacgtttcaacacatttaacaaacattgaagctattggtaaaattaccttgtcaaacgaatccgcctctgggtctaattcgtttttaccttcattgataaactctgatgcattatagcttaacacacaatcgttgtaaaatctcaatttcttaacaaatttaatcaaagtagttctctcgaatcgtagcgtagctacccttcgcaaatgactgatgaacttgttcagcacgtgaatataagatgagagataccgggagagtaaggcgagtatttgttcaactaattcacaagttccaggagtgactttgatatctttgtctttgctcatttttaagtgtctggtattatgcaaaaggaaaattaaggagggtttactgtgctttctctttttttgagaaaaatgtcttgagtaaagtgaggattttactgtcaaatctttaaagcttgttttgaacgatgtcctgcattaaagtgggagtttttcaaaacgggaaaatacaaacaaaaaatgaaaaaaaaaaaaaaaaagggactttaactttctgcgagagtatgtttaaaagtatatgtaatgcacttttggtatgttaagaggcatgcacgaagaaccattctataagagactaaacatctatatattcatgttaattaccagtcatcatcatcatcgccatcgtcattatcatcatcgtcagcactttccgcccgcattttgtttgctcttgctgccaatgcagaagctaaaccgtcgctaaacgtccccaccggattactctgattatcactagtgggtccaactgttgcacttccaaactgtacaccttcttgtgcacttgaaatggtattgtcgatttggcttgatttctgatttgtaacgtcattcactgcccctgtcgctgcaacaggcaccgtatttcttgtgtctttataaggagtcatataagcagtaggaacccaaccttctttgcttccatcgagaagctttgctaaagaccaaccactaggttcatctctgcttataaatacaatatcgcccttttttaatggcaactccgaagatgatccggaacctggaaagtcgtatgcagcttcgaatttcggatcctttggttggcccatggggggagggggtggtggtattggtatgtttgcagttgcagttgcagttgtctcctttaacggttctttatttttttcaaccccttttgaaggtggcatcgatacctggttttgcttggcggatgaggatttgtggcttgaggaggctttctttactgcgactttttccttcgatgagggttttgagctgtgtttcgagcttacttttgcagcagggattgcagatgactttattggtacggtcttatccggtttaggattgtatgctgcctgtgcagcggtagctcgcaaagataacggattcacaggtttttgcgaagggagaggttgcttttttgcagcatccctatgacttctatggctatgtgtatgcttatgagtagatttgtgtttactctttttgcttttgataggtttcccgctcaacccacctggattcttaggttttttattcgatttggagttagcagggtgtccacgacgcacgtatattgtacttgacttgtagatgtcaccgtatttcggtgctgaatcgcttatctttgagcggacagtgtgcaacttgtttggttgtttgtgatactcaatcgtgggaccaacttttatcattatcttttcatttaattttttcaaacgtgtcattaattccgtcttgaaaggcgtgttaatgagtggatcggattgtgtactattaacaaggataacgcccatccaatcgtcttggaggtttgttaagctcacttgtttaattttaccgacatcaattttataatcttgtgtatatttcatagcattctgttcccgtgtttgtccaataatataaaatgtcttttttgttaagataaacacttttttcaatctttgagctgatctgccaaatttagagtgcaggcattccccctttatcgaaaaaacaactttatccttaattcctacctgtcttctgatgtacgatcctttcgttttagactcattgcaggataagtaatcacccataaaagccctgtatccaagtaaagacatggatcttctctcttttttacccgctaaaagtttggttccataatcacgaagcttgacgtacttgtttccaccctttttctctctgatagtacgctgaatttttatcgcagcatcaatacgcctttgaagaaaccttctccatgctctctggattctagcagccatgttgtaccagtatttatcacgcatgtcttctagagcaaatagagattctggagttttaatgaatacgcttgtcactccaagttgaaattctttttctggtatcatggcatctcttaaaataagcttgactgcctcaagggtgtccccatcccaagtgtaatcaccagcatatgaacaatctggagatagtaaataaaatctttcgacgaatttttcgaaagtttgtctgtaagcgaaaccggctctcctgatacgaacattttcttgcaaacccaaatattttacttgatgtagcacttggtgatcatcataatcatttggtgatttagtttgattaggcttgattgttctgatataggaaggctcagcttttgacaaagtttccaccagttcatttgcacttttaataattttgtcacctgctgttggaggccgtctctttgaatctttgtcaacatcatcaggaaaaattgtggaaaggaatgtatttgtcgttgttccaattaattcaattaggtccttttgaagttggtctttatttttatcggtgataccattgatgtcataggtgacatctccagcgtaatgtttaataacaaatttgttggcccttaattcgaagtatggatttgaattaaataagttaagtcgttgagcaaacgcctggtcagcggcattggagtctgcatgagcagttgcaatagagtcattcattgcagcaagaatgcccggtggatttttcgcctcgattaaatcacagacaactttattgtcaaagtatttgatgggggtccatttgattttttctctttcataagtttcttgctcagccttcaaagtcaattggataaaaatctgttgtaacttttcattaacataattgatacatatttgctcaaaagagttgtgttcaaaaatttcgaagccgtaaatgtctagaatcccaattgatttatcagcaccaggaaatgcctgcaaagatacgttaaccctatcgacaatccagtcgaataaattattataaattgccttagcaagggcgtctctcaccgcagttgcttggactgggttcaaaggtacatgataaactgagcctctcttcattccatgactggtttgcatgattctttccactaaacattttaccagtaacgaagcatcaacctgcaacaaataagcgacaaaatcagtcactgaggtatctcctacctgagcattgccctcttcattttctataaaggaaatgttaccaatccacagaattgccgccagcatcctaaaaatttggtcttgttcttcctggactaaaccaatggttctcatagcctctaacgtgccttcgtaatctttacgcatcaattgatctgcagatgtacagccagccgcagcagtgtaaatatattgctcaggcatttgcacaccgaacatctgtttatatgtatcagatgctcccttagtgaattggtaaaaaatatgaaagtttctttcgttcttaatttgaccaacaactctttgtttctctagcaaataatttgtgatattacctgcgcaaggttcaaattgtgagttgaatttaatttctagatacttcccgtgccttgaagaattgttgttccgcagagttttagcacaaccgaatgactcgagaagtggattagtagcaagaaccatatctttgatcttcccaatcgattctgaatggctattagatgcagctgcaatatattgcataatacgtttggctgcttctgtcttaccggcaccagactcaccagaaataataacacactgattttcattgtatgatttgagattgtagtacatagattccgcaatagcaaacacgtgtggtggaacttcaagtctattttttcctttatatgactctaaaacggcatttgtatatattcccaaatcgcggaacggatttacactaattaacacatggccaatataggtataaataattccattcttaaatctttttttcaaattttcattgatagattcatcagatatttttgacaaaagtgtcaaatcagaaatacctacttctttctttttatttgcatcaaatgtagcctttttgatttttgcagatctcttcttgggctccttaacgtcctttctgcgtgctcccttttttatgacagccattgacggttataagtatttctctttactttttttgattcaaatgtgatcagcaaattaatgttttataactggattgttgttaatttgctcgcggtcaattgaatcgagattgctttaaccctttataatagattactctatatttacttgtcacagcaaacggtttcctttttcggtaaagctcttcccgaggtttattatataaatgcaaatcgatcaaagtgaaaggttcaaccatttctcaaagtgcttaacacattatttgaaaagaaagggttttattccatccactctattatatctataaaaaattatttaaattacccacatatttgaaagtcccgaatgggcgctgtgggaaaattcagagcctgccgcgatcggccgtgttgactggtacttccacgacgacagcgacgactttacctgtgtccaggttataaattggaggatgctgtaagtttctcaagacactttgaatgacacctgagtgacaagtaagcgagatgaatttttcttcgcttgacaattgattaaatagttcaaataatccattcagtgtacgtttgtccatttcagcacacgtttctctatgatcaggaagccacaattcatcatcttctgggtaatctggtacatattgccaatgtacagtgtggcccgattccgtgctgaaatcctggtattcgtcaactgccattgagtgagccactcttttgtcacaagtgtgagagcccaacgtctcccttagaccttctataatgcgtgtagaaattttagttccggccggtaattcttgcgtctccgctaacactggtgtccacgactcaatgaatgtttcgagacatcttctcattggagaactgaaaaacacatgaggtagcatacctaattgctttgccattggtagcaagacattcgatcctgttcttctaacttgatctttacccagaggtgtcagtttagagtcaagccactctccatgttcatcgcccgaaagcaacgaccaataggcgtcccatttctccataccgtacctcagtatggcagcattgtggtaaccttgaccatgcctagctaaaatcaacagcttatagtggcgatttttggtatttctagggatagcatgatacagttccttccaattcttatggttaatcaattctaagtgatcatatttcgtggagtctaatccttgaaaaccctcacttggatatgcagcaaaatatcctgggactgctctgagtgacattgttgaataactgttggtgatttcacgcagcagagtcttggaaagaaatcgttaaataacatacaaatctctcgagggtttttttttgcaaatgacactttttactttttccagtactagctagcacccgaaaaattaacttgactcgcacatgcctgctgggtcatatccgaatctgcaagaaattaggattacaaatatttattcaaacgttgcacaaccacgcaatagaagataatatctgtaaattttaatcgctttcatctgaaaacactgagcctcttcttaattttcacggactttttcgcagcccaggtttgaccggctaagtacgaacctcttttgtttggaataagagtttggtattaatcaattgttggtacaaaagattaatagtattacttgtgttttcagaatataattgtccgtgagcgtcctaactgtcatcgagtttataggaagctaattagtaaggactgaccatgcaaacccagcaatgaatgaaaggatataaacgagggaagaaatggtagcagtattaagtaaaattgtccatttcccctcgtgaaattatccaaaacgcggcagaagaacttttaagttatctactgtacatagtgttattgtcctcacgtgaattgaattgaaactttttcagaacattatcgctgaactataaatgaaattttgtaatgattgttctgatcccatcttactaaaagcattattgtgaagtataaaatacaataaatttcttctcaaaaaaacttgccgtacatgatatggagaaataggtgaatttagggatagtagttattataatgagcctattatagagaatctattatcgatttctaacggtcgtatcaatctgttgtattacgggctcgagtaataccggagtgtcttgacaatcctaatataaacagtcttagggaagtaaccagttgtcaaaacagtttatcagattaattcacggaatgttacttatcttatatattatataaaatatgaatcatactaagtggtggaagcgcggaatctcggatctaaactaattgttcaggcatttatactttgggtagttcagctagggaaggtcgggttttgtctcatgttgttcgttttgttataaggttgtttcatatgtgttttatgaacgttcagggtgacgtattgtcatactgacatatctcattttgagatacaacacaatcacgtttaaaagccttgttggcgcaatcggtagcgcgtatgactcttaatcataaggttaggggttcgagccccctacagggctttctttttaaaacaggatgctaaagccgacaccgttcaaacacaagtggcagcttttctcgagaacagcaatgcccacagttttatttacaattttacactattgacgtggagatttttttatcccgcatatgacctagtagaggatctctgtcttcccctgataaatgtcaaatgtatgacgttaccacaattgtatcacggtggtttcagtctgtcatgaggaataagggcattcagtaccgacaatgctatacttgtaaatagaaaaatgatgttctaaaatcggcattctcgctatttgagattttgtctttttttacctggtatttcgcgtttatattacggatgcaagaaaaggagaagggcgcatcacatcgattttggtctacctataaacattctctctctcatccactttcggttcaatagtgcaaaaataggtaactaacaactcaattgaatagtaaatgtcacttctaatagattctgtaccaacagttgcttataaggaccaaaaaccgggtacttcaggtttacgtaagaagaccaaggttttcatggatgagcctcattatactgagaacttcattcaagcaacaatgcaatctatccctaatggctcagagggaaccactttagttgttggaggagatggtcgtttctacaacgatgttatcatgaacaagattgccgcagtaggtgctgcaaacggtgtcagaaagttagtcattggtcaaggcggtttactttcaacaccagctgcttctcatataattagaacatacgaggaaaagtgtaccggtggtggtatcatattaactgcctcacacaacccaggcggtccagagaatgatttaggtatcaagtataatttacctaatggtgggccagctccagagagtgtcactaacgctatctgggaagcgtctaaaaaattaactcactataaaattataaagaacttccccaagttgaatttgaacaagcttggtaaaaaccaaaaatatggcccattgttagtggacataattgatcctgccaaagcatacgttcaatttctgaaggaaatttttgattttgacttaattaaaagcttcttagcgaaacagcgcaaagacaaagggtggaagttgttgtttgactccttaaatggtattacaggaccatatggtaaggctatatttgttgatgaatttggtttaccggcagaggaagttcttcaaaattggcaccctttacctgatttcggcggtttacatcccgatccgaatctaacctatgcacgaactcttgttgacagggttgaccgcgaaaaaattgcctttggagcagcctccgatggtgatggtgataggaatatgatttacggttatggccctgctttcgtttcgccaggtgattctgttgccattattgccgaatatgcacccgaaattccatacttcgccaaacaaggtatttatggcttggcacgttcatttcctacatcctcagccattgatcgtgttgcagcaaaaaagggattaagatgttacgaagttccaaccggctggaaattcttctgtgccttatttgatgctaaaaagctatcaatctgtggtgaagaatccttcggtacaggttccaatcatatcagagaaaaggacggtctatgggccattattgcttggttaaatatcttggctatctaccataggcgtaaccctgaaaaggaagcttcgatcaaaactattcaggacgaattttggaacgagtatggccgtactttcttcacaagatacgattacgaacatatcgaatgcgagcaggccgaaaaagttgtagctcttttgagtgaatttgtatcaaggccaaacgtttgtggctcccacttcccagctgatgagtctttaaccgttatcgattgtggtgatttttcgtatagagatctagatggctccatctctgaaaatcaaggccttttcgtaaagttttcgaatgggactaaatttgttttgaggttatccggcacaggcagttctggtgcaacaataagattatacgtagaaaagtatactgataaaaaggagaactatggccaaacagctgacgtcttcttgaaacccgtcatcaactccattgtaaaattcttaagatttaaagaaattttaggaacagacgaaccaacagtccgcacatagaattattggtcttgaacaagcactaattttccaaagatgttttaactgatcttaatttatatgtagaggatatatgtagtatatctattttttgctgattgacttatcaattagcttcataatacaacattgtttttgtttttcgttactcgcgactttcttcgcggcagagccgcgctacaggaaaacaagatcaaaacatgcccctattggaaggcttaaaaaatgcttatcccgaacgagccaacggtaatcaacactatcgtcataccaacaacagttgagttatttttcgctcccatactttttagaattggtttgtttgtgtttggttaaatttcaaagcctttatattctttgatatagattactctacaatttctttgtatacagcgggaaattgacacttcaaagttcctctcatatcaacaaacattaatacagttcctgaaaatgtattcttggaagtcaaagtttaagtttggaaaatctaaagaagaaaaagaagccaaacatagtgggttttttcactcctctaaaaaggaagaacagcagaataatcaagcaactgcgggggaacatgatgcttcaattactcgttcatctttagacaggaagggcacgataaatccatcaaattcatcagtggtcccggttcgtgtttcatacgatgcatcctcatcgacctctactgtacgagattcaaatggtggtaattcagaaaacacgaactcatctcaaaatttagatgaaacagcaaatattggttctacagggacacccaatgatgccacctcaagttcaggaatgatgactatcaaagtatataatggtgatgactttattttaccttttccgattacctcaagcgagcaaatattgaataaactattggcctcgggtgttccaccgccacataaggagattagtaaagaagtagatgctttaattgcacaactgtcccgtgttcaaataaagaaccaaggtccagctgatgaagatttgatctctagcgagtcagcagcaaagttcatcccatctactatcatgttaccagggtcttcgaccttaaatcccttactatatttcaccattgaatttgataatacagttgcaactattgaagcagagtatggtacgatcgctaaacctggtttcaataagatatctacctttgatgtgacaaggaaattaccttatttaaagattgatgtatttgcaagaattccgtccattcttttgccctcgaagacatggcaacaggagatgggtttgcaagacgagaagctacagaccatttttgataaaataaattccaatcaagatatacatttagattctttccatttgcccatcaacttaagttttgactctgcagctagtattagactatataatcaccactggatcacattggataatggcttgggtaagatcaatattagtattgattataaaccttccagaaataaacctttgtccatcgatgatttcgatcttttgaaagttatcggtaagggttcgtttggtaaagtgatgcaagtcagaaagaaagatacacaaaaagtatacgctttgaaggcaatcagaaaatcatacattgtctctaaatccgaagtcacgcatactttggcagaaagaaccgttctagcacgtgttgattgtccatttattgtacctttgaagttttctttccaatcaccggaaaaattatactttgttttagcgtttatcaatggtggtgagttgttttatcatctacaaaaggaaggaaggtttgatttatcacgtgccagattttataccgcagaattgttatgtgcgctagacaacttgcataaactagatgttgtctatcgtgatttgaaaccagagaatattttattggattatcaaggccacattgccctttgtgatttcgggctatgcaaattgaatatgaaggatgatgataagacagatactttttgtgggaccccagaatacttggcaccagaactattgctaggtttaggctatacaaaggcagtagattggtggacattgggagtcttgttatacgagatgctcacaggtcttcctccttattatgatgaagatgttccaaaaatgtataagaagattctacaggagccactagttttcccagatggatttgatagagatgcaaaggatctattgattggattattgagccgtgatccgacaagaagattgggctacaatggtgccgacgaaattcggaaccatccttttttcagccaattatcatggaagcgcctgttgatgaagggttatattccaccatataaaccagctgttagtaattccatggatactagtaatttcgatgaggaattcactagggagaagccaattgatagtgtggtagatgaatacttgagtgaaagtgttcaaaagcaatttggtggctggacatacgttggaaatgaacagctaggtagctcaatggtgcaaggtagaagcattagatagacttagtgaatacattatcaactagtttactcatgacatactttatataaaaagaaaggttttcttttccgttacttactgtgttcaagatgaagcaactgtaccaatggcgcaatttaagttctaggatttatatttcgaacgtgggcaatacttcacacatgtgtggcttgtgtctcatggtcatagcgtattgcctcagcttattctgattagataaaggatttcctctcttacccttccgagatccgtgtcgatggggcggcagaaaataaaaaaaaaaaaaggtgttgaaaattttctccttgtataaaagatattttgatgagcatctctcgtttgcagtagcttctccttttaaaaatataaaggttgttttaatcagcgttcgactttaaattaacccaagaccccattgttaaaattcttaccttaaccacgaacggatacattgtctggtaaagaaataacttttgtgcaagacaacagctgacaagatgatggcttttgagaatacaagtaaacgaccaccccaggactttgtagctcctatagatcaaaaaaaaaggaaggtccagttttccgatagtactggcctggtaacccttcaaccagaggagataaaagatgaagtgttttcagcggccatgtatagcaggttcgtgaaatctgccctagatgatctggataagaatgattcaacccagatcggcataattgccaatcaagtagcgcttccgagcaagaatcctgaaagaattaatgataagaatctcaatattcttttggatatcttatctagtaatatcaacaggatagaatcctccaggggaactttcctcatacaatctatcataaactttgagaagtggtgggaattgcctccacacactctaagtaaatatatatatttcatcaaaatcctttgctcgagtatacccaaatggtggcaagacgtttcgatgatactggtatcttgttttattttaccaatcaaacagacagtgtgtcatcatgatatgcttaaatatttcttaaggatgattccctcctcgatgggattcatagatacatatttggccaaatttttcccaaataaaaatgatactcggagaaagttggttaattacacttcaaatttgctgaaattgagaggctactgctctgagctaggattccaaatttggtccttactgatagaaaagattatttcgattgatgtcgagttacaaaatgaattagatgaattagatgatgatgtagatgacgatgatctagaggaagttgatctagaggatgacgacgatttagatgatgattcaggagacgatgatgatgaaaattgtgggaacagtaatgaagagttaaggtctggagcagccgacggtagtcaaagtgatagtgaagatatggacatcattgaaggtatggacggtactgaagaatataatgtggagttgacgcagggaatcaaagaactttccaccaaattggactctatcttaactttggtaagcacgcatgtggaagagcaagtgacgccggagagtttagaaagcggtgaaggcgtaggagtcttcaacactctaacaacattatttaaaacgcatgttctacccacgtactataccaggtcgattcaatatatcatgttccatgtttcacaacaacaattagaactaatggattcatttttagtgacactgatagatatttcgtttgccgtcaacgaagcagcagagaagaaaattaagtcattacaatatttggggtcgtacattgcgagggccaagaaactatccagaactcaaattattttcgttgcaagctatttaacgtcctggttgaatagatacgttatcgaaagagaagaagaagttgatcaacgtggaggtatggaaaggtttaaacatttctatgcagcatttcaagcactttgttacattttctgtttcagacataacatcttcagagatacagatggtaactgggagtgtgaactggacaaattctttcaaagaatggtcatttcaaaatttaacccattaaagttttgtaatgaaaatgtcatgttgatgtttgctcgtattgcccaacaagaaagcgtcgcgtactgtttcagcataattgaaaataacaacaatgaaagattgaggggaatcatcggcaaagctgatagcgacaagaaggaaaattccgcacaagcaaataccacatcgtcttcttggtctttagccactcgacaacaatttattgacttacagagttacttcccatatgatcctttgtttctgaaaaactataaaattttaatgaaggaatactacatagagtggagtgaagcaagcggggaatatgaaagtgatgggtcggatgactaaggtcttttttcataggtatcttcgagacatgcccgtcacaaactaatgatacactgtagtcaccccattaatagttgaaatgaggatatatagcataaatgcatttaacacattttttagatttctagatactatagaaacttagtatttttattttccacagtgtactcttcacgatattttgcattttagaacgcttgtttgttctcgtcacttactacgtgcgcgctttacattcgcaggtctacttattaaagagtttctgtggggaggggttcctgagtcaaaatctcagctatccgaacagcttgtacttagattacttggcacatatttatattcagtaaagtcaatagtgggtattattaatcgaaataaacagaacaagcagtaatagctcttttttcatctattttatttgtaactaggaagaagaaaaaaacttgaaggtatacaagagcaatgtatgtcacttttaatgaggctttggatagttcttttggtaatctagagagtccgaatcatgacttcaaagtaggtgaccctaacatggtaccaactccccctatggattcagattctgcagcaattagtttggctttcttaataagtctttctattacgtttgcaatattaatgctcatcttggtagtaatagcggcatatgtcaccttttgtggtgatgatgaatcagaatacgacgaagagaacgccttaggtacacgaacttcaggaactctgcactctttgtttggtaaaaaacatagtggcatcttgttggattcgagttttgcatcccctggcgggtttgatgatgagatcgttcttcaggaaagagaacttgaagaattaccaaagatgtcagcgtacgaggttgagttgtatataagagcgaaagagtttcaaatgatgagcccgccaatggtgaaggactttggcacgtatttggacagtgacgaccagcagtttattaaggatcgtggcattcaaagctattttttgctaccaagcattaatgataatatagacgaatatggaaactttctacccagttttattgtccaggataaactagatattcaattttcaaagttcaataagagctcatccactgtaatgaactatcccctacctcacaataggaaggacgcagtgtatttcgaagttaaaattttcagacatattcaaaagtccaatagtatattcagtataggtttgactactgtaccatatccttatttcagggtaccgggcatggccaaatactccattgcatacgaatccacaggtaaactgaggataaataaccccttcactgccagcacattattaccaaaattggaagaaggtgacacggtaggattcggttacagatataaaacaggtacaatcttcattacacataatgggaaaaaattaatggatgtaacacaaaatattggcattgatcttttcattggaattggcgcgtttaatgccgcatatacaagaacatatacgagggatggtctattggaagacccggataatgttagcttccgtgaagctctctctgaaggcaaagatattgaagtcgccaaagatcttcaaagagttcacgatccacatgatgaaagtgatgaaatgacgtcagatgaggttgaattacatgttaatttgggccaagttgggttcgtctttatagaagccaatgtgaaaaaatatgcgtttgggagtgtttatggccaaattggaattcctcctgcgtataatggaaccgagatcaagaaggatactattttacagaaaggagaagaattgccaccaagatatgctgacactgataatttctttggtagtatgaaggtaaaagaagggtcatcctctaggataacggcgcaaactagtaagcccctgtggtctgttgggacgtatgaaagaatctcttctaactttgacagagaaaataatgtttaccacgacagtcttgaaaccgacgataacaacaccgataacaatgttaataacaacgatgagaacgctggttgcaatgaaaattcgccattattggaagatgatggcaataaaagaccggaaaattcaaataccccccgtgaagtatcagatggagctatcaataagaaccctagaaataaatctactaaaaaacgtcaaagaaacagaggcaaatcttctaaaaagaagaacagatcgagaaaataagagacattatgaatttggttttttttacaatttacgcatacacaatatatacattcctactagcttttttttcttcaattcgatagtttagatgggtttatatctaaatatatatatatagtattttatttcatattcaatctcctagtatacatgaaatatttaacgcttttttttgcccttgtttttattttttttcttttttgaagctgcagagttaccattgttattttgcacagcattagctttttgcttcggttctgtagcagttttcttagccgcaggatcgctcttttcgacatctgtgttgacaattaaggtggctaaaccaacaatgtcttggatgctcttaccttttatttttttactcgattcttttattttgttatttttcttcttcgactgtgctattttttcaattttacctggagttatagatacgcctcgtgggcctaatgcactaagtaatcttgaaacatctttactcttattagtagtaaatttatagttcaaggataaatgcgagttatgagttctaaaggacactttggtgtctgtcttctgtgttggtggtttatacgatatggagaagagcgtttgagatggattcacctcaaaaaggcgaacactgttcgtgatgtagttgtcaatgggtttcacagacatgttttccagttcaattaggtctgttaatttgctcgcggagggaagctcttttatttgggtcaatcgaagacagcacaattgaaacttttagcattgttctcgcgaaaatagtcagttcttaacttttcaagagtggtgcggcttaccctgccttctgccataagtaaaaagtgacgcaaatagcggaactattgtcattgttattgacattaataatctgtatttgtgctcatccggttccatttactagtatgcagacgtatctttttcagctggacgaattgaggctttcattagctagtgtggtaatgacaaactctttgcactgagaaaatactggggtgaggaaacttttctaccgaattgcttccacatctatcaaagcatgattatcaagtattcaaagatcaaagcatgatgtttgcaaataataaatgttcaggcgtcatttaatgttgataatggtgtacgggaagtgacttgtaaaaggtaggggaaaccgtcagtctatcactagtggtgtatctgatggaagtgcccttttatattttttgccgtacacaggtaaagaaatgaaagtactaattatcccccatactctttgtttctcttgtgttgtttatgatcaatccttctaatttaatcattcaataactaaatatttaaaaagatgtaattgccgcaaaaaaaactctcaattatttactattttgaaacagtctctcagatagtatgcgccatattggtgtgatgattcctgtgaaagcatttttgggtttgtttaggtgccttcttttctttatttagcataaccgccaatacggaatgaaaagtccgttttaatgtaccgctaataattcaaaatgcgtaaaagagttttcataaaaagggtatttgcgtcaagcaggaagaaattttgaaaacaactaacaggcaacttacaggcatatactgactttagtaaacgtcttccgctattctaagaaggagctgacttgaacaagatctttattttaacggtgcgacaaaaacaaggaaagtttacaagcgctagccgtcgaagacgtcaattgcactattactcagtaccgttttaatccttaccaacgtagaattactatttgtgcagtaggagcctgtgaaatgttcaagtcgaaaacaagcactttaagctatgatgaaaccccgaactccaacgagggtgatcgcaatgcaacccctgtaaatcccaaagaaaagagccaaacgaaacatttgaacataccaggcgacaggagccgacattcctctattgcagattcaaaaagaagctcttctagatatgatggaggctactctgccgatataattcctgctcaattaaggttcattgataatatagactacggcacgaggctgagaaaaacacttcacagaaactcagtggtttcaaatgggtacaataaactcagtgagaatgaccgatggtatttcgacctattcgataggaaatatttcgaaaactatctcgaagaacccacatatattaaaatatttaaaaaaaaggaaggattagaacagtttgatagaatgttcttagctcaagagttgaaaattcccgacgtttacaaatctacaacctaccagggagaacctgcagttgctaattcagagctattcaagaattcaatatgctgctgtacgttcagtcatgatggtaagtatatggttattggttgtaaagatggctctttgcatctttggaaagtcataaactcaccagttaagagatccgaaatgggacgctcagaaaagtcagtcagtgcctctagagcaaactcactaaagattcaaagacatttggcgagcattagttctcataacggctccatatcaagtaatgatttgaagccgagcgaccagtttgaaggaccttccaaacaattacatttatacgcaccggttttctattctgatgtgtttagggtttttatggagcacgctttagatattttggatgcaaactggtccaaaaatggatttctaataacagcatcaatggacaaaactgcaaaactatggcaccctgagaggaaatactcattgaaaacttttgttcacccagattttgttacatccgcaatattttttcccaatgatgatcgtttcataattaccggatgcttagatcacaggtgtagactgtggtctatactggacaatgaggtttcttatgcctttgattgcaaagatttgataacatccctaacattatctcctcctggtggggaatatacaattatcggtacattcaatggatacatttatgttttactgacacatggattaaaatttgtatcttcattccatgtatctgataaaagcactcaaggaaccactaagaatagctttcatccatcttccgaatatggaaaggtccaacacggccctcgaatcacgggtttacaatgcttcttttctaaggtggacaaaaatttaagattgatagttacgacaaatgattcaaaaattcaaatctttgatttaaatgaaaaaaaacctttagagctttttaaaggattccaaagtggttcctcacgtcatagaggccaattcctaatgatgaaaaatgaacctgtagttttcacgggaagtgatgatcattggttttatacctggaaaatgcagtcctttaatctttcagcagaaatgaattgcactgctccgcatagaaagaaacggctgagcggcagtatgagtttaaaagggctgttgagaattgtatctaataagagtacgaatgatgaatgtttgacagaaacgtcaaaccaaagcagctcacacacatttaccaactcatcaaaaaatgttcttcaaactcaaactgttggttctcaagctatcaaaaacaatcattatatatcatttcatgcccataactcccctgtcacatgtgcttccattgctcccgacgttgcaattaaaaatttgtccttgtcaaacgatttgattttcgaactgacttcacagtacttcaaagaaatgggccaaaattattcagaatctaaggaaacatgtgataacaaacctaatcacccagttacagaaacaggaggattcagctcaaacctatcgaacgttgtgaataatgttggaaccattctaataacaacagacagtcaaggtctaatccgtgttttcagaactgatatcttaccggaaatacgaaaaaaaataatagaaaagttccatgaatacaatttattccacctcgaagctgctggtaaaatcaacaaccacaacaatgacagcatattggaaaatagaatggatgaaagaagttccacagaggataatgagtttagcacaaccccaccatctaacacgcacaatagtaggccaagccacgatttttgtgagctgcatcctaataatagcccggtgatttccggcatgccatcaagagctagtgctattttcaagaattcgatctttaataaatccaatggaagttttatatccctaaagtcaagaagtgaaagtacgagctccacggtgtttggaccgcatgatattccgagagtttctaccacttatccgaagttgaaatgtgacgtctgcaatggatctaattttgaatgtgcttccaaaaaccccattgctggcggtgatagcggtttcacgtgtgctgattgtggtacaatcctcaataatttcagatagagaatcagaaagtaagaggaaaaactatctgttccaccgtctttagatcataagcatgtctgcaaataacatagtattattatttatatctgtagcgatctttattatttttcattactgacacattttctcacagaaccatctacaacccgaaagatgccggaaacggtcttaggccgatggggtctattagggcctacagagacgtcaattgggctataagaaaaatgaaatcgaggaaagattttccactctcaaattaagtagggcaaaaatatgcttttgttcgcatgtggtgttattccagttgcgagtcagggtctgccgatatgctaaaggaggtcacgaaaacgaatctggcatttaatacctcattaagttacagcggaatcggccttctgttgcggaaaaaaaaaaaaaaaagaaaacgaacattaagcaccgctgaaatttcaagctgtgactaagtcgtcaaatgataaatactgcatatatataaactatgtgattatatgcaacattaagatatactttcttcttccataatgcccccactccagaactccatccgaaatagttttccttagattgctatagcaagtcagacacaagcacatctcatcgaattatatcgtaagcaaatatgtcatctgacaactctaaacaagataaacaaattgaaaaaacagccgcccagaagatatcgaagtttggttcgtttgtggctggtgggctagcagcatgtatagctgttacagttactaatccgatcgaattgattaaaatcagaatgcagcttcaaggtgaaatgtcagcatcagctgcaaaagtttataaaaatccaatccaaggtatggcggtaattttcaaaaacgaaggtataaaaggtctgcaaaaagggttaaatgctgcttatatctatcaaattgggctaaatggttccagattagggttttatgagccaatcagatcatcattaaatcagcttttcttcccagatcaagagccacataaggtacagagcgtcggagttaacgtcttttctggtgccgcatctggtataattggtgcagtcattggctctccattattcttggtgaaaacaagacttcaatcatattccgagtttataaaaattggtgaacaaacgcactacaccggtgtttggaacgggttagtaaccatttttaaaaccgaaggtgttaagggtctattcagaggtattgatgcggcaattttaaggacaggtgctggttcctctgttcaactacctatctacaacacagcaaagaacattttggtcaaaaatgatctgatgaaagatggcccagcattacatttaactgctagtactatctctgggttaggtgttgccgtcgttatgaacccatgggatgtcattttgacaagaatctataatcaaaaaggtgacttgtacaagggacctatagattgtttggtcaaaactgttagaatcgaaggtgtaaccgctttgtataagggttttgcagctcaagtgttcagaatcgcacctcatacaatcatgtgtttgaccttcatggaacagacaatgaaactagtttattcgatagagtcgagagttttaggccataattaattcccataacaaactccgaggtttgaagtttcattcattggccaggacagttctactttactaatggtttcattacaacctttttcttcatattatgtagcattaaggataatagagcattttttatttcacattcatacacgatagttttataaacgtaattataaacatacagaacattattcacaattgtccagttccaagaattatatgctctcggatctcggagttcttatttataaaatgatcagttacagtgtaatcttgcttagaactttctttttctcaacctttgttttttcttttacttttgcttcttcgagttttttcagatagctgttatacacaaccacatctgctactaagaccaatattccaaagaacaagcacaacaaaagacgaacatggaccggaaagtttgttgaagatccggtccagtaccaaatggccacaacaaccgatatgacacttacaagaacgttgaaaacagtggtaacttgttccttaatctgtttattaatttgtgaaggcgtgagttcatcgtcttcttgaagtgaaaagacagacttgcttctcttgaccatactttgatattcaagttcttgttcctgatatttcaaaaactctaattttttcttgaaatcctctgaatagtgtaaacctctgacggccttgggcttgaattcgaactccaaaggtttcaaaagttctttgatagagcattggagatcactgtcttttctatactctttcacataaaaaagaagtgactgcataggtattgcgtgtcgcttcaggaacaaatcaatgtcctcatcaattccttcgtttgatttcgcgctattcttgaactttcgcagaaattcagttattctatcattcagtttaatttcgaacattagagttcttttatgtgatgccaatcgtcaattatcctatcttaccttttcttcatttctttcagcgttttcatgtgagatttgctttattttcgcttcctcgtttctcattttaaatattcacacgtccgtcatgtctactttgagtcagttaaatacacaagatttttgtaaaactgagtatttcgtgaacaatataattgttcggattcaatcatagttaaagactatagtatgagatacacagaatatcctaaaagttcccctcgagggtataggaaacctcaaaatggaatcggtctttctacatgataatattactctaacttcttttcttctatactttgccattcattaccctatcacgttatcaatccttgcatttcagcttccattaagaccgataactgtttcccaatctctatgtcatcatcttacaccgctgtgataatattctaggaagacgaatactagccaatagatgatacaaggatttcatttcgacagaaacaaaaaaagcatggaaaaacgaatggagacaaagaggaagttaaagaaagttcatttgtgacctcatttactcagaagaatttcgtaaatcggttgttatagaactgttttattgtttaaaagagcttgttatagtaatctaagtggaaatacactaacagtaaatagggcgtgtggcgtagtcggtagcgcgctcccttagcatgggagaggtctccggttcgattccggactcgtccaatctttttatacttattaataatttttttcctgccgttacttgcttttaaaataactgccttttatgaatacagagtataatttttgatatacaaagaggttgactgtgataatcaatacttaatttgtggttattggtacacatatacctacaaaagttaccaacaaactgttcgacttttaatgctacccgccttccgagtgtttttgaaggggcggagaggagcggcaagaattagcatggaaaaaagcataaaaagacgaaatgggtggcaatgtattaacttgttcgagaaacctagtggactcaattcattacaacaacaagttcccaagatcatcgattcataatagtcatgtccgataaagttattaaccctcaagttgcatgggctcaaaggtctagtactactgatccagaaagaaattatgtcttaataactgtgtcaattgcagactgtgatgcccctgagttaaccattaagccatcatacatcgaattaaaggctcaatcaaagcctcatgttggcgatgaaaatgtccatcattatcaattacacattgatctatacaaggaaattatacctgaaaaaacaatgcataaggttgctaatggccagcactactttttgaaattgtataaaaaggatttagaatctgaatactggccacgtttgacaaaggaaaaggtgaagtacccttacatcaaaactgatttcgataaatgggttgatgaagatgaacaagacgaagttgaagctgaaggtaatgatgccgctcaaggaatggatttcagccaaatgatgggaggtgctggaggtgctggaggtgctggaggcatggacttcagccaaatgatgggaggtgctggtggcgctggttctccagatatggctcaattgcagcaattattggctcaaagcggtggtaatttggacatgggagatttcaaagaaaacgatgaagaagatgaagaagaggaaatagagccggaagtgaaagcttaaaaggaggagcaaatcaacctggagtgctagaatgagtaacttagaataaaagacgaatatatgcactttacacaactctttacctgtttgttattggctgcctctatgtaattaaatattatggaattaataaaaatatttttattcgtaactatcttagatatatattgtacattgtcaaaaagacagtagtaagcagatagaagctatattggatgcaaaatagagaaaaaagcagaaatattatgttgcaaatgtcaagtaatggaactgtatgtgatatttaaagaacaatttctatatgctggatgattatcaggtgtaagcaataagaaagaaaacgaaagtaactcccatccgtgggaaatttcaagaaaaacttagagtatcagcgatcgttttaacgaagggggattcgtaaatttcattaatcgaccaacgttggttcttcctcgttagcgtattttccacaatctgttttcccacattagttttataatcgcttaaccggtaccatctccaatcaaacctggcaatacgatgtgacgtagctctgctacgctgtcttgctgaagcgtttggaggagggtcaaatggtaatctgtcctcaaacaagctgtatagtatgacacctaaggcccacgtgtcgcttaaatggccatcgtagggaactcccatcaggatttctggtgagacataatcctctgatccacatcttgctgtacacatctcattgttctcaatttttttgcagagaccaaaatctgctagctcaatgaaattttgcttgcagtaaatgggtgagtccctaaaactgttgatatcatcaaaactatatttcagtagtatattctctaattttaggtcccgatgaataatactgttttcgtgcaaatattttactgccagtactacttccgtaaaaatcctttgaatcagccacgcttctagtcttccgttacgggccatgacggcagctaataagtctcctgcaggacaataagacataatcatatcacaaggcggcagagctcttggagtttttataatcaaatcgcataaaggttttttgctagtaacaaaaattggattgtttatcccaagtagtttaactatacatgggtgatttagtgattttagcacctgcaattccctagtcagagaattttccaaacgggataaagtttccttatatcgtaacgatgtattgatttgttcaacatttgataattcctcgggatatttgagtcgtttaacggccacttgtttcagtttaggattgctttggtccatgagttcatataaaagtacggtactaaaatttcctgaaccaatgggcctgacctttttccataataacgggcgatcccagtgatctaaaagaaatccctgaaatatatcatcgtcacacttttcggtagaactactactttcgggaaaataaggttctttcgtgtagttatcactatcaacagaatcatttactaaagcctcttcagtcactgttggtaaggaaacaaccctttggggggataaattagctggtgcaataagttcagaaacaactctttggtttggttgtgtaacagaaagcatatcatccagtaatcgtgcatgacttcgtcttttgggtatattcaacgaggattgatctataggtgacattgacagattgcctggggataacggagtgtaggtcatcggtgtaggtaatgcttggacattttcaaacgtcggaatagatacagtcaaaggtgtactgcgagaatcaccagtggtcccttcagtggatgccatttttttatcttcctcaccattttcatcaatcaatgccttttcgtgttgatcgccaatggagtcgggaaatccttcttgtttcaaccgaggagtctttggttgtgaatatatactactatattcatccattgtcggtataacctaacagctgctgtgggtatggatgaattcgaagcgtagatgtgattactatctcaaaatatacttgtctaattgtgtaaaaaagaaaaaaaagataaagaacacaccccgcgttgaagattacaagtaaaaaactttctatgcttaggaataacgttccataagaggatggtgtgctcagccttcttagttcatttactggaatgtatttaactttacccttttcgtctgctaatccatcagtatgtgaaaaatgaaaatctaaaaaaaaaaaaggctgccttattctgtaacgcaacgcgaaacatctataaaccaagtaagtagtttctatgaaatgggcaacagcatcttggatgacgaagggtagcatttagttacgtacgttgagataatctacaaaaattgattacgtatttaaaattcttctcgcttctcattattctttcttagtcttcctcttctttgtcatttgtgacaagatatcattatcgcttggctctgcagtggctttcttcctcttggtgcccccagctcgcttcttttgtttaacctcaaacttgtctaactgttccttacgcgatttagcacctaatttctgcagcgtatcatttttttctttatactccttgtcttctaacaattcgctctcactctttgattccaaccactccataagtttgatttcattaccatagccttcatcattttcgtatggagtttccaagacaatagggataccctgcaggtattcagagtgcgcgatcattctaaacacatctatacccaaataaccttgacccaagcgttcatgcaaatctctatttgctcctaaaggagccttggaatcatttaagtgaacagcacttagatatttgaaccctattacatcattgaactctttccaaaaattgttaaacgtttcagtggtgctgatatcgtagcctgctgcaaatgtatggcatgtatctatgcaaacgccgattcttgatttatcttcaatcattccaataacctccttcaaatctaccagagaacttcctactaaatttccagtaccagccatattttctaatacaattttaacaaatttcgtttccttaattgctttgttcaaatatgaggctagttgttttaactgcaactgatggtctcctttcaaagtagaacctggatgtaagttatacaggcctatccctaattgctcacacctgttcagatcgtccatgaatgactcataactcttttctgccttttccctatccggattagccaaattaataaagtattggccatgcggtaagacgtccgtcaatgggttataattgtaagttgcacagtttttcttaaatttatctatttcctcctgtgtatactgcggagaaacccactttcttggagattttaaaaacatggcaaacgaattacagccagtgttaaatgcattagttacactattagaaattccaccggcacctgacatgtgcgcaccaaatttgtatttcgagacagcagatctaacaaagctaggtgtcgaaggcattacgatggttccgatatgccaaaagcttattaatgttgcgttttgtgtttcttattcggagtttgtcatcttatatttacaatgatttccaacatgtaaagaaatgaagaaaaagaaaccaggtaagaatgaaaaattccacgttcaagttcccagaaaaactggcaaaaaaagagaagtattagatgaaaaaagttcgtgtatacaaatatctatgttacatatatgccaaggtgaaggaccaaaagaagaaagtggaaaaagaaccccctcatcttcttccctttgtgactttattcttatttttgttcaattttttattttcttgtgctcttttcgccgcagcagccagctgttcctttgtcttaggcaccacttggaagaacccatctaacctaccctgaatgccagatttcaagccttttttcaatcttgatataccagatttaactctttcttcactgaatttcttatcatcacataaatactcgataagttccttctcctttggtggcgaccatttcaagtttatttcgttaccatctataacttcagggtcaagaaacagcattcttgcttgtttgtaaggccagtcttctgggattttccatttagtgttgtttgactccccagattcaataaactccacgattttttcgatggatccatgcgtttttatcaattttaaggctgtcactggaccaacacctctgatgctttcacagtagtcacaaccaagcattatgcaaagatcaacaaactgctctattgtcaagtcgagtcctctcaaaactaattcagtatctatttcgtgaatcggttccttcttggcctctgaaaaagtcaaatgtctcaacaagaagggtgttctataacagagtgtgtccatatcttcacttgctgcggcatacacctttcccttctttgccaactcagcacattgagcctcagcttccgttggcgctattatatatgggattcccattagtcctagtaatttttgggcttcttcattatgctcttttgagaccttcaccaatcttctttcttgcttcatcttttccaattctgttgttgcctctgccagttttttttctgtttccacccttcttgaagaccgctttgtcaactcatgagatttcaaatctggaggtttgccgtcgaagacataacaaggcttgataccgttatcaatcattctcagtgtcctataaaacatacccatcaagtgtgacgttgtttcaccggcttcattggtcaactgcccaccgtcttgctgtcttacagcaattaaaaactgatatagagacatagaggcatcgatggcaacctttctgccaaaaaagctcttgatatcgcttttcctgatagcagagggaacatgttccgatataattgcattcaaacctttaatacccatattttttcttccggtgtccgtttcctatttctttccaatgtatgctgtcaacgcttttcatcgatgtatataaggaagaatacctcattataatacatcaaaaccttcatttgcgcgatgttacgcgtcgcgtttcctataaaaaatacataagctagtgaataaaagctttaaacgcgttagggggatctgcaattaaagtaaataaatgaaataaatgaaatagatgaaaaactggttacactaattataacgttaataaaactagttgataatcaaaatattgccatagctaagccaatagtacagcgttggctttctatcataacttaccagccgggtgcccaatcgggtatctgtcaccgaaagtcactgttaacgaggtgtgattcagccgggtactagtctagcattttttttcgcctgtttttttcgtgaaaaacgaaaagtggcaagcaaacttatatcactttctacttctttccctgttctttttgtttattggcaatggccactaccacatccccattaacgaaagtcaccaaagtgtgtcatttaatactacggttagtgacagcattttgtttagatctcaactagagaggattatcaactgctaagccctttacacgttatctgtgatcctgctgcactaggaaacgtttcaaatcaccatatttgcaatttcacaaggatggacaaattagtcgtgaattattatgaatacaagcaccctataattaataaagacctggccattggagcccatggaggcaaaaaatttcccaccttgggtgcttggtatgatgtaattaatgagtacgaatttcagacgcgttgccctattattttaaagaattcgcataggaacaaacattttacatttgcctgtcatttgaaaaactgtccatttaaagtcttgctaagctatgctggcaatgctgcatcctcagaaacctcatctccttctgcaaataataataccaaccctccgggtactcctgatcatattcatcatcatagcaacaacatgaacaacgaggacaatgataataacaatggcagtaataataaggttagcaatgacagtaaacttgacttcgttactgatgatcttgaataccatctggcgaacactcatccggacgacaccaatgacaaagtggagtcgagaagcaatgaggtgaatgggaacaatgacgatgatgctgatgccaacaacatttttaaacagcaaggtgttactatcaagaacgacactgaagatgattcgataaataaggcctctattgaccggggattggacgacgagagcggtcctactcatggtaatgacagcggtaaccaccgtcacaacgaggaggatgacgtccatacccaaatgacgaaaaactattctgacgtagtgaacgatgaagacatcaacgttgccattgccaatgccgtcgcaaatgtagattctcaatcaaacaataagcacgatggaaaagacgatgatgccactaacaacaatgatggccaagataataatactaataacgatcacaacaataacagcaatatcaataacaacaatgtcggtagccacggcatttcctcccactcaccatcctccatacgagacacgtctatgaatttagacgtcttcaattctgctaccgatgatataccgggcccatttgtcgttaccaaaattgagccctatcatagtcacccactagaagataacttgtcactgggtaaatttatcctaactaagattccaaagattttacaaaacgatttaaagtttgatcaaatactagaaagctcttacaataattctaaccatacagtgagtaaatttaaagtttctcattacgtggaggagtccggtcttttagacattttaatgcaaagatatggattaaccgccgaagatttcgaaaaaaggttactttcccaaatagccagacgtataacgacgtataaagcaagatttgttttgaaaaagaaaaaaatgggcgagtataatgatttacaaccttcttcatcttccaataacaacaataacaacgatggtgagctttctggcacgaacttgagaagtaactctatcgactacgccaaacatcaggaaatatcaagtgcgggtacctcatcgaacacaaccaaaaatgtgaataataacaagaatgacagtaatgacgataataacggcaacaataataatgacgcctcaaatttaatggaaagtgtgctagataaaacctctagtcaccggtatcaacccaagaagatgccaagcgtcaataaatggagcaagccagatcaaataactcattcagacgtgtccatggttggcctagatgaatcaaacgatggcggtaatgaaaatgtccacccaaccttggctgaagtagacgctcaagaagctcgtgaaactgctcagttagccatagacaagatcaattcttataagaggtccattgatgacaagaatggtgatggccataacaattcgtcgagaaacgtggtagatgaaaacttgatcaacgatatggattcagaagatgctcacaagtccaaaagacagcatttgtcagatatcacactggaagagagaaatgaagacgacaaactaccacatgaagtggcggaacagttaaggttactgtcatcgcatttgaaagaggtagagaatctacaccagaataatgatgatgacgtagacgatgtaatggtggacgtggatgtagaatcgcagtataataagaacacaactcatcataataaccatcatagccaacctcatcacgatgaagaagatgttgctggactaatagggaaagccgatgatgaagaagacctttctgatgaaaacattcaaccagaattaagaggtcaatagatacccagttgagaagacgagctatttttctcatgtttcttttgtttattcacttttctatactttttcttttctattgaaatatatattatatcttatgtatgtttttttgtattataaacaagcaaatttcgtcttgccatttaccttctgatattaatcacatgtatatctcaattcaagtttttgttaagataatcagcgaaaagcggaccgatcctatcttgatctatatctcttagtttgttgaagttaatgaattgccttttcaatctctgcaattgcgccaacgtaacgacgttaccaatgggcaagtctacgaagaagcaaccatcatcattgatatcggtaatcccttcggaaacaatgactcttgttccgttacttaccccgccaatagaagtcaggcttttgatgtggttcattatggtttttattatcttactagtttcgatgtcgagaacctggatgaaattggactgagacgcaggctttagtaccgtggctgagttcggtttttgtaagcccttactcaacggatcattgtgtccactgtttttagccgatttggaagtttgaaagactactttacaaatatcgtcgatgtagtcagttatgttgtcctgaggagtaagaatagcaaagagtggagagtcccatcggttgcttgagttaggctcttcgtatcgttgaatcaattgattcaataactcgggttcccaagggttcgggtttgaagtcttattccactcgaatatagtctctggtggacacagtgtttgaattacacaaaatgtggtggacaaatttttcacctcgcagtgaagttgataccggaaacccttgatataattcaacgagtctacaatgactatcttgtttttagatagatctcttttcactgcggagatgatctccgacctcaattttctttcatcttgggaagttatataatctgaatgttttatgcctaaagattcatctgaatgataggttatggaatatttacttaatgatggggttgcatcgatcttggactgtagtagttgtaccaaatgtttagcaagcgttgtcttaccactacatgggtatcccgtaaaaagcaccagtggcatcttcttactaaattgcctgtttagttttttcaaaagttttacaaggtccctttaccctcattctgatacgttattgttcaagtttcacctgttcatcaagtattcttcatttctttttccatcgcgatgacgatgacaaaacggcaaaaagtcaaagaaaaagaaaaaaaaagattttttttccatcatatgcagagagaatatgtccaagccaagcgcagtgtgcatgtatgctgtttttagcatatcgggtgtgcgaaaggaatgacataatgatttgcaactaatatttccttatataaatatgcttctggatatgagtctcatgaaacaagttcagtaattgcttgttttacccttacttttttcttggttatgacttgtgtacataataaattgcctattttcccaaattgtgtcctttttcctttccggttggtatgagatatttcttttcaaaaatcaaaagaaaacaacaaagggttgatattatgtaatgcaatacctagaatcgggaaaaacttgtttgtcgtaccaagagaggcagcactggcgtgccttgatttaatataactcctgagatagtgggggttacatgagttgtacagcataagactccctctccccagttctgttcgtatatgtcgggcttgcttgcgaaagcaaggggttcaataaacagaaaacagagtttttggataaagtttaaacaacggaaacagagcaacaatgaaggagagaataagtatcaattgtgtaattctgtataccgtagtgcacagtacgctgtgcgcaactcttgcctaaaaaatctagttatcaagcggggtgaatatgctacaatgcctcttttacgttgtactctatcaagggatgatagcagtggcacatattgattgatacgacttttcgccgcgcggtaggcgaaaagcaaagaaaactacagtaatatccagaaatagatgcattttatgtgcgaaataaaactcatgctgaaaaaaatagtaataattaatagggtaacgaatagaatgcaaaccttatcacgtgaaagagagaacaatcataaatgatttagtgcgtaggtccagatttgcgaaacactgcggaaggcgagaaaagaattcgaatatgaagtaggtagaagcagaggtagggccgctatttaaagatatactttttctgtacgggccggtgacttcgcagtagtgatgtactatgagatcactattttgccggaaactgtaggcaaaaaccgtttatgtctttttttcaccttacgggataacctctgctgagaatttccaaaactaggcatggatgattgccggaatttgaaacccgggccccggaggttgatcgcacggcaaatacataagaaccttctccgcaatacgggctttcctcaattttcttggccaaaaagcgagtcggccccgagctacaaatcgggaacaacggaggaatagagcgacaagttgattcggtcgtgcagcccggaaaaaaaaggctgtcctgcgggctttattcactccaatgccgctgagaggaacacgcgtttcgtgggctttggaccactaccccggcgttcagagaaaccccccggggcaggggtccgaagtctaaaagtttaatccggaagtagcgacgggggggaagcccgccgcgcacagatggccagcacaacggagcggggccgaggcggcaaacgaggttaagcccgctgaacctgaaaaaaaaaacgaaaattttctttcatcaaggactaaagttttcttatgttacggatcttgcacgcggtaagcaatggccgtagccttttcacagttgcttccaagtgtcatgtatcgattttgcagattgttctaaaagtaaatggattgctattttctttccgagactactctaaaaaaatttattgagtatgagatcgtttttagataaattatatatattgtaaagctattaactaatctcctatatcaatttcttcttgcttaaccccgtgtggttgtttaggtccatctcctttttccttttaatttttttacctttattaattccttcacctctctaaaccccagttttatatcgtatatgctatctacaggtccactttacacttaataatataaaaatactactataaaggaaccagaaaaataaaaaagggtcattatttatttgagcagatcattatcaaacgcataggaagagaaaaaacacagttttattttttttccacacatatttattggtctcctagtacatcaaagagcattttaatgggttgctgatttgttttacctacattttctagtacaaaaaaaaaacaaaaaaagaatcatgaccgcaaagacttttctactacaggcctccgctagtcgccctcgtagtaaccattttaaaaatgagcataataatattccattggcgcctgtaccgatcgccccaaataccaaccatcataacaatagttcgctggaattcgaaaacgatggcagtaaaaagaagaagaagtctagcttggtggttagaacttcaaaacattgggttttgcccccaagaccaagacctggtagaagatcatcttctcacaacactctacctgccaacaacaccaataatattttaaatgttggccctaacagcaggaacagtagtaataataataataataataacatcatttcgaataggaaacaagcttccaaagaaaagaggaaaataccaagacatatccagacaatcgatgaaaagctaataaacgactcgaattacctcgcatttttgaagttcgatgacttggaaaatgaaaagtttcattcttctgcctcctccatttcatctccatcttattcatctccatctttttcaagttatagaaatagaaaaaaatcagaattcatggacgatgaaagctgcaccgatgtggaaaccattgctgctcacaacagtctgctaacaaaaaaccatcatatagattcttcttcaaatgttcacgcaccacccacgaaaaaatcaaagttgaacgactttgatttattgtccttatcttccacatcttcatcggccactccggtcccacagttgacaaaagatttgaacatgaacctaaattttcataagatccctcataaggcttcattccctgattctccagcagatttctctccagcagattcagtctcgttgattagaaaccactccttgcctactaatttgcaagttaaggacaaaattgaggatttgaacgagattaaattctttaacgatttcgagaaacttgagtttttcaataagtatgccaaagtcaacacgaataacgacgttaacgaaaataatgatctctggaattcttacttacagtctatggacgatacaacaggtaagaacagtggcaattaccaacaagtggacaatgacgataatatgtctttattgaatctgccaattttggaggaaaccgtatcttcagggcaagatgataaggttgagccagatgaagaagacatttggaattatttaccaagttcaagttcacaacaagaagattcatcacgtgctttgaaaaaaaatactaattctgagaaggcgaacatccaagcaaagaacgatgaaacctatctgtttcttcaggatcaggatgaaagcgctgattcgcatcaccatgacgagttaggttcagaaatcactttggctgacaataagttttcttatttgcccccaactctagaagagttgatggaagagcaggactgtaacaatggcagatcttttaaaaatttcatgttttccaacgataccggtattgacggtagtgccggtactgatgacgactacaccaaagttctgaaatccaaaaaaatttctacgtcgaagtcgaacgctaacctttatgacttaaacgataacaacaatgatgcaactgccaccaatgaacttgatcaaagcagtttcatcgacgaccttgacgaagatgtcgattttttaaaggtacaagtattttgaaataggcatgttgcaataaaacgaaaacaactaaaaatcacgaaaacaaaatgatattatacaataaaaaattcttattatgggtaatgatagtattcttcgcctgcttaggcgtccttttccttcaacaacaaaaattccaaaaaaaaaaagtaaaaaaacaaaactttgattgttttttaatgatgttaatgattttttttttctttctttatcataaaaaaaaagttaaaatgaaaaacaaatatgggtctggaaggccattattttttttttatttatataccgtttctggtacttagttatttattctcatacatacactatattcaaattacctaagagcattttcacatatccgtttactttcattttttttttttttgcttcctttttacatatcttccgtatatcacatcacgtttacgcgtatggtgaaacacgtcaagagaaaaatgataaaatcaaattttgatttacatcaggctccacaggacagggaaatctatctagtgaggcgataactgtagttcgatgtactcatttgaactggacaaattgaaaattgagctgaaaacatgggagcatgatttcattgataaaaataaaagggaacccacaagggatgacatcaagagcctgcggactgttcggcagatgtataaacaatattccacactgaagaagaaacaatctttgcaacgacaaaaagttgacactcaagagtcggttgaactcccggcacataaaaaagaccacgacgaagtcgtagagataggccctactccccaagtttacggtaaggcgattagtatctttgacatgaatttgtcgcctataaagcctatatacatgacattcacaaataatattgatgttaacaatgataactccaagacaatttctaatgaatcttctccacgaaaaactattctcctaaaatcgtcgcctgcagatcgtacgttagtggcggaaccaatatccagtgtgaaacgccaattaaactttcaaatgctaaacgcttcttctacacgtactccgacttcatcaccatgcaagaatcgcaatgggaagttggtagaaatcaagaaatgtagtccaactattaatcctccactagaatctggcaaaccatcggggtattatggacctaattccccgctaaaattggatgaagaaaacattcacctaaacatctcacttaattcaagcactaaacgccggcttcaaatagcatatccatctttacagaagactccctcaaaggatcaagcggatatttcaacttcatttagtccgtctccactcattagaagaccactgacgaaatccctgatagaattggccagggaacatactgaaattgtaaaagaatttggtgtcttacaggaagaagatattgaagaggaagaggaaggagaagaaggcgagaatggttacgatgagaaaaaccacgaagacgactttgggctagaagatgaactaattagaccaaaagttgtgaaggacatatttcaagaggatgatgataatgatgatagccaagcaagggaagataccttcataagaaagagacccaaaagaagaaaggttatcagaagattacgagacaatgatccagaaaccgagaccgcaggttttgagagagatgtccataaggagctggtgaaactcaaaagaaggaaagtggcagaatttttgggatccacctcacaaatctctgatactgaatttgaacatgatccggaggcaagcagcggcgttgtaagctcagagcaaaagcctacggctaagcgaaagggtagaaagaagtataatctagtgagcaataacttcagaagactaaaactgccaaagaaaaaccgattctctaatggacgatggggaagaaggtgagcgtgatggcgtaaataatacaaacatttgtaatttatagaaacctattaagtattcagttagattccttcagctgcatgacgtatagtttatatggacatcatacgtatttttatcaatatagagactagcatgtttttacactttttatttttgttgttcaattaggggcctcgtccatatatgtatatatattacataatctgcaatcatcaattaggggaggaataatcggcagaggtataaatacaaaatttaaaacaattcaagtgaatgaaaaggtgaaccaacaaacagaatattaccacgtatcaaggaaaaactaataatagtatattggcgcatttagcaggatgttctggaaaaaggatcccaccgtcagttgggaaagaaaaaatatcaatgacattgattttagtcgttttaatgtggccataattggtggcacaggtggacttggacgtgcaataagtagagagctggcccaaagaaatgccagggttactgttgtcgggcaaacttttagggacgaggacctaaaagataaaattaactttgtcaaggctgatttaagtttagtgtcagaatgcaagcgtatatctcatagtgatgaaattccctacgaggagttaacacatctgattttcactacgggtatttttgcatcacgccagagacaagctacaagtgagggtttggaaaaagacatggcagtgagctatttgagtagatacattatcttccatgatgtggcgaagcgattaggaattagtaggacaaaaaaagacgatttgccaaaagttttcatagcagggtttccaggaaatggtcaggtgggagacccagatgacttgaattctgatgaaaagaagtatagtgcctacgctacacatatgaacactgtggcagccaatgaaagtctggtcatagacgctaaagacagatacacgaatatagatactttcggtttgaaccctgggctgatcaaaacgaacattcgtaataatcttcttggcagtgacacctacctcagccgcattacagaatggataatcagctggacctgtcaaagcgcagagacgtatgcgaaaacaatatgcaccctgattgcgagccccgctatcgaatcacgcagtggtacaatgttcagcaacaaaggcgatgctattttaccttcgcctggtttgaccaaagatgttgttgagaagtttatggaaaattcggaacttctagttgaaaaggccttgcgtaatcaaagtcctttcacttccagtaacgaatgacttgctgtaactaattggtttatatttaaatatttcactttttaaagggcgtttgcatgcgaccatcgtcgatgattcatattgttcggatgcggaagatggcttccatgagttttgcacgccgtctcatgtgattgttggagtcatagctcgcatatcttcctattgtcagatgtaatatcgacggaaatggcatcttggagtatggaagcactattctgctttgctccaatatttaggatgccgcatttttcatatttttttttacatttttcgcttacgtatataaattgctagcaagtattcgctctctctgtcttggttatctaattgctaaccgtcgcaattgaaaagaaaaaaaaaatacagaatagacgatagcggattgaacgatagcatactattgagtgcgttttcccttctcatttgaaaattactatccgtttttcactgccgaaagacttgatgttgaggacgaggcttactaattgcagtctatggaggccctactacacgtcatcgcttagtagagtaccaagagcacctccagataaagtcttggggttatctgaacacttcaaaaaggtaaaaaatgttaacaaaattgacctgaccgtaggaatatataaagatggttggggcaaagtgacgacgtttccctccgttgcaaaagctcaaaaattgattgaatctcatttagagttgaataagaatctttcatatttaccaataacaggttccaaagaatttcaggaaaacgttatgaaatttttgttcaaggaatcatgtccgcagtttgggccattttatttagcccatgatagaatcagctttgttcagactttgagtggtacaggcgccctagctgtagcagctaaattcttggcattatttatttcaagagatatttggatacctgacccatcatgggcaaatcataagaacatttttcagaacaatggttttgaaaatatttaccggtattcctattataaggacggtcagatagacatcgacggatggattgagcaattgaaaacctttgcatataacaaccagcaagaaaacaataagaacccaccttgcataatcttgcatgcgtgttgtcacaaccctacaggtctcgacccaactaaagagcaatgggaaaagattatagatactatatatgagctaaaaatggtacccattgttgatatggcttatcagggtttagagtctggtaacttactaaaggacgcatatttattgaggctatgtctcaatgtaaataaatatccaaattggagtaacggtatctttctttgtcaatcttttgccaagaacatgggcctttatggtgaacgagttggttccttaagcgttatcacgccggcaactgcgaacaatggaaagttcaaccctctacaacagaaaaactcattgcagcaaaatattgactcccaattaaaaaagattgtcagaggtatgtattcttctccaccaggatacggttctcgtgtggtaaatgtagtattatcagatttcaaattgaaacagcaatggttcaaggatgttgatttcatggttcagagattgcatcacgtcagacaggagatgtttgaccgtctagggtggccggatcttgtaaatttcgcacaacagcacggtatgttttactatacaaggtttagtccaaagcaagtcgaaatattgagaaacaattacttcgtctatttaacaggtgatggtagattgtcgcttagcggagtcaatgattcgaacgttgattacttatgtgaatctcttgaagcagtctcgaaaatggacaaactcgcataattttttcaccttacagttcacctttgtctttatttttttattacttttcccttctcattttgccacacaataatttatagaatataataattttttgtaataattaataaaccttttttttatctactctatatacacttttcagataactagattggattaattcgtgatcgaactagttattaaattttaaatgaaaagaaagctagcgctagccaactattttaattacggtggcagtgcatcatatccttacatttcattttaggtttcctatgttttcttctttcaaatcatttcctgccaaaaatttttttcagtttcctaccgaatttactgtgaccgtgacggtcatgcgacttatcttttatagctgcatcatcgttatgaagcttgtgtatctctccatttttatcaatgatagtcaccggaacgcttaatggtaaggctgtaggcaggtcaggatttgatgactccaaagtggctgttccaccagatatgttcctatttgacaattggcttttatttccgaataatgaaaaccggtggccttctgtaccagcttcgcttacgtcattagtgttcatggatgatgcagtgtaaggggaagaatcatcgttgttgcagctctttttatttgctaatattggcatatcgttttcgttggtcttatttttgaagttcgtcatgggattaactatctctgtttcgttcgtggtatgagtagaatgacttgttctccttttcagcggagagggcaaaccaaaagtccatgattttcttgagacatgacctcctttttccttcttttcttccacatccaggttctctgctgctgtggctgtagcattctttgtgataagtggctctctcaaagacatgcttctaaatcctaggttatccttcgcaggtctttccttctcaaaactagacttcctggcggggggttctttggggtagagtgcactattatttttatcaatgtatagagggacatgatcaggcaatcgtctcgatgttgtgctcgcctgaggagcttttggaaaacacttggacgcctcgtgtgaagccaagttgccagatgatggaggatttgatggcttcttgctatgatatggaggggatgaagatgagtcagaagctggatatactatattatgcgaaagagtagcctcatttgaactaccacgtagagttcttaggcacgaacgattggtgatttttcttttatcgtcgagacgcttgggagacatcacgggtatttgatgagaactagattgatcgtatttctgttttgaaatactcgtcggagggccatggctgttcgttttcgtattggaagcagttttccctgtagaggaatcaatatttggagacgtttctatcgaataaatggacgaggaagtacttgatggaacggctgattgtttcaaatcagatctaagttgtggttgtagtgagcttttcaaaaggtcaggtgcaactcttgtggtatccgtggaggacttggagttcacgttttcggaatctaggctgaaagtgtctgaacttgtgttagtgaggtaaggattagcaccacgtaaatacttggccatgtttgttccggactgactaacttctgcattttcagaattttgttccttctttttattatcttctgtctcggtagaatattctgaagggtgttttaatgaaggcacgtcagatatatcttgttctatttgaaccggatctctcattatcacgtcataagaatcatgatattcatcatcatcgtcatcatcatcgtcatcatcatcgtcaacattttcatcatcgtcaacattttcatccttgtcatcatcgttaacatcatcgtccttgtcatcatcatcgtcattatcattgtctttgtcatcatcatcgtccttgtcattgttgggtccattatttttgtccataacactaccagtctcatcctccagtttaacgttctcgatcccagaagtgctagggaatttttcagaactttccggttcattatcggaaagcgcctcttcttgatcttctttttggactaaaaagcaatttgtatcgacgaggcctgacttttttccctttgtacgttcttcctgtttttcactatcatcatcttgcggaatttttagtccaacctgatttccgcctatttcagactccacacttgtctttgcagtagcgcgaagatcagttgccgagccttctatataattataatcggataattcgctgccagtgagactgtttgaatctgcaatgcacctcacttcgttatctgaattcatgtggaagttagaattgtttaaagagccgagaagaataggatctactaaatttccttcggcatcaacagaatcgatattctctgcattttcaatattctgagtttgattggagagagttgatggctctttctccacgtcttccggaggtacataggcaggcttaggttctgataaagtaggttgacgaatcgtgatcgatttgacctcggatgctacttcctgtcctttgtgaaagtgttgttttcttttgctttcaattagttttaattcttgggcttcaaggtcggcattctccttaactatatttagctctcttttcaataactccattctccgttcttcatctagcttaacttttcgcaattccaaaattaagctttgttccctttcttcttcgttcaattttgctatttcgatatttgatattttttcctccaagctatgaacctctttaagcaatgtttcaatttcttcctttttctcacgtccactgagaccacttttatcttttttgggtatgctacgatcgagaacgctgggttcaataaaagagttttcgtcatcggatataatcatgggtttaaattctaaaggatcatgaagatcctcttgcagttcttgttccgtttcctcgttcatagttgttggtattaatggaacattgttatgccgttgctttaatgatgtagtatgcattttagataatactttgccatgataatcgttttttgatttaccgccgctttcactttttttctcttgtgatcctgctttcttagtagttttattcctatgcattagactagttttgttgtttcgagtaggcaaagaatatgctctaccacctcgttggtttgagcggttgctcagactgtatctaggaggctctacttccacgggtacttccacagccattaaccccctagggcctggtatgtatttttttatcgtccttattgtgctgcctgagttcccaagtgatgtggtccttgatttactattctgaccagtcgaacttgaaatgtttaaaaccttcgatgactgcttgcctccaaattctcgaaacgtggtttctgcatcctcgtgagccctgtgttgccttctccccgccgaattattagaggtattcttatgtccttggtttggcaaactcgacgtgcgcttagagtattggcgaacgttaccattcattaagagcatccttgagttagtcctagaattcgagagcattgtatacctattaatccctgcgattgacgtagttcgagaggtaaaactctgattgtattgcggtattttactcttgtcaacggtcctcccattataactgagcgcatttccaattgctgctgctgctgctaaggcatctggactactttcttggatcatcccgctatttccaatgctcccactatttgttgatacttgcctctttcagagctatctgccttatgttgattattagggttaataaatgctatttcctcccgcaataattgtgtaatttgaacgaagaatatgaagaagatggaatggcgattttcactctaaattttaaaaattgcctctttacaatagcgaatttcctaacccttttttttttttgttgattgcctattgctcgttcacttcccatttattttctctcgaatttcaccaaaagttgatgtggataatcaatcatcgggcctattcctgcgggtaaaacgcagggcccaactcaggatagggtttaatattattttagaggacttacaagaaggaagttatatggtttaaaaattgtaacaaagttagaacacatttatttagcaggtctaatttagggctgcaactatctttttggttattcatataaaatataattttttatttatatagagaatacaagtggaatcatctttaacgccagcttgtagtgcgcattgcagaataatggaagttcaaaaattaaaagcgaaggagaagtgattgtagaaagacggatgggaggctgggggacgaagagaaagtaaaagggttaatttattcgacggtaacagatttagccaagtttcttggaaaatcaacatcaatccctttattaacagccaaccaatatgacattagttgtaatggaataatattaattagaccttgtaaacaatcaacagtttgtggaacttctaaggtttgcaggtcgattgatttagatttttgcgcccacacttcatcattttcgttacaaataataattggatggccctttcttgcagtaacttgctcaatagaggaaactactttagggaatagagagtctctggtaccaaaagcaatgattggcaagttttcgtccaccaaggccaagacaccgtgcttcaactcacctgccaaaacaccttcagaatgcatataagaaatttctttgatcttcaaagcaccttccagagcagcagcaaattggtaacctctacccaataacaatagagatttttgatcctttaattcagtcgcacagagcttttttattcttggttccagctttaatacctgcttaatttggcccgggattaacttcaagccttgaatgatttcaattcttctgtctattttcgatacacggtcatctgacagcgatagagcaaacatcactaaggcaatatactgggaagtataagcttttgtagaggcaacaccaatttcaggaccagcgttaatatgaacaccacagtgggtgacacgagagatagaagaaccaacactgttaacaattccgacagttaaggctcctctttctaaacaataatttagagccagcatggtatccgcagtttcaccactttgtgaaacaaacacgcatacatcgtctctgaagacagggcattttctgtccagaaagtcagacgctaattccacactaactgggatatctgataattcttcgaagatagcacgagtagccaaacatgaatgataagaagtaccgcatgcgatcatgatcagtctccgtgctcttctgacaactggtaaccatgcctttaaaccacccaatatcactttattattttcatagtcgattctacctctcatagtattgaaagtagattctggttgctcatagatttccttttgcataaaatggtcgtaagggcccttcatgatctgagctaactccatctctaaagtttgaatggaccttgtcattgatgcgcctacttctcttctagatctatgaatatgtaactcaccatcgtaaatatgagccaaatcgtcatcttctaaaaatagcaccttcttggtatgtttaacaacagatgccgcatccgaagaaacaaaaaattccaccggtgttggagatccatcttctgataggaaagccctggattgagaatgtctcaagttaaattcattggcggcaattggtagtaaattggcattttgggaaccagcttcaaattcacgagctttctttgggcccaagccaaatgatttgttgttagatttcaatggaatttccggttgaccagcgttttcttcgggaaattccacatccacgaagtcgacttttagttttttttcagatttgacaccaatcagtaaaggggacccttttctagtggcgataacctcattaggatagtgacaagatttacataataacccgtatgaaccttctagttctaaaagaactagcttggttaattcgtggaaatctaagtcatgcccattttgtaaatttgtattgtataaatgcaaatatagtttagcaatacactcggtatcggtatcactttcgaatttataacctttgttaattaaaagagtcttcagttctctaaaatttgtgatgataccattatgaacgaccacaaattggtcttctgggtcagatctttgagggtgacagttaacttgttctggtcgaccgtgagtagcccatctagtatgcgcaataccacaatgagagacaaaagtaacgtctctgttcggattttgcttagtaatctcctctttcaaagcactcactttaccgatttgcttatagatgaaagtagaatcagcttcgtcaccatcgatagcaataccggtggaatcatagcctctatattctaatctttgtaaaccatccactaaggtgtcgataatttctcctctggatctttccactagataattgcagtaaccaaagataccacacatttttttataaaagttgctgttgatttgctcgagaacttattgcttatttggccctgataactatataagaaaagaaatacagttattccttgtttatgctggctttttgtccactttttctcaactatataactatgatgttggaaaggacaccggttctgtaactttgcagtgaaaataagtgtgatggatgactgagaatgctttcttgtaagcgaaaagaagtacgtgttccaaaaataaagcagaaaggcgaaaagggtcgaatgtaagacactaaataaatattttaagaagaggaaaagtcgcctcagaaacgctaaaatgcatccgatttcccaaagaggaagtctaatgttttcgatttgtgaaaaaaagataaaaatcgaagaaaatgtagggagccgcgcgttacccggattgatatttgagtgatcgacggcgtcacaaaagaaagaatgcttggctaatcaagaaaagtatgtggtttgtttcatctaatacggctgtcaaggcccacattggtgttcaaatgcattttttatagttcgtggttactgttaatattctttcctagtagaatgtttggggtttaggtatttttgatgttttatttataaatagatatttatatcttgacgattgtggtgttttatttttttttttttatacatttttcttttcttcctgattcgaaataaaagtatttttagaaaaaggataaagaaacagaaatcaaaagaaataaaaagagtgtggcaaaatcacaactcgccgaattcatcgtagactgatctccagtgcttgaaaaatccgttgaagaacttaacacctaatccgacatccttggaccctgtagcagctctgatgctgtgcatggacaactgtgcaattcccaggtctatggtacgagcacctgtttgagaagccaatgatgggccgatagtaccacctgatcttgagttgtttttgatttggaaatattgcactttgtctccattgcggcgtgctaattcttctactagggcagttcctacgacatctgtggccatatgaccgttaggatccagtgataaagtgattccgacattaggcactggaaaatgattcttcaaatagacttcaggaaagtttgggttgtagaggtggttgacgtctgcggacaagatgatggaattagcccaaaccgtatgcaaatcgaccggtttcttagtgaatgcagaagaactgcgttccaccactgactccaacaagccaccttttgcgccttgtcttgtcaacgatccgatttcttcattatcatacaaagtgacagtagagaataaatctgattcctcggtattaacatccttagcgtagcaaatcaaagcaatcattgctgcgaaactacacaacctgtcatctagacgtggtgcaaaaaggaagtgtttaccaatacctccaatggtacccttttgcacatcgaataagtctaaatccatttgaatcaattcggacacttccacaccggctaatttggcaacgtaccttaacaggtggatgcagtgtttgccaaataagggcgatttcttttcatcatccgtgggaggttcattaccttcctcatccggagtggggaagccgatgaccgggatagtttggtcctctttatcaaatgggccttcagcaggtttaccgaaatggggagccaaggaaggaattcgacaaacaggtaggggtgtagaatcaaccaaggcgcttttaatttcgttagtgcccttcttcttgtaaagaaggcgaccaccaatacctaggtctctgtctagccacaattcattcagtgtacctccatagggagcaacagcaattcttccgtaaccttccgctgtgtctttaaaggagacgggcttcaatttgaccgtcaaagcgtccacatgagatccaatgacaccgacacccttttcggctctccagtttttgcccaggataaaggcagataggttagttccatttcttatagtgtagaatttcccaccatcttcgccaatggagtcctgccaattggatttctcgctcaagtatttgaagttatgcttatctaacagctccgcgaaaaatgatactacatggtaagtggtagggttcttgtaaatgaaatcaatgaattcctgtgcaatatcctcataattgtgctcgaggatgcaccacgaattttcattttctttcttttccttttcttcgttggcgatttggttatttttagatggctctacagttagcatctgcagagttttcttcaattgttccagtatttcacgttgttcctccattctttttttcttaattttgttggttgtgcaggtttctacaattgcactaagattactgatcaggctctatacagtgtatgtcttgttctgtgaagtcaactgcttataaatgaatttttattatctaatggaacgattaaggggtgtgtcaactatttcacttaaccctattctttcttactgtcgtttgcttgcatagcctatcttacagtaatagaggtgcaaaacagcatcacccctagttgtttttcccgaaaaacctatcccagattattttttttttgaattagacaagaaatcatccgaagacctattatgcttctgattaaaccttgagaaaaacggaagtttgcaacctataccctaaagtagaagctgactaattcatattcctcacgaaatggtgcgacctctctttatccatgagaaaaggaaggagtgggttcttgtttgatgcttctttatctgataccaacaagcgcaagagataagggattacaatgttatcatgcctcagaaagtaataggatgacattttcttgcaaacgttgacattaaaaacataaagtaccttacggcgttcggagcctacaagcctgccacaatttgagccgctgcacaagagaacaccgaatgaacaactggctgcagctgtcgatgaaacctcagcgaataaagcacacatttgtgcgttttacaataacagggaaggtggaatgtgttgccttcgtccttatttttcgcgttgtgaaatatttttactaatttttcttttcgcgtggtcattttcgcgttgggttgtttgggctaaatagtgaaaactaatctccatcacgtaccgtaccgtcttgtaccggctgggagcagcattatagtggccactcttattggcgttcttaatataagcaagttaccttttgctcgaaacctgtttcttcttaaaactccctttggatcgtaagttcgctagttatccgactgcaaggacgtaaattggacagcgagaggccattaaaacagagagttgaactcaaatagatcatcaaataggttggatatccatcatactacttgctactaatcgcgaaaagagataaataataaaattacaagaaagacaaggtaaaaagaacgacatagatttgcgggacaaaaaatactgataaataaatcaacaaccaactatattcactcctttattatttgttattaatattttttatttttaccacacgacatgactggtcacgtttcaaaaacgagccacgtacccaaaggtcgcccgtcttcattggccaagaaggcagctaaaagggccatggccaaagtaaattcgaatccaaaaagggcgtcggggcatttggagcgtgttgtacaatctgtgaacgacgctaccaaaagattatctcagcccgactctaccgtaagtgttgctacaaaatcatcaaagagaaaatccagagacacggtgggtccttggaaacttggcaaaacattggggaagggatcttctggtagggttcgcttggctaaaaatatggaaacaggacaattagctgccattaaaattgtccccaagaagaaagcctttgttcattgttctaataatggaactgttcctaattcttactcttcttccatggtcacttccaatgtatcttctccatcaatagcatctagagaacatagtaaccattctcaaacgaacccatatggcatagagagagaaatagtaatcatgaaattgatatctcacacaaacgttatggcattgtttgaagtttgggagaacaaatcagagctgtacctagttttggaatatgttgatggtggcgaattattcgattatctggtctcgaagggaaagctacctgaaagggaggctatccattacttcaagcagatagttgaaggtgtttcctattgtcattcttttaatatatgccatcgtgatctgaagcctgaaaatttattattagataaaaagaataggagaatcaaaattgctgatttcggcatggcagcattagagcttcctaataaacttttaaaaacttcatgtggctctccacactatgcgtctcctgaaattgttatgggtagaccatatcatggcggtcctagcgatgtctggtcctgcggtatcgttttatttgcattactcaccggtcatttaccatttaatgatgacaacatcaaaaagctgttgttgaaagttcaatcgggcaaatatcaaatgccctcaaatttatcttctgaggctcgtgatttgatatcaaaaatattggtaattgatccagaaaaaagaattaccactcaagagatattgaagcatcctctgatcaaaaaatatgatgatctcccagttaataaagtgctgaggaaaatgagaaaggataacatggcgaggggaaaatctaactcggatttgcatttgctaaataatgtctcgccctctattgtaactttacattcaaaaggggaaattgatgaatccatcttgaggagtttgcaaattttgtggcatggagtttctcgtgaactaatcactgccaagttgcttcaaaagccaatgtcggaggaaaaactattctactcactgttattacaatataaacaacgtcactcaatatcattgtcctcgtcaagcgaaaacaagaaatcagcaacagaaagtagcgtaaatgaacctaggattgaatacgcatccaaaactgccaataatacaggcctaaggagcgagaacaatgatgtgaagactttacattctctagaaattcattcagaagatacttcaacagtgaatcagaacaacgcaattacaggggttaatacagaaattaatgcccctgtattggcacaaaaatcgcaatttagtatcaatacgctcagtcaacctgaaagtgataaggctgaagcagaagctgtaacattaccacccgctattcccatattcaatgcttcttcatcaaggattttccgtaactcatacacctctatttcatcacgttcgagaagatcgctacgcttatcgaattccagattatcattgtccgcttcaacttctagagaaactgtgcatgataatgagatgcctctacctcaactgccgaagtcgccttcaagatattcattgtcaagaagggcaatccacgcctccccatctactaaatcaatacataaatcactttcgaggaagaatatagctgcaactgttgccgctagaagaacactacaaaactcggcttcaaagagatccttatactcattacagtcaatttcaaaacgttccttgaacctgaatgatttattagtctttgacgatcctctccctagtaagaaaccagcatccgaaaatgtgaataaatcagaaccccattcgttggaatcagactctgattttgagatcttatgcgatcagatcttatttggaaacgccttagataggatactcgaagaggaagaggacaatgaaaaagaacgcgacacccaaagacagaggcaaaacgatacaaaatcttcggcagacacttttacgatctctggggtgtctacaaataaggaaaatgagggcccggagtatccaaccaaaattgagaaaaatcaattcaatatgtcatataaaccatctgagaatatgtcagggctctcttcatttcctatctttgaaaaagaaaacacgttaagctcaagttatttggaagaacagaagccaaagagagcggccctttcagatatcacgaactcattcaataaaatgaataaacaggaaggtatgaggatagaaaaaaagattcaaagagaacaacttcaaaaaaaaaatgaccgcccgtcaccactcaaacctattcagcaccaagaacttcgtgtaaattctttgcctaatgatcaaggtaaaccgtccttatctctagatccccgccgtaacatctcccagccagtgaattcaaaagtggaatcactattgcagggactgaaattcaaaaaggagccagcctctcactggacccatgagagaggttccttgttcatgagtgaacatgtggaagacgaaaaaccagtcaaagcctcagatgtttcaatcgaaagttcatatgtacctttaacaacagtagcaacatcttcgagagatcccagtgttttagcagaatctagtacaattcaaaaaccaatgctgtctttaccttctagttttttgaacacatctatgacgttcaaaaatcttagccagatactcgctgatgacggtgatgataagcatctaagtgtgccacagaaccaatctagaagtgtagccatgtcacaccctttgcgaaaacaatctgccaaaatatctctaactccacggtctaatttgaacgccaatttatccgttaaacgtaatcagggctcacctggctcctatttgagtaatgatctggatggaatctctgatatgacatttgcgatggaaataccaacaaacacctttaccgctcaggcgattcaactgatgaacaacgacacggacaataataaaatcaatacttcgcccaaagcatcttcttttacaaaagaaaaagtaatcaaatcggcagcctatatctcgaaggaaaaagaaccagataatagcgatactaattatattccagattatactataccaaacacatatgatgaaaaagccattaatatttttgaagatgcgccctccgatgagggttcattaaatacatcttcttcagaaagcgattcacgagcaagtgtgcataggaaagcggtatctattgacactatggcgacaacaaacgttcttactcccgcgacaaatgttagagtaagtctttattggaataataacagttctggtatacccagagagactactgaagagatactttctaaacttagattgtcaccagaaaatccttctaatacacatatgcaaaagaggttttcttccacgcgtggtagtcgtgatagtaatgcattaggcatttctcaaagtttacagtcaatgttcaaagatttggaggaagatcaagatgggcatacttctcaagctgatattcttgaatcaagtatgagctattcaaagcgaagaccatctgaggaaagcgttaatccaaaacaacgagtgacaatgcttttcgatgaggaggaggaagaatctaaaaaagtaggtgggggaaaaattaaagaagagcataccaagctagacaataaaatatccgaggaatcttctcaacttgtgttgccggtggttgaaaaaaaggaaaatgcaaataatacagaaaataactactctaaaataccaaaaccctcaacgattaaagttacgaaggataccgctatggaatcaaatacacaaacccatacaaaaaagccaattctaaaaagtgtccaaaatgttgaagttgaagaagcgccttccagtgataaaaagaattggttcgtcaaactatttcaaaacttttcttctcataataatgctactaaggcatccaagaatcatgtaacgaatatatcatttgatgatgcgcatatgctaacattaaatgaattcaacaagaatagtatcgactatcaattaaagaacctagatcacaaatttgggagaaaggtggtggaatacgattgtaaatttgtaaaaggcaacttcaaattcaaaatcaagattactagcacacccaatgcatcatcggtaattactgtaaaaaaaagaagcaaacattcaaacacaagttccaataaagcctttgaaaagtttaatgatgatgtggagagagtaattcgaaatgccggacgttcataaattctatatagatgttatataattatacaacaataatttgaaaaatttaacgtacgagaaccgaatggacaggcgtgagaaaacatagtttaaaagaacattaataaatggagagacatgagacacgaaggaaagaaagagggttttacaaacattgtcctagattagaagataaatacaaccctggaggggtaaaaagagctgtcgtttcttttggagctcaagaagattcgtcatccaagagatcttcttcagaaagctcttcctcagagctgtcactgagatcttcctcttgcacgaattcttcatcatcgtcaaaattttcgtttacatcatcaccaagcaaggcatacttgtcggcatcattatagtattctgataggatgaaggtcgaataagttatagagttctcctttttttctatcgctttttttaaacttttatccacttcaatcgtatcatactgaaaattccaaaactgcttaaaatccttgttccagcaagctaccaaaatagtactaatcaacaaggaaggaacaatgtataataaagccggttgagcagtattgaaaatggacaaggagaccatggcagataccaaagaagcaacgtaactaaccatagcagtaataaaatattttccaacgtatgaccagttcaaaaagtggaattcagtgtcatcatgatcaaggtgccacttccagatgtcatatttgtagcacatcgcaataaacataccaggcaaggcaatatcacccagaccaagtattgaaaaattgaagttgttttgagctgtattaaacttgactggtaagcttagttttacgggaatatcaaggttagtagctactgtaaccattacatcggtaccaaagacaaagcaaatgtcgtaaaaaaatagagcaattaggattagggcccctgattttaaattcttcaattttaattgagcaatggaccaaatagccatattcatactgacagcattggatattaaccaatcattgggtgataaatagaaatatacggtagaaacgatggacagaacgaacgaaacaattaatgcgctattcaaatacatgttgctgatctgcctcttcgatttaatatccttcggttcaactaattctcttctgtaaaaatgcttcatccaatgatctttttcaatctcatccaatgttttcttgtgaacaactgagttggtcaatccatctttgtaattcaaattggtaacaaacccgcctatcttgttcaggtcttcgttatcatcagctattgttacacgataccttggtaaaacaaccaggggattccaagaagctaaatgtgataggtttctgaaaagtgagttgagaaagtaggagtagacaaatgtgccagctgggatatttagcagtgttatattaaaattcaaaattttcaccacatattttagccagtttaggtgtagtttcttgatcacaaaatagagagcgagtaaagtacagccactagttaagggcagtataatcgcatgtttttcatccatcatatcgaaaaacctcttgcttttcttctttttctttttatcttcgtcattctcgcggtagataacatgacagtcgtggtccacatcaaaatctgtaggatcaaacaatgagtgttctctcgtaggaggtagagctgtaaatggaatagaagaaatagacgtaaatgagccaataacgaccaaagcacttgcgatgagaactaaagtggcgtagttgaatactaaagaatggctttccaccaagtgtgtaatcttgtgagcaacgcgatatgatatcttatcaaaggcagtggttaatttgttattgtggttttcaactatagcattgatctgttcaaaaacttgttctaattccttgttcgacgcactttggttagcgcttgatgaattgttcctaaaggcacgagatgaccactctgaaaggtggtcaacaaatgaattcaaatacttgtccatcgtgtatgagtttgttccccattatagatctgtagtattgctcaaaaagggagcactttacaaatcttgtcctaaatactcccattcggagaggggttcttttttttccggtgcctcaaaatccttttttttttgatggcgcaaaagacacttaagaaaagtgaatactttttataaacgtaatcctataaaacatgaaaagaaggattacggaacgtctgcctgattcacttatatatactatatagatggtaaaaatctaacgtttccgttgtttcttccatttaaatgaaatttttcctgagagtctacgatttttttcttggaacccttcttcaacaattctctttgagcatccattctttgttggacctgtttcaattgagtttccctctgtaagtgctgcttgacttgcttgaactttttcaatttctttttgtctaatgattcctttggcattattgatgaagcgttcctattgtttgaaatatcttgggctaattggtccttagttaatctattttcagatctattcaccatctcggaggtggtattgaaaaacttctctggggtgaattcgttcatcttctctcgggaatcgacgaatattgtatgattcccactgcttttgaacatcaactgtttcgctcctttctccagctttttcagctctatttgcctcagcgtcctcacataattactatcttgcgttttgagtaatttaacttgatccatggaaagcgattcgtcttcttcgtcaccgtgacgtgagctgatcagcagtccttttgcatctgtcttccttgaatgcatagcatggtagtattcatctggatttctctcttttgctttttctctgaggactttcaaagtggactgcttcctgtggaagtcttgagcacgtttcacatagtctttatgcttttctaaaaacccatatctggaacggctagttagctgagaacgttctctatgctgctttttctgaacatcatgtacaagtttagccatatcttttgtctgttgttggctgtaacgaactagaaaaccccactagtattattcgatgatatgcaacttgctcttattgtagtttcttagcattgttttctttactctttttcttcaaatcgcgatgagctcatctagccataaaaaaatttcatcttttacgtgcataacgacaaacctttaagccttagaggacttggtgatgtgctcctttataacaacgattacttccattgaacagcaacacctgcaaaatcggagctgcaaaattattgattggatgtggcaaaaataggaatgggcgatcataatctgccggattttcagacatgtttgaagttttctgttacagctaaaaagagctttctatgtatgtatagagacagcgtctcaaaggaaaaattagcctcttcgatgccaagtacttgtgatatacaactgaagagggcaatcaatgacgcttatccgggcggaggaataaaggtcacggttctgaactcaacaactgcaagcttggactcgttagcaactacacatgttaaggaatttgagattgttatcattccagacataaattctcttttacagccagaccaagcgaaattagtaaaaattatgagagattgcacagtggcgattgagaaggcacagtcaacacgtatatttataggagtggttcattggaataatcccgtgcagccttcaggcgccgctaaggatggggatgaagcaggtaaaccagctcccaaaactcgcatcttcctgcccacgtctttccgtatgggcgcttggctcaaacacaaattctggtttgcatgtgcacccccatatttggattttgaaagttcaactgagtctagcattaatacaagagccaataatagcattggtatggctgaggaagagaagcaggagccagagagcaagaggtcgatcatattaaatgaagaggcaaatctgaacgatgtatttgtggggtccactgtaagacggtatattctcgatatcatggtccatttgcgaacgcatagattgacgtataacgccaaagccggcggggtatatacaaattcattggacgacgtggtgttattgtctagattaattggtctacatagcggcaagatgtttgtgtcaccttcacatgtcaaagaggcgtccaggtggtacttccccatgcacttggaattggttcagcgttcctccatggatagttccttattgtacggtagcgaccccaacttggtggacgaaatgctagagaaacttgcgaagattaagtgtgaggaggttaatgagtttgagaatccccttttcctggaatctctcgtagtgaaaaacgtactaagtaaagtcgtgccgcccgtgtaagtttattatgtatttcgagcatgcatctggaacctatgtttacatacgtacaaacggtatttaaaagtttctattcttagcgtcaattgccctttatcgttttgttaaccaattgttgtttttattcattatgccatgacccgaaaaatgagcaaaatcggtcaaagtaaatagctaaatatttggtctaaaaagtaagagagaaatgaaaatggcaaggcttaactactttgcaatagtgtatatagacattaccaattgagtccagcaacgaaagattccgcttgcacttggtcaatcatttactgaccataatacgaagtaatagagatgctactaaaagatgaccatgcgattacaatttacaatagacaattaagcgcaaggacaatcagtatgcattccatttctaatagacaaggtgctatgagtgaattgctagcctcccctttttattttgtgcggtcaccgcaagggacaaagcttttcttagaaaaccgtctgagaagcataacgtacgccatcccctagacatattaataatgctacagatactatgctgctcgtctttttttgacgacccttttattgcaatgtgcaactaatggcaaacaaccacatagtatcacagtattacattgcctccaccgatgcggatgttagggcgccaagtctgtcatgaagcatgttcctgtcataatcttgtatgcaaaataccgcgttctgcgccactgatatgctaggcagcagcaacctatgcagaagattgcttttcccacgcctgttttacgtctccagggcacttgaaacaatgcagcgatcgccgccacaacacgccaaagagaagcgaaagtgggcctgggcggcctcagtttcggcagaggtaaacaacacgaactgaactgccttagctccgaagggcaattccacaggcactccgcggggcccggccaaggcccaaaaggcgtggaatatgcgcgttttggggccataacacccagtaccacggccggaacgggccatataataagtttttcactctcaagaatggtaaacgtaaataggaacatcccactaccctagaaattgcggaaatttcgcgcttatcattagaaaatctggaaccgtcctttttcctctttcttgcatttccctttccgtattattgccattctttaactgcatttggggaaccgtagaccaaaagccaaacagagaaatgtaacgttctaaaaaaaaaacaacgaaaaaattgaaaaataagatacaataatcgtatataaatcaggcttcttgttcatcattttcaattctcttcttgccatcccttttcctatctttgttcttttcttctcataatcaagaataaataacttcatcacattcgctacacactaacaagaaaaaaaatgcaattctctactgtcgcttccgttgctttcgtcgctttggctaactttgttgccgctgaatccgctgccgccatttctcaaatcactgacggtcaaatccaagctactaccactgctaccaccgaagctaccaccactgctgccccatcttccaccgttgaaactgtttctccatccagcaccgaaactatctctcaacaaactgaaaatggtgctgctaaggccgctgtcggtatgggtgccggtgctctagctgctgctgctatgttgttataagaaatctctgattttttataatatctatatggcttttttcaaaattttcggttttactaggtaagtgtttgattcttttcttttcgttaatatatttttacacataattttaaataatttttgttattttgaataggtagataccataaaaataaaacactttttactttaacgatgttcctgtgatttctcttcgaatgagtcaaaaatttgaactcgaaatgaatgtattagagactgggtttcttcgagtttgctgagatcttggctatgcacaatgtttcctgcgcccctaaggtgaaaaaaacatgcatgcttgtttcaacagaccagtgtgcataaagaatttcgcccttagctgcgattaaagagtcaaggcgtgaaaaacataggcgaaagtgctgaccgttcttccctttatctttttaccatcttcgttatctgttacctgttcaaaagaaagtgggaaagatattggtgtgctacggtgggatcttttttttctgccattttctatactttacttccacttataaaatattttacaaattcaagggagacgtgtgacaaaataataatctagaactcaatgaacttttgtcctcactacaattgcccctcggatggatttgaacttacaagaaatatcacgttggcgcgcgctaaagtcgcttgccaatgcgctatgaaattttcatgacctggcacattttagcacagtgccattaatccctttattatgggcattgatgcgactttaaaactgtaccttccttcgcacatgctgaattttcttaatgagattcatctacgatgctttagagctagccttgttttcttttttatgcttcaagagtaagtagtgaagaaccccactagacaaatactaagggatgctgcaaccacgtcttatacttcacccatacataacattggaatctcattaatttttgcaaagatatggtgaacaagtttcaaaataagaatgtatgtgtaccgaatcgtagctcgaggtaataatgaaaaaaaaaatcggacatctggaaagttacgaatatagaagcagatacccctcttgacggcaaacattgtgtgctcgaccttctatcccgttaaaatatcataataaacaaacccctcccgcgaaaacaaaaaaagagagctaaaaaaagtacttcttcgcgttatagatggtgccgcaccgtacgtcataactaaaaatagcgttagccacagctccctgaacgaaaagggcccttcggcccgattggaatacgggtccgcttacgtctgtgcgtgcgggttgtcccacaacggtaacttactccaggagagccatctcgaaggtgccacaaaagaaaacaaaaaaaacaacaaacaataagctctgtggttcacgttcaatgtagtgttttttcaccttttaattttgataatttgtggtgcagaaaaaaaaaaagcaaacaaacaaaatctcaattatttaaaggacgatcttaacgtttctttctttcgctatcttccttgaattttttttctgtctgaagtaaaatatcccgtaacaaactaataaatactacgaaagtctcaaaaaacaataatgaaattctccactgctttgtctgtcgctttattcgccttggctaagatggtcattgccgattccgaagaattcggcctggtgagtatccgttccggctcggatttacaatacttgagtgtttacagtgataacggcactttgaaacttggcagcggtagtggctcatttgaggcaactattaccgatgacggtaaactgaaatttgacgacgataagtatgctgttgtcaatgaggatggctcattcaaagaaggttctgagagcgatgctgccactggtttttctattaaagatggccatctaaactacaagagctcttctggtttctacgctatcaaggacgggtcgtcttacattttctcttctaagcaatccgacgacgctaccggtgttgcgattagaccaactagtaagagcggatctgttgcagcagatttttctccaagcgactctagttcctcttcatctgcttctgcttcgtctgcttccgcatcatcttctacaaagcatagttcgagtatagaatctgtcgagacctctactactgtggaaacttcctctgctagctccccaactgcttcagttatctctcaaattactgatggacaaatccaagctccaaacacagtttacgaacaaacagaaaatgcaggtgccaaggctgccgtcggcatgggtgctggtgctctagcggtcgcagctgcttacttgttgtaagtacgagaacaaaacctgcatgttttatttccttcaatatagctttctacataatgatcacttacatatagcgtaatgtaatatgaaatggcccataatattctcttacattgtcctcctacctacattccttttcttgcatgcagctctcacattccccgattcgcttgaaaaatttaaacttgtagaaaagtaggtgaatgtcccgccggcggtttctctgctgcatgtagaaagatggatatacagaaaaggagataagagtagctatctcaagtttgttccactgactgctaatacgcatagagttgttatttattgtacatattcgaaaaaaagcaagaaatcactacggtgacctcagtagaacgaactaataagtcaaaccaaattaaccgtttccaggctgataggagaatacaagaatgtctgaaagaaaagctattaacaagtactatccaccggattacaacccactggaagctgaaaagctatccaggaaaatggctaaaaaactgaaaaccatgaataagagccacgcatcgattagattaatgaccccatttagtatgaggtgtttggaatgtaacgaatatattcccaaaagcagaaaattcaatggtaagaaagagctactgaaggagaagtacctggactccattaagatatatagactaaccatttcatgtccacgttgtgccaattccattgcatttagaacagaccccggtaattcagattatgtaatggaagtggggggcgtaagaaactatgtccctcagaaaccaaatgatgacctgaacgctaaaacagctgtcgaaagcatagacgagacactgcaacgcttagtgagagagaaggaaatggagcagaacgagaagatgggtataaaggagcaagcagatgacaaaatggatttgctggaaaaaagactagccaaaattcaacaagagcaagaggatgatgaggaacttgaaaatttaaggaaaaaaaaccttgaaatgagccagagagctgaaatgataaaccgcagcaaacacgcacaacaagaaaaagcagtaacgactgatgatctggacaacctcgtagatcaggtatttgacaatcacaggcagcgtaccaataaacctggcaataacaacgatgagaagagaactccgttgtttaatcctacatccactaagggaaaaatacagaagaaaagctctgtgcgtacgaatccgttagggatagttataaaacgaggaaagtctctcaaatgacctagaaaagtaaggaacgtacgattggtatcatgatctcttgtgatgctgtgctactgtggttgcttccacactatagcgtccatcgctacttacgaggggcgacagccccttcggacttcgaagtgtctggccgttttttcattgaattttcttataaatgaatacatatcggaaaagccattgttgactaaagcaagccaaagccacacaaaccgaggacaaatagaaaagcatggctccgtatccatacaaagtgcagacgacagtacctgaacttcaatacgaaaactttgatggtgctaagttcgggtacatgttctggcctgttcaaaatggcaccaatgaggtcagaggtagagttttactgattcatgggtttggcgagtacacaaagattcaattccggcttatggaccacttatcactcaatggttacgagtcatttacgtttgatcaaaggggtgctggtgttacatcgccgggcagatcgaaaggtgtaactgatgagtaccatgtgtttaacgatcttgagcattttgtggagaagaacttgagtgaatgtaaggccaaaggcatacccttgttcatgtgggggcattcaatgggcggtggtatctgcctaaactatgcctgccaaggtaagcacaaaaacgaaataagcggatatatcgggtcaggcccattaataattttacatccgcatacaatgtataacaagccgacccaaattattgctccattattggcgaaatttttaccaagggtaaggatcgacactggtttagatcttaaaggaatcacatctgataaagcctatcgtgctttcctcggaagcgatcctatgtctgttccactatatgggtcgtttaggcaaatacacgactttatgcaacgtggtgccaagctctacaagaatgaaaacaattatattcagaagaacttcgctaaagacaaacccgttattattatgcatggacaagacgacacaatcaacgatcctaagggctctgaaaagttcattcaggactgtccttctgctgacaaagaattaaagctgtatccgggcgcaagacattcgattttctcactagagacagataaagtcttcaacacggtgttcaatgatatgaagcaatggttggacaaacacaccacgaccgaagctaaaccataacctatacaggacttaatcacttagacagtatacaaatacacatatacatttatatttcatcgagaatgccatcagtaaatattatttgcaaaagtcgatcagcatattagtaaagcagtaaattaaaaggtaaaccaagtcacaatcgaccgattgccttgtcgaagtaaaagaaaaaaatttaagagcggctcccctttccccggaatgggaaatcacattatccgtgcggcgttttctgagcgaaaatcattgcgattgccaaacttttggtagccatctgggggaacttttgaccattttttccaatgatgaaaatgtattattggtgcgaatggcgctaaatacagaggtttttttttctccattccacccttagaagtttcttgttcaattctcattttaactgttgcgtttgttatcgattaatgtgttctgaactcgagtaaaagaacaggtgtgtgtgctaagtaagaagaattattacatttacccaacatgaggatggaaaaaacaacagacaaaccactttctgcaggagatatgaacgatgaatattctcggggtccaatcgacgatatagactgtttgaactttttcgaaagggctgttcaggacccatgttgtgaggcctgtgacacagaagatgcagatgaagaactgagagcaaagcttagtagcttcaattttcagcctgattcatctccgtgtaatgctaaatgtcaacagacactgaatccactgtgtaaaatagatgaagcactcccagcggagtcagaattagctccatcgagaaacggctcagtatctgaggcaaattctgatacaaattccatagcttctactgtccatgaccctgtcgactccaaatatggaggcatgcctagcttgagaaaggccaaaacaacgtcgtactttacttcatcttcatcgaacaataccacaatgaggaacccgctaaaaaaatgtaataccaatataaatggccttttagtgaacggaaggagctcaagctcctccagacagtctataccagagctctttagcggtgcgtgtactaaaaagaaaaacaacgtattactgaaaagtgaaacacccaattcagaattctctagtaactcacttcaacattgcaactcaaggtcgttttctctacccaggtcaagatcaaggtcttctgccattgccataccaacacatttgtatggcttggaaaagtacgtttcacctgggttggatactttgactgctgacccagaagaaagtattgaaaggttttcaaataatcggccccgtgaaatatcatcgtgttgtccgaacgatacaggggacacctcctcatcattatcacattcgaacacttcctcatcactaaatttccctttaggtacaaatacaaatcaattccaccaaccaaggcagccagtacaacagcaacagtcttcgaaaccaaactttggtgctgggaggaaaaaatctttcattgagatgtcactagcaagttcctttgcaggctaacattctcgccaccttggaataaccgtatgatgttcaactttgttatttatttccacattctggatcgccatctgttcgtttttattaaatataatatatacccatttgtatctcctgtttggtttccaaatttccatatacttatcgctgtctatcatctcctctcgaagcatttttttatatactatattatgagaaatctttctgaaaaattatgaattacttttttctgctgatagtacaacccgctatatactgttacaagtagtgaataaagaagtaaaaaaaaaaaaactttcaaaggaaagaatatgaagtgaacatttttttctacgattaagatccccctgtttcttttttctttttgaaccatcttgtcagcttacgggaattttgttctttaggaacatctgcgttaggaggtttcctcattatcctagataactttgtcggggaaaatctattccccaagttacctttaccttgcgagtttggaagcgtcaagtaatcatccttggctccattttccgatgatgttccatgtaccgatgttttgttgctactcttgggattctcatcacttacatcaatagtcaaaaatttacagtaactatctccaactgtgttattggatttactagagacaccttttgtgaagaatttctgcaatcttgcggaagagttttcatttgttggtttatttagtagtttaagaacaatttcttttccctcctttatttcttcataaaaaattttatgtgagagtgaaatggagtattttttgtcttcaaacaaagtgctggaagcacattcataacctgacaaccgttttctaatatgattaatcctattatagagtaaacatgactcttgctccaattctttcattgcatgcttttcctcttctgctttcgggattatagaattaaatttgatgcctgaattagcgccattatccaaatctctgcttctggaacctacatcatcgcttttcagtaggttcattaaatcatctccgaagatctccgtgttgttttcagttattttctcaaattctaactctccaatttctggcttaacctcaattggtgaatccaaatcttttttatccacagacaaatttaggctgctaccgcttaacaggccctcctcttcgattaattctcccttcccaccattatccatgtgattgtatttttccatcttggtcatatcttcctgactgaaattaacaatcaagttaacaaactcagtttctctcaaattcttatcaagcagataaggaatctgaggcaaatcatccaacatcgtttgttcaatggccaatttgggtctcgaaatagtagaacttaggttcaatatctttgaattaaaatctagtttcttttgcgtcattttatcaatgtaatctaataagtcattgtgtcttttatcgataaagttattcatcttcattagccagggctctttgtttgcaaactgcgtcaaagtggacagattaagtaaaactttacttattagggtaagattccttcttgctgtttcgtttaaattttgagaaacatatttgaatagcttagggtttaatatgactggacaaaaaaaccttaaaaacaataatcctgatataccattcaaaattatttgcaaagtgtcatcgatacaaattatctctagtttttgcctaaagatttttaaaacatttcttatttcaatcggcaggtcattactcgttgcatacagccttttccaaatcttcgtaacccaagaatacaatcgtttgtagttgtcggcaattattttcctcttttttacttcatctttttcttttactctagcaggatccaattcacatgatttgtttgactcaatgatctcttttagtattgcactaagcgctttactcaaatattcattacccactctgaaaaagtactgttcaatcgactttgttaagatagagttaccacggaataaactgttgaaaacatgctttgagtctaaatttttctggtttattcttgaaaccgttccatcaattttagccaattctttgtctataaggacgtggaaccattcttctattcttgacaaagattggaatatatcgagaaaaattatggatgtttgcgtcaatttgttatcattctccattgatgaagaagatttgtaaattagattggaaaccatggacaagtttgcgttcatcaaaagtttttccaatttaacgaaattggttgacggtaaaatgaagttcaaatttgaagaaattttaatacagattgttcctatttgaaaatttttgttatcaacgtccatgatgggtagtcttgtttccttattatatcttgtatcatttattatttcttgtgtgatttttattttgcctatcaatcgtaaccgttttttattattgagatcgtggaataactgcttgatttccagataagaattagtaagtcttaaaagttcattgaactgaaactcttctctccaaaatggattagaggagtttgaaaccatggatgttctagcccatgtatggccccaggccgttatgtctgtgaatattgaccatggcgtattattcttgtcatttaaattgattgactgaaaattagcttccagtatggaaattttaaagctattcgatatcttcatatcatttgatttatctgagccagtaatagataagtattccgacctagcgaacgattgtaacgctataaaacaatcctccaggtctattcttaagggaaactctacaataatttcttgagaaatatcactagagttggtggcagcactggcaatattttctatgcgaaacttttcgaggcccaactggctccttagtaatggcaattcacctaaaaacaaactgttttcactttgtaaaacagatgaatccagaattcttatctctgatcttaaaagctggctaatattcaatgagtaaatcagagagccgtcactctgtaaaagaagatctagcatgccgtttgatttaagcacccccatagcggaaaaccaacctacgctgttgtcatcattattaattatatcagggctttctaaaatatttgttgctggcggaaggacgatgttcttaacgatgggcccaaaaacattcaatttgtaaaccagcaaactttctggtttcgccatttttttgcttttaaattctagaggtcgcgatacttgaaacttattaaatataccatttgtcttcattgagctccaccagatcagacatgttagcaatttcttgaaatcactccaacttttaactcgcaggtaaactttattatctttacctgaggtgtttacttggattataaaattacaatttgcattaatatccttaaaagaggaatgcttatccttaataatctcgattctacattgctgtagatgtttgataattggctgaatattagtagagtctgctgttaactcatcgattgagtgggttagtgcacctgtactggtaatttgcagatagtgtgtcttccagtcgtttaaggacaggttattacaccactgaatctcacccttaaaggtattcttgtaatgcttaacgttggacaaaaattcattcaatttgaaatatgatgttcgactttgggccggttcattgttggagctcataatatgatacaatcaaagataaacaccacgacgtatgcacggataaagttttcagtctgaccgagtagttattcctactattttgttgtttcttcctccgttttcataaatggcgtttgtttggatacctttcttttttatcgaacagaacgcgttcaagaatgaaagtcattaattattattagatacagagatatacatattatagagtatgcatgctatattcacggaaagctacgacgaaggcctgtatcatagttagctggtaacagtaaatttaccaaaaatgttgggaatttcaccttctggtccgatgtatctagggtctctccagggaccaatatcggaatagtagaacttatcattagggttgtgcaagacagatgtaccaccatatttaacaggcaagttctcgattggaatttgttttaataattcctttttataagaagagccaagaataaagatttttgacacggttactggatccaagaagggtttaaccatcttgaacatcgtcgagaaaccaaatggactgtgtataatataaaacttacccattctttcaggataataattttgactgatatctgcaacatctttaatataggaaagcacatgataagcattagaaagtgagatacccttcaagtccagcacagtgcacgaagtttcaataaggtagccagctcttctcgaacacgctgggacccggtacgtggcaaataattcgtactccttgactaagtttcttagcatctgtttttcggtagtgatcttgtacattttctttaagttaattcctcctagttcttcgaagtacaatggtctcccatccttatcaacgtgatggtaatactgagggtacattttggccaatttgattctttctttgtcttcggcttccttgttgttttcataatcctcgataatagtgttggcaccgtattcttccctccatcgttcagtttctacaaacatctcaacgctagcattgatatcaaatttccttgcccgtagaaatcgcaatagcgtagaatcatccagcctttctttgtaattcttttctaacaagattgacctaaattgcaaaagcgcttcctcttgctccttagtcaaattgccgggagtacctggcaaagcattgggggagcatatttgaggataagtatcgagtatgctggttgtcattcttcctttccagttttaacagtgcgcaaatgtattgcttttcagatttatttccccgttatacaagttcaaggaaatgtttgagtagagagaatcacgatctaaataataatccgaagaatttaaaaaggagtaaataggggcatacaagagggggaatttcagaagtgcctgttatgtaaaaaagatatgataacacataatggattgcataccagtaaatttccatatgtactatgccgacctcttttcatgtaaacgccttgcaaattcatacttaatgattacaagaaagtaatatgtaaattttaagctcaggttcaaggtttataagggccttcgtctctgatagaagaatcaagttggtaaatccaaatggaagtacgggtcccaatagcaggtttgatttttgaaggtgactcgagatatatcagctgccgcccctgaatcagcagtaattataactgaagagaacggacaatgttttacgtataattaaggcacataaattccatctggagtgttctgaagtcgcttacttggtgagatattgaggtgtcatcagataggacaatagtaggagaaaggaccatctggaggttaatcacctgttgtcttactatccggtcctcagggtccataaaaaaatactttcaacaaaatctggatgcattgaaaaggttgttttcaaacagtctgcagtttgtaattcacccacatgcctttttttgtattcatattagcttttcttgcataattagggacatataaatcgtgcacacatggatatttcttcataatattatagtctgattgatattcaaaatttgaaacatttccataaataatggataggggacagccaaaaaaaaactgttgtgctcgatcctgaatggaaaagactgacactataaggagacttattctagatatcgtagaacaaacatatgttactttaacgtcgctggacactcacagacaagcctcaggggagacgtttgaaaccgtagaggaatacgtatgaaatataaatcaacaaacatacgtactgaattatgtatcaggatatattgctttcacagtttggaaattgcctctatcaccaagatattcactgttaaaaaaaaaaatgcgaaaaaattcaaatttcaacagcgatattcgccttcagtatatcaatataaagcaattatgacacctcatttatcgtgcatataagatcatgcaatgagtatggataacaatgatgaccatgaatctaaattgtcaatcttgatggacatgtttccagctatttccaaatccaaattacaagtacatttacttgaaaacaataatgatttggatttaacgataggcttgctgttaaaagaaaacgacgataagtctacagttgataatgaattacatcaactgtacgacatgtttcctcagcttgattgcagcgttataaaagatcagtttgtaataaatgagaagtccgtagaatcgactatttctgatcttctgaattatgaaaccctgcaaaaacttaaagacaatcaagcaaattctcctgatagcgtaaaaaggaacgaaaagaaaaataattgggaatcaacaaacgatcacatagagagtataataaagtttaccgacgctcccaaaaatattgcgcaggaatacttagccgaaaatggttttgatacagtaaaggcgatcatcaaaatcattttggattattacgacaaaagggattttaaaaaagatgtggatactttcaaagtaaaacggagtcctaatacgactgtgagaggtggtcgagttcaatcatcgacggggcttgcccacgttttgaaaaagggtaaagaatccgcaaatgttgctcaagagagtctcaaaaggccaaggagttataagcactccttggatagtccgcagatggttgagttaaatgaattagttgcagataatcgcgatctcaaagccataaaccatgaatttttgcaaaaatgcctgcaattttatgatggagatgttgtaaaggtgttgaacatatcgtccttattgatcgaagatgacaagaatattacgaaaacttggaactttgacgaaggttttaccttgacatccagagataattgtaagcaacatttacccaaattttcaacaccgcagatttcccgcagaaatgaggtaggaaatacttataaattgccccttcatgacaaagaaacccccgagggagctgtgccggttataaataacctgtttcaaacatacagattggatttccatggttttcttcccagtgaagcggtttcaacactgaaacttgcattaaataagtggtggtccaaagaggtagcagaacgagagttgaactcccacaacataaactcatatggctcaaaagtacagtttgtaagcccgttaatcgtggtaactggtagaggtatccacagcatcggcgggatctcaaaggttcgactgcaggttaaaagttttcttgaaaaaaatcactacatattttgggaagaatcttcctacttcagaattgagggtaagaagaagaaataaaacctatctgatttttctataaaggttataaacgctaggcttctttaaactgcattgggttttttctcaatttcgagaaaaataatataacgcgttagaaatggtgatgtaaataaatgaatgttagaaaaatacatacgttaaacaaataagttagacattagcacaggacagcacttcactcatggattatatgaaattggggcttaagtcccgtaaaactggtattgatgttaagcaagatatacccaaagatgaatacagcatggaaaatattgatgattttttcaaagatgatgaaactagtcttatcagtatgagaaggaaaagcagaagaaaatcatcgcttttcttaccatcaacgttaaatggcgatactaagaacgtattaccgccatttctacagtcatataaatctcaagatgatgaagttgtccaaagcccatctgggaaaggcgatggatcaagacgatcatctttgttaagccatcaatcaaacttcctgagtccagccaatgatttcgagcctattgaggaagaaccagaacaagaagaaaatgatatcagaggcaatgattttgccacaccaatcacacagaaattgagtaaacctacatataaaagaaagtactccactcggtatagccttgacacttcagaaagcccttctgtaaggttgacacctgatagaatcactaataagaatgtttattcagatgtacctgatttggttgctgatgaggatgacgatgatagagtaaacacttctttaaacacatctgataacgcattattagaagacgaattagaagatgacgggtttatacctgaaagtgaagaggacggtgattacattgaaagtgactcatctttggattcaggctcggattcagccagtgattcagatggagataacacctatcaagaagtagaagaggaggctgaggtgaacacaaatgacaatgaagatgattatataagacgacaagcgagtgatgtggttcgtacagattcaataattgatagaaacgggcttcggaaatctacaagagtcaaggtggcgcctttgcagtattggaggaacgaaaaaatagtatataagaggaagtccaataaacccgttcttgacatagacaaaattgtcacatatgatgaatctgaagacgaagaggagatattggcagcacaaagaaggaagaaacaaaaaaaaaaacctacaccaaccagaccttacaactacgtacctacggggagaccaagaggaaggccaaagaaggatccaaatgcaaaggaaaatttgattccagaagatcccaacgaggatattatagaaaggatagaatctggaggcatagaaaatggcgagtggctgaaacatggaatactggaagctaatgtgaaaattagcgacactaaggaggaaactaaggatgaaattattgcattcgcgcccaatttgtcgcaaactgaacaagtaaaagacacgaaggacgagaattttgcccttgagataatgttcgataagcataaagaatattttgctagcggcatattaaaactaccagctatttctggacaaaagaaattaagcaactcatttaggacatatattacgttccacgtgatacagggaatagtcgaagtaactgtatgtaagaacaagttcttgagcgttaaaggttccactttccaaataccggcattcaacgagtacgcgattgccaatagagggaatgatgaagccaaaatgttcttcgttcaagtgaccgtttcagaagacgctaacgatgacaacgacaaagaattagacagtacgtttgacacttttgggtaattatgatgtgaatattctcattatgcatgctatgtactgaagaaatataactaggtccatacgcttatactgttaaacatgtgaacttttctgtaagaaaatgaatcacgtaaaatttcgcaccgaactttcgtagatgagagaacaaaaagcagaaaaagagaaagaacagtaaagtaacacttagttagcatatttaaataaaagtctaaaggaccagcaaagagttattaggtgtgatgacggatgaaaaagtgaactcagatcagaatatgaacggtaagcagggagttaacttaatttcatccttgcctacaacacaagtgccggtttcaattttgaccaacaaggagagaagaaaaagtattcacgatgaatcaaatttcgaaagatctgatagtcatgaagatcaatcaaaatccaactctaataggaggaatatttacaaaaacgattatagcacaaatttgagggatttctcttttgccaatctgaagcaaaatagtgaaaggaacaaagatggccatgaaatacagatcaacaccagtatgccagctaatacaaatggccagcaaaaaaggttttcaccttcattaccttctgctgtttcatttacggtgcccgaggtggaaaggttgccgtatcatagatattcgatatccaataaacctggaaagcagcagcagcagcaggaacaactgcagcaaaatcaacaacaagaagagcagcaaaaggcacaactgcaggagcaaaatcaacgagcaaaacagcaagaagaggtgaagcaaattcaggagcaagtgcaaaaaaagcaaactgaaagacagcaactgatagacgaaaaggagaggatagcgaatgcaatatttaaggagaacactactaatgatggtactgatatcaggaaacattcggtatcgagtggtacgagcaatagcgaagatgaagtagattcaccttcgatggaaaaaaattctatcgttcatatgccaggtgattttatctacttcaatcccaagtcaaacgcttctaaacctatcactgcaaaggcggcgccattatcggctaataactccacacataaaaacaaggaagttatcactgcacccacagggcctcgtgtacccttcacagagttctttcagaaggaagacgacaagaaattccacattctcattggtgcgacgggctcagttgccacaataaaagtacctctaattattgataaacttttcaagatatatgggcctgagaaaatctctattcagttgattgtcacaaaacccgctgagcattttttgaaagggctcaaaatgtcaacacacgttaaaatttggagggaggaagacgcttgggtattcgacgctgtgaataagaatgatactagcttgagtctgaacttgatattgcaccatgaattaagaaaatgggctgatattttcctgattgcgcctttgtcagctaacacacttgctaaactggccaatggtatatgtaacaatttgctaacttctgtgatgagagattggtcaccactgaccccagtgttgattgcgcctgcaatgaatacattcatgtatatcaatcctatgacaaagaaacacctgacgagtttagtgcaagactatccgttcatccaagttttgaaaccggtggaaaaggtattaatatgcggagatattggtatgggtggtatgagagaatggacagatattgtagagatcgttaggaggagaatcaatgaaatacggaaagctagggacgaggaaactggtgataaagagcaagaacaagaagaacaagagggtgctgacaatgaggacgacgatgatgaggatgacgaagaggatgaggaggacgaggaggaggaagaagctctaaatgaaacagcatccgatgagagcaatgacgaggaagacgaagaggatgaggaagacgtgaaaaccgaagtttaaatgcattagaaaagagtattttgtgttatgttttatgttttattttttttttttttgtttattccttaaaagaagattactgctttttcattccctagtttctaaattgagtgcctaaataagattaaataaatatgtatgtggaaactagggagggtatgtttttatttacaggaatagttgtagtaattcaaaagcctaaagatttccagaaccgtaatctaaagccctcaaaactgtttaattttggtctaacatcgagataaataagtggttgttgctgcgagtttgcatcgttcagatcggtggaatagaaatcgattacgtagtcgacggttttaccgcatctatctatctgccaatcatgtctatcaaaaggtttggccaggtgcaagatacgggacctgaaccaggcccttggtgtcagttttttggaatcacctttaaaatttgttaatttgataccgccacacgcttcaccaccctgcttgtcttcccagcttttaatgtagttccaaacccgctcattgatggagttatgtaaaggcacaaccaccttcatgtcatctgagttcggatcccaattttttttcatcattgcctcgtaaaattgtttctccgacgggtatatccagtttctgtcagaattcgtccttggtatggtggaaacctctctggactgagagagatccaccgtggtgtgatattcaggcgttttatcgttatcttgtgggtttgcagagcactctagttgattgcctggggcagtagcaccaggatgcgcttcgttgccatgttctcgtagccataactttttggtttcctcatctacggggcatttcccctgttggtctgaagacatcataatatgtaaaatagagacgaatgaaaagcacgtgaactaacaaactatttactactaccgaaatgtgatgcttaagcctttggcctctgcaatactagcgattgctttttccctgattagtaagctacatcatttatactacatctttctgtcttagaaggcttacaaacatcgaaaagctggaactttgatttcgaaaaaaatatgccgttacccgttgcgggtcccttttttttagaaggccggcccagaagtcgccattatttttagtcattacagtagccctgttgggtaaggatgcgatgcaatacatgtcaagaggtgttgtatataaaccacaatatctaccatcaatgagctatatatacttttcttactgaaaaaaaaaactacaaaaccaagtaaaaaaagaacaatatgtcactacaaagcaacagtgtaaaaccaacagaaattcctctctcagagatcagacgccccctagcgcctgtgttggatcctcaaaagatcgacgcaatggtggccacaatgaagggcattcccaccgctagcaagacatgctctctagaacaggctgaggcggctgcctcagccggggaactgccgcccgtggacgtgctgggcgtgcgagtcaagggacagacgctatattatgccttcggcggctgccaccgtctacaggcatacgaccgccgggctcgcgaaacgcagaacgccgccttccccgtgcgctgcagggtgctaccggccactccccgccaaatccgcatgtacctgggcagcagtctcgacatcgaataatgattacgctaataacactacataagaaacatagataaattataattcactaatacaaaatccctcaatttaattaatcaatttcttattcaacaactagagtaggcactagcagtttgtgcgaccctcggcgccggagaggtacaagggacctggcggttgggccttcctgccagcttctcccccccttctcggcattcactcagcgttcattggctcaatcacgcgccaagcggattcccagaaaaatacaaaaaaaagttgccataatacaatggcggatattacaatatatatagcttgcgctttaaaaagaagtgttagcacgcattgggtgtttgtactgtattcctccacttaagataacgaatacacatatagatatacaatatattatacgtggacatctacggaaaggaagaaaaaaaacaaaaggaaaaggaaggataccatatacaatgttgtcaagagtagctaaacgtgcgttttcctctacagttgccaacccttataaagtgactgttttgggtgcaggcggtggtattggacaaccattgtctttgcttctaaagcttaaccataaagtcacggacttaagactgtacgacctaaagggcgcaaaaggtgttgccaccgatttgtctcatattccaacaaactccgtggtcaaggggtttactccagaagagccagacggattgaacaacgctttaaaggacacagacatggttttaattcctgctggtgtgcccagaaagcctggtatgacacgtgatgacttgttcgccatcaacgcaagcatcgttcgcgatttggcagcagcaaccgccgaatccgctcccaatgctgccattctggtcatttccaacccagtcaattctaccgttccaattgtcgcccaagtcttgaaaaacaagggtgtttacaacccaaagaaattgttcggtgtgactaccttggactctattagagccgccagattcatctcagaagtcgagaacaccgatccaactcaggaaagggttaacgtcatcggtggacattctggtattaccatcatcccattgatttcgcaaacaaaccataagttgatgtctgatgacaagagacacgaattgattcacagaatacagtttggtggtgacgaagtcgtcaaagcaaagaatggtgctggctctgctacgttgtcaatggcccatgctggtgctaaattcgctaacgctgttttgtccggtttcaaaggcgaaagagacgtcatcgagccttccttcgtggactctcccttgttcaaatccgaaggcatcgaattctttgcatctccggtcactttgggcccagatggtattgaaaagatccatccaataggtgagttatcttcagaagaagaagaaatgctacaaaaatgtaaagaaaccttgaagaagaatatcgaaaagggtgtcaactttgttgctagtaaatagattgttcaagatcagaaatagagtgaaaaatagggaaaaaaaaaaaaaaattctactaataagaacggaagactactcgccatcatgagattacgacatcttttttatttaattctttgttatatttagccaattgaaaggaaggaaactgccaaaaatcaactagagaaaaattcatgctattcgttgctcctacacctttttttcttccgtagacgaggaaaaacaaaaatgattaaataggcgcgcgcggtgtgatggtgatgataatgatgatgatgatgataatgatgaataaacgtttcggtttacgagtttctttaaatatacatatatgatataaaaaaaaaaatacgtaccacttacaatttgcaaatatagatgatcgaaactgccatttatggtaagacagtggatgaccaatctcgatgtgtccactggcatcttccaaaggatgtaattgccatcaggtttaaatgttgtgataagtactatgcgtgctttgaatgccaccaagagttaagttctcacccgctagaaaaatatgatctccttgacgatgcaaataaacacttgattatttgcggagtttgccgtcatgaaatgacgtttgcagagtattacgactacaattcaaaccttatttgtcccaattgcagatccccctttaatccaggctgtaaattgcactaccatttgtatttccagaaccctccccccgctatgtgttgagtgttgttctataaatgcatgccatcttaagctctgctgtgctcttctcgttaaggaaaaaatgcgatggtatatatatagatatatatatatatatatgtatctgtatatatatgttcatacatatatatatatctattattgttgttattattatcgtgattattatttaggtcctcccttctttttacctgtttttaatctaccctcaaatccggctcttttctttggtacggcactaccgacatactttcttttcatcttttcttgcttatttctctttttacccttgttgtctttcctaatcctcagattctcttctcttctcttttgtctttcagatatcgtgtcttccacaaccctcttacgttcgctccattcaatcgcagactttctcttttgtgcttcctttctctttatagctttgcgaagtagtttttcgtcatccctaatcttaattccttctgcttgtaacatagccttttgccatttttccttttccttctgcttgatttgttctagttcgtctttcgcctccatcttattcttcttggcttctaataactttaagtgtgattttacatcattcttagccggacccttcgttctaccagcttttcttaacctttgtaaatctgaagtggcccttgcaccatcatcgaatatgatattttgaaacattacaccatctgcgttaatttctgagtccttcttgccttttttgaatctttttttcgaattgttttctaaatcactatcgatgtcttccatatcggaatcagacgcaatttcatcctgatcctgttcctgttcactttctagacgctttctttttttcaactcttccttgcgtttcctttgagcaagaatagcctctctagaaccgggtgctttccttttactcttcatatctgaaattttcgcttgtaacttggaacgtagtgcttccaagtttttctttctttgtagtttctcttcctctgtaatagacttcttttcgacagatctatcgggctctgtagtatcttttttagattctaatggtatttcatttccctcatcatcaaagatcaccttaatatcctcttcctcttcttcatcttcgtctggtgctattatcataggatcgtttacttctacgttcaggtcggagtctccttccacttttgatgttgcttccttttgcttttgcattttcatgtgcttgaatttttcaccaggtaggaccaccggctttgcgtctttctccttcttcttcattacttctaatgtactagatgtttcatcatcacgttgctccgggtctaattttttcagtttatcatttttactctgttctttggttttcttcttggccttccattgctcttgacttttttcatcataatagtattttgcaggaattaaagccaataaaccatcgaaggcgcttgaattagcacgaaggcgctcctcaagtgaattactcatctcagtctcctatatctttcaattcccggactttctttatcacttgcaacaacgtctcagtcctcacttgttattcatctcttggtcatctcatctcttttattgtactttcctcttttctttaccggagatgagaataaaaagaattcattttaaaaaattttcaatttggtgtctgggtgaaactttttaatcgtgtaatcccaattaaaccactctactttactttaattggtacacgaactcattacacacctttgcctctattgcttgtgtcaatcgtgttgagagaggaagcccaaaacaagggaaattaacctctgtaggcaagccatcacatttggcaatagcagccctcatttaatttaattcggcatgtggccggcagggtaatgcgctctgctgctgacaaaattgaaagaaaaatttttttcatcaacagtttgcaatactttctttttcatatttaattcatccattccgtcgttaattttgttcaaaactggtgtccatccttaataccaactcaattctttgattttggccctcgatagattcaagatgtcccaaggtactttatacattaatagatctccaagaaactacgcttctgaagctttgatttcttactttaaactagatgtcaagatcgttgatctagaacaatctagcgagtttgcttctttgttcccattgaagcaagcccctgcatttttgggtccaaagggcttaaagctaactgaagctttggctatccaattttattgtatgttccatattttattttaacacttccacatacattgttttgcgcgtttcccgttcgtttatttggcacgtcatttttcttcgaaacataatgatgaaaaaaaattttatcaaacagttatccctgtctgaatgggtaataataggtaacctctcatatgttgatatttgtatttctgatatgtttcttaaagaaaaatgaaagtcaaaataacaaaaaggaagtacaaagcgtgtcctaatccaggaaaaaatataaaggattgttttactaacatttcttcaattaatggttgtataaccatcgagatgatgtatatttagtggctaatcaagttgccgatgaaaaagaaagagctcgcttattaggttccgacgttatcgaaaagtctcaaatccttagatgggcatctctagctaattccgatgtcatgagcaacattgctcgtccattcctttctttcaaaggtttgattccatacaacaagaaagacgttgatgcttgttttgttaaaatcgacaacctagctgctgtcttcgatgctagattgagagactacacctttgttgctaccgaaaacatttctctaggtgaccttcatgccgctggttcttgggcttttggtttggccactattttgggccctgaatggagagctaagcatcctcatttgatgagatggttcaacactgttgctgcttctccaatcgtgaagactccatttgctgaagtcaaattggctgaaaaggctctaacctacactccaccaaagaagcaaaaggctgaaaagccaaaggccgaaaagtcaaaggctgaaaagaagaaggacgaagctaagccagcagatgatgctgctccagctaaaaagccaaagcacccattggaagctttaggaaagtccacatttgtcttggatgactggaagagaaagtactccaacgacgacaccagaccagttgctttgccatggttctgggaacactacaaccctgaagaatactccatctggaaggttggttacaaatacaacgacgaacttaccttgactttcatgtccaacaacttggtcggtggttttttcaacagattgtccgcttctactaagtacatgttcggttgtttagttgtctatggtgaaaacaacaataatggtattgttggtgccgttatggtcagaggccaagatttcgctccagcctttgatgtcgctccagactgggaatcttacgaatacaccaagttggacccaaccaaggaagaagacaaagaatttgtcaacaacatgtgggcttgggataagcctgttgttgtcaatggcgaagataaggaaattgttgacggtaaggttttgaaataatctcaataactcttcttccatattttcttcccaatatacataagagtcaaacaaaacgaattttcaaaagaaaaaagaaaaaaaccctgaagtctacttcatgattaccccatacttacgcgtggtttaattctatgtaacgattaacgtccatgtaatcattatatatatatatattgtaataatctctctaattgagtatcacaatctgctgcggttactctaacaatattttgcataaacttgattcttctcttcttatttcatgtttcagtggggcattttccattgtacttttgcaacaatagcgaaaaaaacaattttccgtaaagagaagcgtcagtcataaacggtgtatgttacccgaactggaatgaattttatcttaagactggaaaacaatttaggatagaactgaagatagtgcaacacgtctggtgatatcatgtgctttcaagcaggatttgtcacagtgctttagaaacacaaacaaaggaggtatatagaagttgcagttgctagagtttgttttcttacctaattctagatcaattcttttttctgaaaaaaaaaaatggctactgcgttatatactgcaaacgatttcatattaatctcgttgcctcaaaatgctcaacctgttaccgcccctggctccaaaactgattcatggttcaatgagaccttaatcgggggtagggcatttgtttctgatttcaaaattcccgaattcaaaattggctctttagacacattgatagttgaatcggaagaactgtctaaagtagataaccaaattggggcttctattggcaaaatcattgaaattcttcaaggcctcaacgagaccagcaccaatgcttacaggactttacctatcaataatatgccagttcctgaatacttggaaaattttcaatggcaaaccagaaagttcaagttagataagtctatcaaagatttgataacattgatttctaatgaatcttctcaattagacgccgacgtcagagctacttatgcaaattacaacagcgctaaaactaacttggctgctgctgagagaaagaagacgggtgacctttctgtcagatccttgcatgatattgtcaagcccgaagacttcgttcttaattctgaacatttaactactgttctagtagcagttcccaaaagtttaaaatccgatttcgaaaaatcgtacgaaactttatccaagaacgttgtaccagcatctgccagcgtgattgcagaggatgctgagtatgttttgttcaatgttcatttgttcaagaaaaacgttcaagaattcacaacagctgctagagagaagaaattcattcctcgtgaatttaactactcggaggaattaattgaccagttgaaaaaagagcatgactctgctgccagtttagaacaatctttgcgcgtccagttggtaagattggccaagacagcttatgtcgatgtttttataaattggttccacatcaaggccttgagagtttacgtggaatctgttttgcgttacgggttgccacctcactttaacatcaagattatagctgtcccaccaaagaatctctctaaatgcaagtctgaattaattgatgcttttggatttcttggtggcaatgccttcatgaaggataaaaaagggaaaattaacaagcaagatacttctcttcaccaatatgcttctcttgtcgacacagagtatgaaccatttgtgatgtatataatcaatttataatcgatttataatactaacttagattaatatatatttctgttttttttttagaattttcaacttttttattcatagagataatacactgtgattgtgaatgtttgaatagtaatggaacataatccgataaaatatgcttttgatgaacgattagacatttttcaattttgtcgttgagttccaatccttccttatttatggttaacaaggaaagaggtggaagttaaaaaaatggaaattaaaaaaaaaaaaaaatcaaaaaaagaaaaataaaaatagaaaaattggcacggaaatctacaggatttagcactagtagggggtttattaagcactacaggtcgactttaaaccagaaaaaattatcattcagggtaggtgcaaacttgttaaaatgcactggaatataatttcgaaagagcaaagtagctcttctgtatcgttaccaactctagacagcagtgaaccctgtcacatcgaagttatcctcagggcgatacccgaaaaaggattacaaaacaatgagtcgaccttcaaaatagacccatatgaaaatactgtgctatttcgcacaaacaatccgttacatgagacaaccaaggagacccattcaacatttcaattcgataaggtattcgatgctaacgccactcaagaagatgttcagaaatttctggtgcatccaataataaatgatgttttgaatggttataacggtactgtaataacatatggaccaagtttcagcggaaagtcctattcccttattggatcaaaagaaagcgaaggaattctaccgaacatatgcaagaccttgtttgatacgctagaaaaaaatgaagaaacaaagggagatagttttagcgtaagtgttttggcattcgaaatatatatggagaaaacgtatgacttattggtacctttacctgaaagaaaaccattaaagcttcaccgttcttcaagcaaaatggacttagaaatcaaagatatttgtccggcacatgtcggatcgtatgaagacttaagaagctacattcaggcagtccaaaacgtcggcaataggatggcatgtggcgacaagacagagagatcaagatcacacctagtttttcaattacacgtagaacaaaggaatagaaaagatgatatattaaaaaatagttctttatatctggttgatttacacggggcagagaagttcgataaaagaactgaaagtacgctatcacaagatgcgttaaaaaaattaaaccaatctattgaggcgttgaaaaacactgtgcggtccttgtcaatgaaagagcgtgattcagcctacagcgcaaaaggatcacatagttctgcttaccgtgaatcgcaattaactgaagtgttaaaagattcccttgggggaaataggaaaacaaaggtgatattgacatgtttcttaagtaatgttccaactaccctatcaacactagaatttggtgacagtattagacagatcaataacaaggttacagataacaccacaggtttaaatctgaaaaaaaaaatggatctatttattcaggacatgaaaattaaggatgataattatgttgcccaaattaatatactaaaggctgaaatagactctttaaaaagccttcacaataaatctcttcccgaagacgacgagaaaaaaatgttagaaaatacaaagaaagaaaatatcaaactaaagcttcaattagacagtattacccaattattgagtagttctaccaatgaagatcctaacaatcgtattgacgaagaagtttctgaaatattaacgaaaagatgcgaacagattgctcagcttgagttatcttttgatcgacagatgaattccaattctaagttgcagcaagagttagaatacaaaaagtcaaaagaggaagccttagagtctatgaacgttaggctactagaacaaattcagcttcaggaaagagagattcaagagcttttaactactaacgccatcttaaagggtgaactagaaactcacactaaacttactgaaacacgcagtgaaaggataaaatctttggaaagttctgtcaaagagctttctcttaataaatctgcaatcccatctcctagaagagggtctatgagctcgtcatcaggaaatactatgttgcatatcgaggagggttctgaaatatcaaatagcccttggtcagccaatacttcctcaaaacctttagtatggggcgcgagaaaggtttcttctagcagtatagcaaccactggatcacaggagtcttttgtggcaagaccgttcaagaagggattaaacctccattcgataaaagtcacttcgagtactccaaaaagtccctcttctggaagctgactataattaagttcgataattgtacgatacaactgtgtagtatctttgtaattataatcatgatgataacgctaataatttgtacgtataatgctgactgaaagatgtacttttcttctaccgtttttcttcggcggctattcgtttacaatgatttggaaaaatgagaaaaattgaaaataaaaaattctgctcgatgagatgagatgaggttatgatatatatgtaagaattcctcaagaagaggttgcaagagtctgcagacattatcatggcagcaaatagcaatagtagagttgcatcaaaccatacttctaaaaaacaaaaggttaggaggaatatacatccattcacgaataacactcggattaaaagagctagtaaaatcgtaaagtttaatgattcaggcgagggcgaccatgtttcagaccaacgttcgaacaaggaaaatgtccttacttataaatctttgaaaagtcgggcaagcgatttactcaaaatgagagaaacacttcccgtttaccaacacaagcgagaaataatgtcatatattgaaagcaatcccgttaccgtccttattggtgaaacaggttctggtaaatcaacacaaattccgcaattcgtattagaaaaattatatgatacgaagaagcatgggtcgattgctgtaactcaaccccgtcgtgttgcggccatcaatttggctacacgtgttgctcaagaacatggttgcaaactgggtgaacaagtaggttattctgtcagatttgacaatacgactactacaagaacaagacttaagtatctgactgacggtatgttacttagagaacttatgatgaatagtgaccttagagaatacagcgtcatcgttatcgatgaagcgcatgaaagaactgtgcttacagatttgatattggggttcttaaaatccttgatacaagggccaagacctgatttgagaataattgttatgtctgcaacattgcaagccgaaaaatttagtgagttcttcaataatgccccaatcttatttgtagaaggaagaaaatttgatgtcaaacaatactacttgaaggcgccaacagatgatatagtagacgctgtcatcaggtgttgtatacaaataaaccaaggtgaagaactgggagatatcttatgttttttaccgggccaagaagagattgacaaagcagtgactataatggagaaaattgcaaagtatgtttcagatgaggccccagtaccattaatagttccttatcctttatatgcagctcttcccgcggtccaacagtccttggtcttcgctccgataaagggtttcaagagaaaagtcgtctttagtaccaatattgcagaaacatctgttaccatatccggtgttaaatttgtcgttgattctggtcttcgaaaagtcaaagtttggagacatcagctgggattagccactctacttaccgtacccatttctcaggcaagtgcgatgcagagaagtggtcgtgctggtagagaaagtgaaggaaagagtttcaggctttattgtgagtctgattatgtgaaattacctaaacaaagtgaacctgaaatagccagaagtgacgtcacatctcctgtgttaatgttgaagagatatggtgttgatgacctgctaaactggacctggtttgagaaccctggaaaggaagctatagtaatggggcttcaggaactttatgaattgggtgctcttgacactcgtggaaagataactaaacggggtcaacaaatggctctgttaccgctacaaccgcatttaagtagtgtcttaattaaagccagtgaagtcggatgtttgagtcaggtcattgatatcgtctcttgccttagtgtggaaaatttactgttgaatccgtcaccagaagaaagagatgaggtgaacgagcgtcgtttgtccttatgcaacgctggtaaaaggtatggtgaccttatcatgctgaaagagctttttgatatctatttctacgaactagggaaaagtcaagatgcaagctctgaaagaaatgattggtgtaaaggattgtgtatttcgatacgtgggtttaaaaatgtaattcgtgtcagagaccagttaagagtttattgtaagcgtttgttttcttcaatcagtgaagaggatgaagaatccaaaaagattggtgaagatggcgagctaatttcgaaaattttaaagtgtttcttaactgggtttatcaagaatacagctatagggatgccagacaggtcttatagaactgtttccactggagagccgataagcattcatccatcatctatgctatttatgaataaaagctgccccggtataatgtacacggagtatgtctttactacgaagggatatgccagaaatgttagtaggattgaactttcatggttacaagaagttgtcactaatgcagccgctgtagcaaagcaaaaagtttctgattcaaaataagtcacctactcttagcgcatttttattgtatataaaggcatttaatgtaatttatagagcattataaatcgtaacaactactgcagtatgagtttcatggattcatttctcaatatcttatgaatatacacaggtatatatgtatattcatgttaaacgcctttcgaattgttcgttggctttttttgtgaaattatctcgggaaaagggcgaaattatattattttgccgttgacattttgaaaaggaataaaagatcatgaaaaaaataagaaaggcaattcgacgcatttctctcagcaagctattctttacttttgaagaacaaaatattttagcaaaaaggttaagacaatatagtcggaagcagttctgcgggatctgaaggaattgcggaataatgagatttcacgatagtatacttatcttcttttctttggcatcgctttatcaacatgttcatggtgcaagacaagtcgttcgtccaaaggagaaaatgactacttcagaagaagttaaaccttggttacgtacggtttatggaagtcaaaaagaattagtcactcctacggtcattgccggtgtcactttttctgaaaaaccagaagaaacaccaaatccattgaaaccttgggtatctttagagcatgatggtaggccaaaaaccattaaaccagaaatcaacaaaggtcgaaccaagaagggaagacctgattactcaacttacttcaaaacggtaagttcccacacatattcttatgaagaattgaaggctcacaatatgggccctaatgaagtttttgtagaagaagagtatattgatgaagatgacacctacgtctccctgaatcctattgtcagatgtactcctaatctttacttcaataaaggtctagcaaaggatatccgcagtgagccattttgtaccccttatgagaattctagatggaaggttgacaagacttacttcgttacttggtatacaagattttttacagatgagaattccggtaaagttgctgataaggttcgtgttcatttgtcctatgttaaagaaaaccccgtagagaagggcaattataaaagagatatccctgcaacttttttctcttccgaatggattgataatgacaacggtctaatgccggttgaggtcagagatgaatggctgcaggaccaatttgatcgtaggatcgttgtatcagttcagccaatatacatatcagatgaagatttcgatccactacaatacggtattttattatacatcactaagggttcaaaagtgtttaagcctactaaggagcaactggctttagacgatgcaggtataacaaatgatcagtggtattatgttgcattatctatccctactgtcgtggtggtatttttcgtcttcatgtactttttcttatatgtcaacgggaaaaacagagatttcacagatgttactagaaaagctttaaacaagaaacgccgtgttttgggtaagttctcggagatgaagaaattcaaaaacatgaaaaatcacaagtacaccgaattgccatcttataagaaaaccagtaaacaaaattagattcccttcgaagtatgcattcacccttcctcgagagggctgtttttatcttccgtcacactaatagaaaaccactctatccagttttttttgttacttaacttatcttaactcgatattgtataaatactgaagtccatatacttctttttttctcctttggatagtaaatacggtaaattaaaattagtgtaaactgaacaatattaacatatataaatcatctgtacgacaatttgataccaaataaatagagaatgcatcagcatcctccagggttcaaaagaaaacgctggatcttgcttcttttcctttgatttctccttatatccatttctgtcttgcagcaacttcacatattttttccagtgtaatgacccttggatcaggcttaaaatgacgctcaaccacattatcatctccttccacattcctgctaagtaagctttcttcgtcgccctcgctattgtccacattatcttcatcttcatcatcatctccgccgacgtcttcaatgtagtagaaaaagggttccaacaccaacataattttccagaagttgttcgtgccacaattagcaaacaagacatctacaagggcaggtaggtattccaattcaatgtactcctctgcgcaacaaacaaattcatctaattcgtaatcttgctcatcagcagataatgtagaatacatttctgataacaacgttaattctttgctaattgtttttggaatatcttctcgagcttgccataacagcttttgcgctctttccagtctttcttggctaacggcatcatccttgctctctttttcgcctttatcaccttggacattttcggagtcttgtagagaaggcaagaatccgttcttttcgcttttgaccataagctcattgtattcgttatagagggagataattttcatcataggcttgtataattgctgacagactttcatttccgagtaaggtacaatgactttttccaaatagtgattgatcagtccttccatgaagtttgcccaaattgacgaaaatacataatcctcgtcgtaagtcgattccgtaaaatcttggttgatgttatgctgtatgatttgctctgtaagagttgggaaaaggtttttatggcttttgaccatttcatctctcaaagcagtagatccagcgctatctgctcctttagtagaattttccaaactattatctgttgaagacgcctctgagttcttttcaccatctgtcttatctagccagtattccggaccacccttttcagacaatgtcaccaataaaaggaagagttttactttaacccacgggtttagcgagtttacataggcgtccgtaattttgctaacatcgatatttatttttctatggatgcatttgataaatttttcaatgtaatgtgattttttcaatccgtatttttcattcagatatccaaccgaagtgattacgtcgtaatttgtattttccatgttcgtatgcttcaaaaagttgaatgttaactttcgtctatttccataatgtctttctcttttctcctcacctttcttctttcttctaatctttttttcttttgaagcacccaatttaagacatcttttacaggtacagtcctttaacgatggctcgttggccgcttgcttgggcaataaatctttagccatcttctttggcgcgctatactaggcttgatttataatgttagttattccaaaaatgtgaaggaaattgatcaaggcaagctctaatgatgattattgacccatgcaacaaaaaaagtttgaattctcttaattttccagatcgcaagttagtagtcaatctgctaactttcgttatatttcaaaaaagtaattgtacaaaaaaagtcaccaaaaacgaggacttttttcactgcgttaaagattagatctacataatgaatactcaattctttacttaatttcgctctacaaaatagaccatttaggaaagttgggttgcttccatcatgtcaaagtcgtcctcatctatataagtacacagaacagtgcgatcgttgaattgcgtacccggcaattcttccattgcgtgttttgctgcctccaaggtcttgaacttgatataaatattaccggctccggaagccaagttttcaaaattaagtctgtaatcgacgccgggttggcatattttaatcgtatctgctcccgcgatactatactttaatgtttctttaatttctgtgataaaggtttcatctttcaaatccaatggatcaagacaatttaagagcaacaaaactctcgattcaacacgaacagattgggtaaccagatttggcaggctttgaaacgtaatccatgaagtaacttgtgatatctttccatcatttggcttgaaccatttgtatggttttaatttatcaagaatatcctgagtgacgacttcaaacgataatagaatacatttagtgaattcggattctttgccagtgttgtttgtattggacgaacatttgtaaaaaagtggcttagcggtaccgtttgttacattcaatgacgaaaaaagctctttcattctataatcttcaccctcgcctatattttccaaattttccaatgcaattaccgtacccctgcaaaaatcgaccagatgatcaagttgttgaacataatcattaggtcttctccattttaagtcgaaagtaccaagcttcgcattaaagaatgatcgacaggccaaaaccatagtgctacagatctgagaactaaactcaacaataatatggtccggccttccttcaccaatataaaagttggaaattttaaagtcctccgcattactctcagttttctggagacctgaaataaaattttccagcaaatctttcaatcttgctacaatgctggggtcgctgctttgagacaagcccgaaattacaagccttgaatttgccttggatgaggccatgttgtagtaagccggagaatcgaatgatgaacccgggtacattacattttgggaattatagttcatgtcatatttattagtttgcaactgccttttatcacggtcgccattgaatttagaaccttcgttcttcctttggtaattgaaacgatcgtagtttccgtttccatttcttccccttctatcgaacctttcatttcttcctcttctttcatcccgttgcctattatagggattgttgttccattggggcccagtattgtgactactataccgattctccctgttatatgatcttcccgatgcatcccgataactttgacgatgaggacctgcccttgtttgttcataagtcgttcgattcgtgctcatagtaattattgacgatggtcctctgttattagaatgtgaaacgtttctactttttggcgctttcggaagctcaccgtcacttttttgcctcttaaaatgtgtatctataactgcattatccgtgttgaatcttttgttctcaatcggcacaacatccttttctgattttcctatagactccattattttggatctcaaatcctccagtctcttttcatcagccatctccgtgtgcttgttttctgtgtcaattaactttccttttctacttcttttatattagcatgtacagtttaatttctcatctcgaattttttcagcacttgctaattaggcgcgcgcctcaaatatataatatcgaacacgctgttataaaagtgatccattctacagcgtaatattaacagtatcgctcctgcagtattctggcattattagtgcaaataagtacgcatattaccatgcgaaacgttttaaggcttttatttttaacagcttttgttgctatagggtctttagcagccgttttaggtgttgattacggtcagcaaaatatcaaggccattgtggtttctccgcaagccccattagaacttgtgctcacaccagaggcaaaacggaaggagatatctggtctttcgataaaaagattaccaggttatggaaaggatgatccgaatgggattgaaagaatctacggttccgctgttggcagtttagcaacaaggtttccccaaaacacattgttgcatttgaaaccgctacttgggaaatcactagaagatgaaaccactgtaactttgtattcaaaacaacaccccggtttagaaatggtatcaacaaatagaagtaccatagcctttttagttgataatgtggaatatccattggaagagttagtggcaatgaatgtccaagagattgccaatagagccaattcactgttgaaggatagagatgcaagaactgaggactttgtaaacaagatgagttttacaattcctgacttttttgaccaacatcaaaggaaagcacttttagatgccagttcaataaccacaggaatcgaagagacatatctggttagtgaagggatgtctgttgcagttaactttgtattaaagcagcgccaatttccaccaggtgaacagcagcattatatcgtatatgacatggggagcggttctattaaggcctcaatgttctctatattgcagccggaggacactactcagcccgttacaatagaatttgaaggatatgggtataatccacatctaggtggtgcaaagtttacaatggatattggcagtttgatagagaataagtttttggaaacacacccagccataagaactgatgaattgcacgctaatcccaaggccttagcaaaaatcaaccaagcagcagagaaggcaaagttaattttaagcgccaattctgaggcaagtattaacatagaatcactgatcaacgatattgatttccgtacttctataactagacaggaattcgaagaatttattgcagactcgttattggacattgtcaaacccataaatgacgctgttacaaaacaattcggtggctatggaacaaatttacctgagataaatggggtcattttggcgggaggctcttcccgaattcccattgtgcaggatcaattaatcaaactcgtatccgaagaaaaagtgttgagaaatgtcaatgctgatgaatcagctgtgaatggtgttgttatgagagggatcaagttatctaattcgtttaagaccaagccgttaaatgttgttgaccgttctgtaaatacttattcattcaaattatcaaacgaatctgaactgtatgatgtgttcacgcgcggaagtgcttatccaaacaaaacatctattttgacaaacacgactgattcgattcctaataattttaccattgacttatttgagaatggtaaattgttcgaaactatcacagttaattcaggagctataaagaattcatattcctctgataagtgctcgtcaggagttgcgtataacattactttcgacttgtccagtgatagattattctctattcaagaggttaactgcatttgtcagagcgaaaatgacataggtaactccaagcaaattaagaacaaaggcagccgtttggcttttacttctgaggatgttgagatcaaaaggctttctccttcagaacgttcgcgtttgcatgagcatatcaagttgctcgataaacaggataaggaaagatttcaattccaagaaaatttaaacgttcttgaaagtaacttgtatgatgctagaaacctgctaatggatgatgaagttatgcaaaatggaccaaaatcccaagtagaagagttatcggagatggttaaagtatatttggattggctcgaagatgcatcctttgatactgaccctgaggatatagttagcagaattagagaaattggaatattaaaaaagaaaatagaactttacatggattctgcaaaggaacctttgaactctcaacaatttaaaggaatgcttgaagaaggccataagttacttcaggctatagaaacccataagaataccgttgaagaatttttgagtcaatttgaaaccgagtttgcggataccatagataatgttagagaagaatttaaaaagattaagcaaccagcgtatgtgtcgaaggcgttatctacatgggaggaaaccttaacctcttttaaaaattccattagcgaaatagagaagttcctggcaaaaaacctatttggcgaagaccttcgtgaacatttatttgaaatcaaattacaatttgatatgtatcgtacgaaactagaggaaaaactgcgtttaataaaaagcggtgatgaaagtcgcttaaatgaaataaagaagttacatttaagaaacttccgcctacaaaagagaaaggaggaaaagttgaaaagaaagcttgaacaggaaaaaagcagaaacaacaatgaaacagaatcgacagtaatcaactcggctgacgataaaactactattgtcaatgacaagaccaccgagtcgaatccaagttctgaggaagacattttgcatgatgaattatagaagaatctttataatatatagcactagatttattttccgatatcaaattcagttacttatataaagttaaccacttgttacttcttttttcgcagcgataacggtaactattattgttagctctgtttatgcggaaaggttatatgatcttcggtgcaagatttagtgccctatttagtcacccggacatctattgtttgatggtggggcaatttcgagagatgacttatttaagcataagacagataataatgcatagaaggtggatatacgtaatgcacattaatattatagtggcactgaagcaaaattcagaaaaatttaaaaacatataaatataaaagaaaaaaaagaagaatttcgagactgctacgaaaagtgaaagtaataacaagcgtgcaaaagttcataatatccataatagattggacatagaaattaccgcaaagcgcaaagagttatcattcgtacgattttgaaaaataatatatttgctgggggaaaaaatgcaactggaagccactcatcagaaagaaaaccacctgtctcctttggctagcttcatttttccagacttcagggcattgttcaacatagggtttaatttatattctaatataaactacaaagaagtagatattaatggatttgaaatttacattgtcgaacaatgggctgcccagagaaaaatatcaactctaatcacttcatatacgggcaacttacaagacaccatatctgcagtagaggttgctcttcccgaagatcctgaggaatggccatgttgtttgaagaaataccatgaagaattgttgaagttttctagtccaaaaaagactgccaaaggaactttatttgttacaaacctttcttctttcaaatctacgctaaacttattgcatgttgagtgtggtaatctaaagaaaatctggaaaaacttcaaaaccaactacgacctaaagagattacattgtggtggtcgttcagctcagctgttaaaaaagacacctagtgcctcaatagcgaagtttgcacagttatataaatttccgaattcagctttttctcatgaaataacgtcggatttccaacaaccttctcttcagaatgacaacagctcaataagtagcatagaaaatattcctgttaatcattgccctgtggtagaactaactaccctcgtgcaaatatcacttagttattttgcgctgtttgaatacaagaaggagagagatggtctcttatgcaatggaacgaaacaatcccttgaaaaatggtgggaaatatatgggaaacgataccacggcattgataagccgaagaatgaaacgatccttggtccgactacggtggcatcactacttagtcttgtattgacttgttacttcaaattaatggtagaagattgcatgtcagcaaaagatccgtttgatgaagaagagttttattctggtctttatgcatttcaaaagaaatacggcctatccaaaaacaataaacagacctccttagacgaactaacaattgataaattatttgaagtatcttccaagacttcaaacaaagatattttcaagtttaaaaaggttgtgaagtcaactgttcaagacatgactggcaaaggaaactttatgcatctatccaatgagatcctaacaactgatttagataccctggtaaagaatatacacggtggatcccttggtaagctctggaaagggagaagtgcttcgagaaaggaaacatgcatggtttgggaaagaaaaacctttctaagtttcaagtttgaacgtggagatccatccttacaattggaaaataatgagctgttttatggtacgagtgtgccaagtgaacagttaacgacttccaataaggaggacagtgatacgcaacccacaaagagaaatagtatatatgatattgccaatggctccaaatcatcgctatctatctcatccatgttctgtaattatgatgaaacccgttacaaaagtaccaacaaccttaatagagcctataggggggagtattttaggcgcaattcgatcccattttgtaacgatggtatacacgatactaaaaaaatatctgctgatcttaataagatagatggattgtatcgttgcaattcatattctgaggtacaaaacgcaatagagctgtggagcttgccattcgattcatcagtcatcagattagcaagagacttacttaagatacaaagtctaatgtcagttcaacgtcagctcgatgaaatacgtgacggatatctgggaaaaaattcacaaagatcataccagaatgatctgatgtttagacaaagcttgaacaaattgcaggaaatgtgtgagagatgtaagagaggttctaacgaatttcactgggaatatggtaacatgcaaaacaaacagcaaattttggagagtgagaaaaaagatatgaaatcactttcttcgaaactgaaatataacgttcgtatcctagatagacgtgtaagagatgttgaagccagcgtagatcattttgatcgcaagttagaggatgttagaaaaaagcttctggagcaaaataatagtaaagacatatctatggccttagaaagtccttgtgataaatttgaatttgacagttttatggactctatagtgcagtcccaacagactaaatatgaagggctgtgttttaaaattttagacaagaaaagtcttcgaaagttaaaaaaggaattctggaaatggagcacctggacattcgataccttcttatacaaaaataggcccaataaggagaaagatacactatgaaagcttcctcatttcgttactgctgttgcagatctattaaatcagacaatgcataagatacactaatttcctggagagccatatacttatagatattataaaaattcgtaattttaagaattctgccatttgagggatgcatatttaatttcctgggagaactgtatatttatggttgatctttggggacagttagctattttcttctttcacattatagatgtcacatagacttccttcctttttacggaataagcccactgaaatttttaaggaagctccagctcattatgctctcgttcttctgttctgagtttcgagaaatactacgaattattgagaaaatgaaaatcaactatcatttatcgatcagtacatataaggtgaaaagagaaggtaatagcattatgtaaaatattggtgtcctatattctcgaggaaaacttctagtggattccattgttgatgaaggctataacattaggtatacagaatatactagaagtgcctcctcgaggatctaggaatactcaaaatctatatttctacataaaaatattacatattattcctcgttccgttttataggtttcattattacattatctatccttgcatttcagcttcccctgacttcgatgacagcttctcataacttatgtcatcatcttaacaccgtatatgataatatattgatagtatgactattagttgatagacaatagtggatttttattccaacagtttcatacttatttaaatgtttaggttgatatattggtaatgatatgttatcttactctgagatgcaacatatatgctacatactgaactcatttatccaatattaaattaagagattggtgaattttgaggtatttgttggcagatctaaacttcatcatgctcttctttttctatgtatctaatcttgtattttatcttcatagaacactgttatctctgctcttttcagatatagtcgtcattgtttgaggtgatctatcctattttaaaacgtgaatattccaagatgaagcggtggctcaatggtagagctttcgactccaattaaatcttggaaattccacggaataagattgcaatcgaagggttgcaggttcaattcctgtccgtttcattttctttttttgccatacatttagcgctccacactctaaataaagtatttcttcttttcttgaaaatgatgtacttaggttgatgaaatagcctcagttactggaatttccttacctttgtcgtgttactgatagtatatcttaatcattatttcttgtttcaatctggattttgatttgcgcggcatatcgttaccgccttttgcatattataaatggcttatataagtatacagcaactttcatatattatagataggtaattgcctccacatcgaatcacataggataaagaaccgacttcctgccgcgaatttagagttttcacgttatgtgaccatctcaatttttagaatatttgctaagccacttgctattaaaacttcatggacaggccccagtattatcgcaataatactggaaacatcaacgaatgctataataatgcgcatttactttgggcaaaagaactatttaaaattacgcattacgtagtttattttgacattatgatcataaacatgcgcaaatcctaagatcgtgaattacctctactgcgagaatacaaattataacatatgactaacgttacacaacattgtattacatttctgactaatttgaagtctgggagttaattgtagtagcctactaaatagcgcggttatttataaagctaacattaccatgttacatgacatgctatttctagcgaggtaaaagcattgctccggcttttcgaagataagtattccttcaatttccaaatgtcacaacataaaattttgatttgcgttatctctcgttctctttaatcactacaatagcatcaaccaagtcaataaaacatgttgtgaagagactacgcagacgtgacggtcatctagcaactctccatcttttgatgcagccatccacagtttatcgtgagttatggcaaaatccaaaaatgtaccgtaccatttcctctttaatcctgtattcaataagcaagttccccatttcaattgatctacacatcactgcgcgttaaagcgcacctaatttattcggtaggaaacagaaatagtctgcaaagtcattcaagcacctttctttaccaaatgaaaggatttaatagtacctatgaaacaatagttcgaacttttgccatttcccggtttttttggccagcttgtataaaagtgcaccttacccttatattgggctcttattgaatgccttccgaagaactgactattcaaaaaatagaaacaagtacgtcaataaaaaattttgcaattctacgaataattattcctgtttctttaacctggtaaaaaaaagtacaaacacttaagctttttgaaacagctttattttgcttcattaaatagctaggataagaaatccctcatccgaaaggttttgtatctaactaccctagagaacatttgtcctgatcaggttcatttggagtttatattttttagaagctcaaagtttgttggactcattaccatggaagaaaaaaagaagatactacgaaatattggtttctcaggttaaataagggacaccattttcctattaggctagtcgagcttagttcttctaatttcttcagatcttctataatttcctatcttctacctgatgtgtgcatgatatatctatgagctcctgatattgcttgttttactttagcttgcatgacttgcaataatctaatcatatatgttcccgattaatatactgtgcacaaattgcaggacatataatttttccgtggattatatcttcgattaacgtccgcgggtctcataaaaagcaaaccaacttcgcaattccctagaaatacctcaatagaaagttatttgtaatgagattagtaatgagattagcaatgagattagtaatgagattagtaatgagattagtaatgtgattagtaatgcatagcggtataaatggtagtactaataagtaagatagtataccagttataataaataggcggcgatgcttcaaaactaatttttgacgtttttaagaataaagcctttaccagtggcataaatcagtagaattctaagcaaacaaagtcgatatgaatacttcatcaagaataacttactttatcatcggtggtagccgtggaattggttttaatttggtcaaaattttaagcgcttctacgggcaatacagttataacctctattcgtggatcaccttcattacccaagaacaaacaagtggaagatttagcaaaaatcaggaagaatatccatattgtccaacttgaccttacaaaggacgaaagtattggcaatattgcggacgagatcaagaaaacgccattcttcttgggtattgatatttttatcgcatgttctgcagtatctgattcttattacaaggtcctggaaactcccaaatcagtctggctcaaccattatagcacaaacgctctgggtccgatactagcccttcaaaaagtttatccactgcttcttttgaaaaagacgaggaagatattctttatctctagtgttgcaggatctatcaatgcgtttgtaccactttctgtttccgcttatggtcaatcgaaagctgccttgaattatgcggtaaagacgctcagttttgaattgaaaccggagggttttactgtcgttgcttttcacccaggtatggtatctactgatatgggccaatatggccttgatcattttaaagagaagaatatagacatcagcggcgtaaatattatcacaccagaagaaagtgcctctgcgctaattgatgtcttccgaaaaattttaccagaagataatggaaagttcttcaactatgacggcagcgaaggcgtcttttagataagtgcaaatttggctacttatatacaactcagatacggaatatacctttgtgtaatacacttttttattggtaggtgctatatgatgtgactttgcttttgcctcacgcccctttaagaaggtattttgtggcatcactttgtatgctgatcttttaacgcttaaccagatttgaaactatctctattatgtcctctgattttaattaggatggtatataactggtcctagaaccgaagattctgcatattcgccgaaaaccatcccttaatattatagacataaattgccagtctgagaagaatccaagaatctatttcataatgtacattcctaaacattttgagtccatggaactctcaaggtacaaattatcaaaaaaacccccgctaggaacactattctcctctaaggctagcaggcaaggtttcttcggatggagaacttcttccaataaagatgaccccgattttggtatgtgcgcatcacatattccatttgtattcgtggagttcgataatggagagcataaacttattgcacatttagcacggaagaataaacatgtggaaatgctggaaagagttcaaaaatgcttagtggtatttcagagcgtcgattcatacatttctccggcgtggttcccaatgaagaaaaagacccataagttcgtaccaacatgggattttgccgctgtgcacgtttacggtacaccaaggattatccgcgacgataaagactggcttattaatatgttatcaactttgactgaccaagaagaagagaaaagacctgagggggaaaatgtacgaagtaaagtggagcgtttctgatgccccagattattatatcaatgctatgcttcaaaacattgtcgggcttgaaatcagtattacccatattcaatcaaagttcaaattcgaccaaaataaatcacagattaatgttgaaggcatatgttgaaaattcaaagaatttggtggagaaagaggccaagaaatggctcgccttgtaaaagataactatccaggtagcttataagttttgtattttctctgcgcattaaatatcaataattatttattcgttttcattcttttcttatcttatcttttaatattgacttaacagagggcaaggcccaccgtgatgcagaaagaacacaaacgcaaaggtttacctattccctgcagttagaaaaccatgtttggaggaaatgaagaaagatatttacagttgagtttacaacgaagtattatcctttttaacgaacgctaatatcatcggtttcttcatgtttatatgatgacgattttcccaaatgtaagcaaacaaaggcgtttgctgataaaacaaatccgtaaattagaaaaaaaaacaaaaaaaaacaaacagatatgggctcatcaaccgggtttcatcatgccgatcatgttaactattcttcaaatctgaataaggaagaaattctagaacagcttctgctttcatacgaggggctatcagatggacaagtcaattgggtttgtaatttgtcaaacgcttcgtcattgatctggcatgcgtacaagtcattagctgttgatatcaattgggctggattttacgttactcaagctagcgaagaaaacacactgatattgggcccatttcaaggaaaggtcgcttgccaaatgattcaattcggtaaaggtgtttgcggaactgcagcctctacaaaggaaacgcagattgttccagatgtcaacaagtatcccggtcatattgcgtgcgacggtgaaaccaagagcgaaattgttgttccaatcatatccaatgatggtaagacattgggcgtcatagacatagattgtttggattacgaaggattcgaccacgtagacaaagaattcctagaaaaacttgctaaattaattaataaatcatgtgtctttaaataagagttttgagaacgaacaagtatttacgcacataaccaatattcccatgtagctctcttgtcaaatatattgtcggacgggcacgaatagagataaacatcaagaaagattgaggggcttcaggagatcattggtgaagaaaacattccctgttcgccaaattgacagctctcaatctttatttgtaacccttattgcaaatttatggcatgtttaccctcaaacaaaggatattcagcatttattaaaaatatctttgcttggtaagaaaaaaacgtcaacgaaaatgacggagatatctgacggaaaaaaaaattgatttcgcccaggatcgaactggggacgttctgcgtgttaagcagatgccataaccgactagaccacgaaaccacttaattgttgaataacggacatctaaagtcatatctatagtgcagcaagttcttcttcagctcaccccagtctcgctaaaggcatgcttactttgccgtaaagaagaaaggaacgttcaaaatgtgtttgatgcgtaactgtgatgattttctatcatttacttgcatgatatcggtgaaaattctagctagatttatcaatgcatagaagcagtaagtgatgccacagatatgagcttttctctgtggcgaggtctttgagaaattaagtggcttgtacagttttcacatgacgattggaaatgttgaaaaaagagcctaaaaataggccttatcgaacaacattaaactaataatcttctggatgcgatagtcttacttgataaaaatcattggcgatattgtgttacctggattatcaagctcgccactaaaggtgtctggatccttactcaatacaaagtccaaggaaaggtgtgccacaggaagaggtagcatccctttatttcttttcaaggaaagaagcattttcaatcacatatgtatacaatagtcttccgtgtggctgcaccgcaccaccttgcaggtcccgtgtatgtaggagtcgcatgcgaataaaaaattgagaaagatcatggggttttttgttcacgcgggccgcagttgtggctcctctgtcacttttttgccctctgctaagggcaaaaaagaaaaaaaaacgcaacgagaaaattaaaagtgtggcatttcgacatctatcgccattcgtgcggccatttctcgaaacaacgctaaacttttgtttcgactgtgaggccctagaacagttcgattctgatgtaggcaatggaagaaacaatcatatataactacagaacctaatgttacatgcttgcatctctcagctcccgcgaattttcaagtgagacttaatggtagccatctagtaactcataaatcaacgacattatatatcatcaactacaatgcaggcaaaccattccgtcagttacctttacgaatcaagtacttcaaagaggtcaaatgggctcttttctcaaacacaaaagcaaggaagttttcaaaaagctttaagtcaaactcaggaagaaatagaagatgaagacctgatggtagacctcaacacaggatctttaactcccgttaagttaaaatattggactcaaatgagtgctatgacggaaaaatttggtaaactgtgagaccaattttggcggtaatttcgtttagctgttttattttcacatttttaattgtcaatgctggaggttgttaaagtttggctagctgttctgaacaatccttgtataccggtgagactttttgttatagatattggcgatattcattttttaggaaggtgtttttatagatttttcaattttttttgtgtagatgcatgttttgattacttatgcatagtacgaatttttagtttattaagctatagaggtttttttttttttcacctctttaccacaaatttaatagctattgtgtagaataacttttaatggaaaacatttgcagtattttagtatttttctacctgtttattgcaagtaagggcagcattatcctgataggagtagaggttaaccgcacatcggaatgagacttctccaagaacgttctcaaagtaaaacatttagcattaggaaatttctttggtcgattattagacaaagattagattgtattatgttctgatgcttagttagaacggaaagtgttacccatcttgcaatcaccgtgacaccttaaatatttgccgtaagcgaagaaaaaaagcatgaaaaaaaaaagcatatttatgctgaagtcatctacaaatgaccaccgcttttggacctgaagaggagaagaaaataacatatcgtagaacagtctttgttaaccaaaatattttagctttgattccggactattagtacattgaattttttcaggtactaacaatgtttggcaacaatagaccaatgtttggagggagcaacctttcctttggatcaaatacgtcatccttcggtgggcaacaatcgcaacaaccaaactctctttttggaaatagcaataacaacaacaattccaccagtaacaatgcccaatcaggatttggtggattcacttctgccgctggcagtaatagtaacagtttatttggaaataacaatactcaaaataatggggcatttggccagtcaatgggtgccacccaaaactcaccatttgggtcgttaaactcctcaaatgccagtaatgggaacacttttggaggatccagttcaatgggttcttttggtggtaataccaataatgcatttaataataacagtaacagtaccaattccccgtttggtttcaataaaccgaatacaggagggaccttgtttggttcgcagaataataatagtgcaggtacttctagtttatttggcggccaaagtacaagtaccactggcacattcggaaacaccggaagtagtttcggaacaggcttaaatggcaacggctctaacatatttggggcagggaacaactcacaaagcaatactaccggcagcttgtttggcaaccaacaatcttcagcgtttgggacaaataatcaacaaggaagtctatttggacagcaatctcaaaacaccaataatgcgtttggtaatcaaaatcagctggggggcagttccttcggatcaaaaccagttggttcagggtcgctgtttggccagagcaacaacactttaggtaatacaaccaataatagaaatggattgtttggtcaaatgaattccagtaaccaaggcagttctaacagtggattgtttggacaaaactcgatgaacagcagcactcaaggggtatttggacaaaacaataatcaaatgcaaattaatggcaataacaacaacagtttatttggaaaggcaaacaccttttcaaattccgcatcaggaggtttatttggccaaaataatcaacagcaagggtccgggctgtttggtcaaaattctcagacaagcggtagtagtggactttttgggcagaataatcagaaacagcccaatacttttacccaatctaatacaggaataggtctctttggacagaacaacaaccagcaacaacaatctacaggtttgtttggagccaaaccagcaggtaccacaggatctcttttcggtggtaattcatcaacccagcctaactctcttttcggtactaccaatgtacctacctctaatacacagtcacaacaaggaaatagtctttttggtgccacgaagctgaccaacatgccctttggaggaaatcccactgcaaaccagtcagggagtggaaacagtctattcggaactaaacctgcctccactaccggctcattatttggaaacaacacagcttctacgacagtaccttccacgaatggattgtttggtaacaacgctaacaattcaactagcactacgaatacgggacttttcggtgcaaagcctgattctcagtccaaacctgcattagggggagggttattcggcaattcaaactcgaattcttccacaatcggccaaaacaaaccagtttttggaggcacaacccaaaatacaggactctttggcgccaccggcacgaactcttcagcagttggttcaactggtaaactttttggccagaataataatacgcttaatgttggtacacaaaatgtaccacctgtgaacaataccacccaaaacgcccttttgggtacaacggcagttccttccctacaacaagccccagtaactaatgaacagcttttttccaaaatatcaatccctaactctattacaaatccagttaaagcaacaacttcaaaagtgaacgcagatatgaaaagaaatagtagcctcacgtctgcctatagacttgccccaaagccgttatttgctccctcttcgaatggcgatgctaaatttcaaaagtggggcaagacactggaaagaagtgatagaggaagcagtaccagcaattctattacggacccagaatcaagctatctaaattcaaacgacttgttgtttgatccagatagaagatatttgaaacatctggtgattaaaaataataagaacttaaatgtcattaaccataatgatgatgaagcaagcaaagttaaattagtgacgtttacaacagaatcagcttcaaaagatgaccaagcctcatcaagcattgctgcttcaaaattaactgaaaaagcacattctcctcagactgacctaaaagatgatcatgatgaaagcactcctgatcctcaatcgaaatctccaaatggttccacctctataccaatgattgagaatgaaaagattagcagcaaagttcccggcctattgagcaacgacgttacctttttcaagaataactactacatttcaccttccatagaaacgcttggcaataagtcattaattgaacttcgtaaaataaacaacctagtcattggtcacagaaattatggtaaagtcgagtttctggagcccgttgatttgttgaatactcctttggatactttatgcggggatcttgtcacctttggaccaaaatcatgttcaatatatgaaaactgttccataaagccagaaaagggcgaaggcattaatgtacgttgtagagtgactttatattcctgttttcctattgacaaagaaacaaggaaacctataaagaatataacacatcctctactgaaaagaagtatagccaaactaaaagaaaacccagtgtacaagtttgaaagctatgaccccgtaacaggcacctatagttacaccatagatcacccagttttaacttaaaccggaataatttttgtagagaatccttgtatcgtctaagtagtctagatgttcagctgatagattttcgttgtattgtatatataataattgtcggaaaacaaaaatacttaattgtaattgtgtgaccgaaaatgcctgatcaacagccatggcacatttgaatgggattttgaggagacaaaaatgaagaggttctataacctttgtagaagaacattgacctcttttcaatgaaggttggtggcatcgccagatgcagaaaggttgtctcatgaaataaaaacggacagaccatgaaggctaaaggaaaaaaataaaatgccatctcctagaatcgaaccagggtttcatcggccacaacgatgtgtactaaccactatactaagatggcaaacaactgtgaagtttttggttacatctgcacatctggttgaataaatattatgtactctttgcttttttatgttaaacctacaagtggtgactgtaaagaagcattacaacgtagaactgataaaggggagaaatatgtgagttgttagataattgttgggattccattgctgctaaaggctataatattggtatacagaatatactagaagttctcctcgaggatataggaatccacaaaagggaatcgatagttctacataatgttattattttatcttccttccttttatatgttgtcattcattatcctattacattatcaatccttgcatttcagcttccattagatcggatgactgtttctcaatctttatgtcatcttctcacaccgcatgtgataatataatattaaatagatgatattagagttcaattccaacaaaaggggagtagttacataagctttccgtaatggtgaatttatagcagtttccttctcgatgaaaggaagggaaagaattaaatatactcgaatgcttgtaccactccatttccccatttatcacatttaaagttacgagtaaaaaagtgaccgatatagaatgtctgatgaaagagcaaatgaaagaaacatcaagaaagcatattgaaattagcaagtgaaagcaaaaaaagtagatgagtaagcattataatgcgtccagtctgacttttttgttggaataaaaatcaactatcatctactaactagtatttacgttgctagtatattatcatatacggtgttagaagctggcgcaaatgatgagaaatagtcatctaaattagtggaagctgaaacgcaaggattgataatgtaataggatcaatgaatgttaacatataaaacgatgataataatatttatagaattgtgtagaattacagattcccttttatggattcctaaatccttgaggagaacttctagtatatctacatacctaatattatagccttaatcacaatggaatcccaacaattacatcagaatccactgagtcttcattttttcctattttttgaattaatttttgttcgtatccattgggctggcgagcaagtccatcaaataaaaaggcgcgtaattcgcttcgtttcgtgtcttcgaaaatgaagaccagttttcctccttaaaagtactttaattcggagagccgattatataaagtgaaagacttagtacttcgttagctcatatcgttttcttattttgaaataggttatctatagaatactttatcaagttatcaggttctttccggaaaaacatctcataaatcatccctggaaaaatgtctagtcaaacagaaagaacttttattgcggtaaaaccagatggtgtccagaggggcttagtatctcaaattctatctcgttttgaaaaaaaaggttacaaactagttgctattaaattagttaaagcggatgataaattactagagcaacattacgcagagcatgttggtaaaccatttttcccaaagatggtatcctttatgaagtctggtcccattttggccacggtctgggagggaaaagatgtggttagacaaggaagaactattcttggtgctactaatcctttgggcagtgcaccaggtaccattagaggtgatttcggtattgacctaggcagaaacgtctgtcacggcagtgattctgttgatagcgctgaacgtgaaatcaatttgtggtttaagaaggaagagttagttgattgggaatctaatcaagctaagtggatttatgaatgaataacttatggcatgggagggtacatatgagcgccttttttttctcgctttgggcagctcatatcatgttccctcactagctaataatataatgaattttttagaaggagcacgattatataaaaaaaataccacttatgttgctacccttatatacgaatttataatacttaatgacgcttcaatgacgcctgatgtcaaatgcttttggctcccagtgaaattgccacacttccttcttctttccgaactttatagtatcatcgaaaaatacaagttggcaaaggtctattacaatcgcggaacgtacgatgttcatacggtttcagcgaatagtcttgtaatatccggaagcatgcctaccggcattattataggtagttcatcgcccttggactatgtaggggtacaagtaaataggcaacttgaaatggatctccctattgaatgaaacatttaagggtgcccaacccttaagttgatagagctactaccgttcttttaggtttaacagtttctccaataaatttggcaatatgcagggatcccaaattgaaatttctggcggaatgtatatattagacttgcagctgagttttatcgcgtacactattctagggactttggacctaactctgacaacaaaaactcaagtaaaaaaaagcttacatttttaaatgatgagatctaatattttgaaattattacaacggacaagtaggagatatgtatcctcaaaggattttgagcctgtgatagggtctaatcctaagaaacaaacatctagactaatggtcggttctgtgggtgttatgattccagttctactttatttgttttataagaacgatagcaaacatagtgaaattaaaaagatataccaaaatgagaaaaaaatttaaaaagttgttatataagggttttcgtatataacacagaatggtaaaccgagtcacgaagctcaatcttttttttttatgtctttctctaacgttttttcgtctatattcaaaaaaaataaagttggtaacatataatgcatatattcatttgatctaatcgcttgctttttatttcagtagcattttcgtattgcgtcgcgaccagagaagtatgagcaccagaggtaacacgtatatacatttatacataaatatatctatttagtttcctttcttggaagcttcagcagctgctacatttccaggttgattcttctcatcaaaatatttctccaggtttttgacttgcttttgtaggccctccagagaaatttgctttttccttagttcctcttgaagtttggtggaatcagcttcatttgagtctttcttgctgtttgaggaaggtttgttcaatttttgcttttcttgttcgttgattaagccttggtatttcaccagtctcttgacaatagacatgacagttgggatacagatagaaaagtacaatatgaacccggaaatatacatatttctttgattgtacgctcttgatgctagtgcctgtattggagttacagcagatgacccgattgagccactgttgtcgttgtggtataatgaaacacgaatttgagaccttttccatgaatcaataaacaacaggccaacaagacaacccgttataaagattatagtttttatttgctgcttcgctgtcaattggttataggtgctaaaaatacccctacggatccggaatggcaaaggcaaaacgaagatgaagagcattaccacctcaacagtgagcaataaaaataatgtcgtaaagtataaactcatcgcaatattatttattcttctcggttttcagtacttgccactttgcgaaaggatagcagaaaggagcgttgcaatgaacgaatagctttaaaccagaaactatacaaggtcccacttggcatatatttctatttttgcactgcgccagagggtttagtagcgccccctttatgttaacgtatcctgtgatatagcatgcagctgcgggttacatgtaaattgttcagggcataagcagtacgtatcgaggaggtaaaagacgttgcaagtaggtagatagtacaatatagataagcccaacagtttgcgtacgccttaaaagtagtggtgttctgcgtttatgttctctcccttcttttctatctaggtttttatggcgcacttaaaatattctgctgcttcaacgggcggcgatctacggagaaatttttggcataaagtcaaacttagaaagagcacataagccataacttctttttgatatgtgaaacctagcccaggttgtcgttagtagtacctggccctttaaatatatttttgtactatcgtatacttgtataactattcatcattttctggtttggtagtccgcattttttcatttgatgactaagttgtacgtattgctacactgagtttatccccttacttcgacagtaaattgagagaataaaagtgagaagtgtagagaagaaaaagattaaaaatgagcactgataactcacaaaaggatgaaggtgttcctttgctttccccttactctagtagccctcaactaaggaaaaagaagcgcaatcaaaaaagaagaaaggacaagtttgttggtcacttgaagtcagactcacgtaggccaacgcaactgctgcatgataatctgcaacacaatcacggccagattactgatttcgaccagatcgattcctggggcatgctgcatgaatctgattctacaagtaatgatataataaaaagtgaggatccatcgctcaagggcgcgttcattgatcatagaccttcaatgagccaacctagggaggggcctcaaagtgtatcaagcacagttcaaccacagccaataatgaagttttcaacaccaagttacaagaaacccgcagggttaagaccctctgatcagaatagatcattagtatcggacttatccccttcagagcttgaatcatggctgaagagaaggaaatctgttcataagagttttgttgacgaaaactcccccaccgataggagacaatcgaacgcgaataatgatgtcgtgattgatgttgatgcgttaatgaaccatgttaacaacaatgcaagtactggggttaatgataacagcaagagaagaaagaaaaagaggggttctgatgatagtagcaacaaaaattccaaatccacatccagtgattcaaacgatgaagaggatgagtataactcaaggccatcttctagtctttcttcaaataactcttctttggatgacgtttgtttagtgcttgatgatgagggtagcgaagtgccaaaagcttggcctgattgtactgttttggaagaattttccaaggaagaaacagagagactaagaagtcaagctattcaagatgctgaagctttccacttccaatacgatgaagatgaggaagatggaacatcaaatgaagatggaattcttttttcaaagccaatcgtaactaatattgatgtccctgaattgggaaacagaagggtaaacgaaacagagaatttgaagaacggccgtttaaggccaaaaagaattgcgccatggcatttgattcaacgtccaatggtccttgggtccaattcaaccaaggactcaaaatcaagaattcaaagcggattacaagataacttactagtcggcagaaatattcaatatcctccgcatattatttctaataacccagaacatttcaggttcacttattttagggtggatttggactctactgttcattctccgacaatatctggtttactgcaacctggtcaaaaatttcaagatttatttgtcgcttctatatactcccaagataatagcgctggtcatatcaagacacatccaaattctccaacacctggtataaaagcagaaactgtatctcaactccagggattgacagctaaaaacccttccactttatcgtctatgtctgtggcaaatatagaggatgttcctccattctggttggatgtcagcaatcctactgaagaggagatgaaaatattaagtaaagctttcggaattcaccctttaactacagaagatatttttttgggagaagttcgtgagaaagtggaactatttagagattattacctgatttgttttagaagtttcgatattgtagcagaaaagcatgttcgtcggaggagaaaagaaaagcaagaatctgctaccttggatcatgaaagtatttcacgtcgtaaatcacaagcctatggtgctactatgtcaaatgaatcaaatgcaaataacaataacagtacaagcaatgcaagtaggagcaaatggcttccatcgattttacgtgcacgccgtcggtcatctgcaaatagaacaaccaatacatcatcatcaagctataaacgccgtgtcaaaagcgaaaagaaaaagatggaagagaacgaaaaattcaaaagaaaatcaggagacaggcacaaaccacgtgagggagaattagagccattgaatgtttacattattgttttcagaactggtgtattgacgtttcattttgctcccacaccacatcctattaatgttcgaagaagagcaagactactaaaggattaccttaatgttacctctgattggattgcgtatgccttaatcgatgacattacagacgcatttgcccctatgatagaacttatcgaagatgaagtttatgagattgaggacgccattttgaagatgcatcagtcagatgattctagtgatagcgattctagcgatagtgattccgattcgggcgctagcgatgaggatgcatttccgttcgatgtctattctaaaaagacgtcctactctagtgcaaaatctagtgtgagttcaagaagtatgagcacttctgaagcgtcattcaatgcaaatttgataggttggaagagaaaaggagatatgttgaggcggattggtgaatgccgtaaaagagtgatgagtatactaagattgctaggatccaaggctgatgtgataaaaggatttgccaaaaggtataatgagcaatgggaagcttcgccacaatctgaaatcgcaatgtatttgggtgatattcaagatcatattgtaaccatggtctcatcgctaaaccattatgaaaaactgttaagtagatcgcattcaaattatctggcacaaatcaacattgatatgacgaaggttaataatgacatgaacgacgttttgggaaaaattaccatactgggtactattgttctgccaatgaatgtgattacgggtctgtggggtatgaatgttatcgtgcccggacaatacagggattcgttgacatggtttataggcattgtgctttttatgtgtatgctagcatgttctgcatatatgtatactaagagaagattcgggttttaatttaagtgttttttcgcgcattagcgcttgcttttccttcgattttaattatcagcctaaattattgttgtctttcccgaaggatagaattgtaaattatcagcgccgtatcgtatacttgtggtgataaatatctttaatctatttatgttttttttttttttttttttcgtgtctggtttctacatgtttgtgaacgttctgcatatctttatgtacgtacacagtatgttagtatgcacttatactatacaaagaataagggaggtgaggttaatcaataaggttaacgtaaaacatttattattttcatcaccaaactgttggaagttttgaattggttaattatcaaggatttcattgttagccaaattttccttggcgagatcttgtttctctttctggagttgctgtttttgttcttttttgtccttgtttatttgtttttgcttttctgaatcaatttgtggtttcaaatcgttctccaaattctttacttcttgttgctttgcgacttcattattgaacttttctttaggtactttagcttgttgtggttgcttattgttagtcgcatcagctgcaccgccggctgcaatattggtatgatcgcttgcacttgcagaaacatcagaagaatggctttctagcttgatctcagtttctttattcagatcagaataggcaacttttataacgaaataaacgccacataacagtataatgtatactataatctttttcataggggtagtcagataaccgccccttcttctggaattatatttgcttcctgttttataacgaggtaaaagatcttttttccttctgatatcgccctgcatattttctataattatgaatcactttagtttgatttatatttgctcagaataccctagctttatctatatagtactactactttggaggggaggaacgtatgttggaaggcaatagcactctggtaaagtgctaactcttaatgttaatgacgaaatcactttttttgcctttctgaaagattggaagactgtcactgagaaattcgctattcttttctttttcttcgtgtttttttttgttagaatactgcacagcttgctatcccgctgcacagcttgctatcccgctgcacaacatgaaattgctcacgtcgtgccaaattacatataggtgcttaccctgtttatattttttgccttcatagcggagtttttaagggtagcccttatgtttttagcgttcatttgaacgaatggctaacgctaaacggagaagagaggaaaacaaggccgctggcgttattgcgcgtaaaaacaggagataagcactgtttaacatacatttcattgaaagcttaaagccgcaaaagatgaagggttttcaaaattttcatctcttgcagtataaggatgcagtgaatctatctacagacagttgataaaaacgtctaccttgcctagtgtacccagctgctgtcaacttctttccttagcgcgtaaagagctatgttttcgataaaagatgcaacataaatgctacgatgtaaggcacccaggacctctgaaggcaaagaagttgtgaaatttgaaaaataatcgctcaaaaaggaataattgtcaagcgtaacgatttttttgattttccgaaatcaggggaggggaaaagaaaaggggaaggggtctcctcacaggtattgtgagctccaagcaatcattttgccagcactaggaaataataaaatgaaagaaaaaaacatacatagaaagtgccgctccggggcattttgagcgcggcaaaaaaagcccgaagatccgttcctcgaaggaacggcaaccgcacaccaagaaaaagggaaaaaggtggggttggctgtaaagtacgagcgcggggacggatccgtaacaatttctatgtggggccagcagccggctgctggtgggtactgttgtacgaagcggttggtagcgatgacagtggccagggctgctaggcatggtgccgtgaaaacccagcgcaaatgtcaggctgcaggaaccggctttctcccacgaggtttcactgctggcggcgtactggtcatttttagaacctgaaaacccgagctagaactaggactcttgagcaataaggtttgcgcattgctattctccggataaaccaaacccacccttttaagagcgtttaacaaaggtctcttatctatcaaaagtattatggctatttctgggattccgcttgcgggcctttctaccctcttgatgctacacatgtttcccttagatgcatgagcatacctgtaggtacttaaattttatttttatgcatcttatttctgtctaaatttgtatataacaagcaactgcagttctgtgatgtgtttttcgcaactggtcaacaggcttaagaatttttccgtctctttccgttttatttccagagaattaacatttatagagaaaagaattaaaacgtgaaatttcctttttgaatatttaacgcctttatcagttcggcttttttttcttttcttcttattaaaaacaatataatgctagtcttcggacctaatagtagtttcgttcgtcacgcaaacaagaaacaagaagattcgtctataatgaacgagccaaacggattgatggacccggtattgagcacaaccaacgtttctgctacttcttctaatgacaattctgcgaacaatagcatatcttcgccggaatatacctttggtcaattctcaatggattctccgcatagaacggacgccactaatactccaattttaacagcgacaactaatacgactgctaataatagtttaatgaatttaaaggataccgccagtttagctaccaactggaagtggaaaaattccaataacgcacagttcgtgaatgacggtgagaaacaaagcagtaatgctaatggtaagaaaaatggtggtgataagatatatagttcagtagccacccctcaagctttaaatgacgaattgaaaaacttggagcaactagaaaaggtattttctccaatgaatcctatcaatgacagtcattttaatgaaaatatagaattatcgccacaccaacatgcaacttctcccaagacaaaccttcttgaggcagaaccttcaatatattccaatttgtttctagatgctaggttaccaaacaacgccaacagtacaacaggattgaacgacaatgattataatctagacgataccaataatgataatactaatagcatgcaatcaatcttagaggattttgtatcttcagaagaagcattgaagttcatgccggacgctggtcgcgacgcaagaagatacagcgaggtggttacctcttcctttccttctatgacggattctagaaattcgatctctcattcgatagagttttggaatctcaatcacaaaaatagtagcaacagtaaacccactcaacaaattatccctgaaggtactgccactactgagaggcgtggatcaaccatttcacctactaccactataaacaactctaatccaaacttcaaattattagatcatgacgtttctcaagctctgagcggttatagtatggatttttctaaggactctggtataacaaagccaaaaagcatttcctcttctttaaatcgcatctcccatagcagtagcaccacaaggcaacagcgtgcctctttgcccttaattcatgatattgaatcttttgcaaatgattcggtgatggcaaatcctctgtctgattccgcatcatttctttcagaagaaaatgaagacgatgcttttggtgcgctaaattacaatagcttagatgcaaccacaatgtcggcattcgacaataacgtagaccccttcaacattctcaagtcatctccggctcaggatcaacagtttatcaaaccctctatgatgttgtcggataatgcctctgctgccgctaaattggcgacttctggtgttgataatatcacacctacaccagctttccaaagaagaagctatgatatctcgatgaactcttcgttcaaaatacttcctactagtcaagctcaccatgcagctcaacatcatcaacaacaacctactaaacaggcaacggtaagcccaaacacaagaagaagaaagtcgtcaagtgttactttaagtccaactatttctcataacaacaacaatggtaaggttcctgtccaacctcggaaaaggaaatctattactaccattgaccccaacaactacgataaaaataaacctttcaagtgtaaagactgtgagaaggcattcagacgcagtgagcacttgaaaaggcatataagatccgttcattcaacggaacgcccttttgcttgtatgttctgtgagaaaaaattcagtagaagtgacaatttatcacaacatctaaaaactcacaaaaagcacggtgatttttgaaaaaaataaggtcaaaagcaaataaaagcaagacaagctacggtatgacaagttttcggagaaataatattctttcttcctcagtttacaaaacaagtaggttggtcatttcattcggatatattctaaggaatgaaatgaacattggtgtttgtttctaatataatcttaagatattttaaattgtttctttccttttttgcctttctaactattacttcaacttcttttccgtatatttccgttttttccatttggcagattaaaaaaattgtgcacgttctggttttaacgtatagacttctaatatatttctccatacttggtattttttattcactttttttatacatatttggtttttttatacaatatcaaaaatcaataataattaatttaataacaagaatatgttgctgtgatgactcttaatatacaattgggaagcattcaaggattggtacgacgtttgctttctgataattaaacgcttggcgtttaatcttttttgccgattaataatattattattaccctcttatttattagcattgtcttccgtactaaaaggagtagggaaaaaggcgaagtagagtgacacgtccattacccagcgcttcataagaatccatcaggtatattaaattgtgatgggagaacaaaacaaattgtactatgatgtcgagaaattggtgaattctttgcaggaaagttttgacctggattgcgcgcaaagtgtatcacttttcaccagtaaatcaaggagcaatgaggcttggttggaagagctagagaataaattcaagttaaaagatgatgttgaacttgatgatgtggaaaatttaagagccgaaattgacatgaagttaaatatgttggaggataaagtaagctactatgaaagactttacaaagaactcgaagagttccagaatgaaataaaaattaaaacagttgtgaataacagaagacaatcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacttataaagtgttagtggtacggaaagtttccaaagacttggtgatcttagcacccatggtcttttcaccttctctaacccagactcttgggtcgaagaacttcttgtttggcttttctggaccttctgggttaccgactggggacattatgtagtccttcttgttcaagacgtagtctctgataccagtcaagtaagcgtattgacagtcagtgtccaagttgaccttgacaacaccgttgtcaataccagtgtggaattcttggacagtagaaccggaaccaccgtggaagaccaagaacaatggcttttcttccttgcaaccaacttgttctctggtgtacttttggtgttcagccaagatttctggtctcaaagcgatgtcaccagcgtacaaaccgtgacagttaccgaaagcagcagcaatggagaagtttggagagattgggtgcaaagccttgtagacgttgtaaacttgttctggcttggtgtacaagtcttccttgtcagcgttttcgttgttaacaccatcttcttcaccaccggtaataccgatttccatttctaaccattggtccatagcggccattctcttgaagtacttgacacaagtagagatgttttcttcatcggtttcttcagacaaatccaacatgtgggaggagaataatggttcaccgtgttccttgaagtaagcttcatcagcttccaacataccatcgaaccatggcaacaacttcttggcacagtggtcagagtgtaagacaactgggataccgtaagctggagcaatggatctgatgtagtgggcagcggcaatagcacccttgatggaagcattttgaccttcgttagagatacccttaccagcgaagtaagcagcaccaccgttagaggtttgcaaaatgattggggacttgctgtctctagcagcttctaaagcagcgacggcagtagaagaagaggtgacgttaatagctggaatagcgaacttgtgttccttagcgtaagtgaataagttgtggacatcttcaccaacgatgacaccggtctttctctttaagatttgttcaacacccattttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcaattatttagtactgtcagtattgttattcatttcttagggcttgcgtcagcttgatgaggatttgtgatagtagccgttggaggcatgaagggcattggaaacatggggaaaggaggtataccgaaaggtaacggtactggtggcactggcgtaccgccgttatttacagaagttggaaggctggtattgttgttcaagccagcggtgccagttggatccatcaacttcattttcttagtttctggctggttgccatctttagagcttccgtgtagttcctcttgtttcttcaaaaacgtttcgacctccttttccttgtcctggtcgggtactaaagaatcgagaaggatatcgcgggtttcgcaattggggcatacaaagtcgctctctaccagtgcattttccagcgcctcttttgagaaatctatgttacagcacttgcttgtctttaccggctgcctcaaaagaccacctgtcaagggacattttaaatcgtcaggaagatctttgaaatggccttttctccaaatggtttcatcaccatcaatttgacggttctctcttttcctttggtagtcttcccatgattgtttgtcttcaacttgtaccacgaacttgccttcgtccgtaatcataatctttcgctgagccatctcttccggtgtcattgtctcgggatctatttcaatggattttaaaaacttctttggaatacctgtggttcttctgattctttttccttcaaaatttggatcgctgttagttggacaatttttaatccagtggtctctacccccacaacgatagcacatataacctggtggcggtgggccttcgttttcttgtgcagaattcttattcgtctgtgacttgaaaaaaacaggtgtggctgcagacatttcttcttgcgtttgttcccattgattttcttgtgtggcaaacatactagcaattctttcttcttccgttgtaccactaacattagcagtggttgtagcagtgtgttgtctcttttgcaacactcttggcctaccagtaacataccttgttgcgttcccaagagctgctgctcccacattccctttaagtcgactgtgtacggagaatgatttaattgctggagatctttttactatgacactagtagatctaggtataacaaaggcatcatcgtcgtattcctcttctgtatctgggttgtaaatttttaattggaaatctgtgccgtcacctagtttgttctcttgaataatttcccttttcaaatcaaatactgtcaggccggtaccatcaaataaaattcttgatgtgtttcgttgagacttaaagcggtaaaatatcgtgctactcatgttacactattccagtctctgccgatatgatgagagctaccgaaatttcagtaccctcttgattgttcttgcttattttatgttggccataaacttggttattaacaatatgcttgatattcatcatcattgtattaactttcagtaaagttacccgcctgaattacaatgttgtgacataatataatggcataaggaaggttattgcaccagcaatggattaaggtagttatatttaccgcttatacactacatgataatgaatatatcaagtcgatcatccttttttatgttttaaaatactttacatacataactgtgtttttactttatctaaaaaaagagttgttatgaatttgtgattatttatatttccaaatatttatgatctcaaaacgtaaaaaaacataaaaaaaaagtgttaaccaaagaaattgaagaaagatagataaataagttccaaaagttctatgaattttcaggttgcatggcagataatgtcttctgctaggcaaatgtcaaacatgaactgaattgtcaatacaacataatgttagcttcattattgttgtattgccgggtaagctaattttactaataacaatattttcttaacgccttagaatactttgtgaaatattcgaccgaataaggaataagtagaagatgcacttagaggttaggagggggacacaggctatcgaagataacagtaaggataaatggcagtacccgggtattacgaattatatcgtagaagtactatagggaatagtttggtggatgctcttgatactttaattagtgatgggagaatagaagcgtcgttagctatgcgtgttttagagacatttgacaaagtggtggctgagactttaaaagacaatacccaatctaaattgactgtgaaaggaaacctggacacatatggattttgcgatgatgtttggacttttatcgtaaaaaattgtcaggttactgttgaggacagccaccgcgacgcctcccagaacgggtctggagatagccaaagtgtaatttcggtggataagttgaggattgtggcatgtaactcaaaaaagagcgagtaatatctatgctatatgcccggatgctttgttgaccaatagttacattgaaatttctctattatctcctctcttctaccgcttttaatacaagctctaggaacagtgtcatgaaataatgttttgtattcttttatattagggaacttgtgattcttctgtttttgttttttatttttcctgtctgtacattcatgtaataataatttagatttaaagttcaatctttttacttaaaaaacaaacgaagatcatggtgctaatattcggatttgagttgatcaattttttaaatgaagtattaatttacagtttatatattcactatagacctcgtaactcatctcttaaatcagttaaagtaaccactttacttccgtttagaatccattgatcgtatgcactatcaaagctagataaaacgttgatgaccattaggtaacattttctctttcgaataacatcaagatcagcttgcattaatatgtactggtacagtacttctgcagcagccctctcgcttttgttcaacattctaaaacaataaagtttcttaaaacactcccaatcaccactccgtagattttgtgacagaatactatccactattttaatatctactgtacgaagatatagctcgccattgtctgaatgtgcgttacacaagcgcagaagtgtgctgaaaaaatctcgtgaatatatgtcttcctgtaataataattggagaaaatttgttcttactgtgtcggaaagacactcgtgacccaatctcaaaacatccaagacttcttcaaacattctgaagtggattaaaagatttaaataatgaatatgctgtttttctttgaagtcttgcagttcttcaatctgaatttcttttaatgaatattctgctgacttagatatacatttcaaagcaaattcttggctgttatttctatcaaataagagagataattgataatagaatgcagaatgcctatatggaactgtaaaggtgcacaaaagatctttccatatactatcaccgtgatagttttcactcttaaggtcttctaagaatgtcggcaatttatcattgatagcctccggataatcgtgtagttgaaaaatttcataggattgatcgaaattaccacaactaaataacgtcatggcaaacataaattcttgcacctcgttgtggcgtaagtagaaggggcattcaacgttctcgagaaagaaccttatattcttatgagatgtgttttcaatgatatatgagcggaaaaacgtcataaagaaagaattttcagtgatggaagcattgtaaacattagagtttaaggaatcgatataggcaatgagttggccgtagttaaaaaatttgacaccgaaagagaattcagaagaatccttgagaagaacttccgccaacagacacttatcttgtctataaaggtttaacaataaaaattgcttataatgcaaatccaataatgtagatatatgctgtccgaaaatttcggtatcaagatcgaacagaacgaatgttaacaatacttgtaaagtaatacgataatgtatggaaagtaactggtgaagagattctagggaaattatacttgtgaaaccatcgaatttgattgcagagatgaaatcctttttccaaaatataccaggcttcatttggttattgattaaatcatttaaaacaacgggtatatcaaaagagtttaattcgtcgaaaagaatctttagatttgtgatttcaaattgattttctaggcaatttttgaaaatgtccgtaaatttttctacggtagtcatagaatcaggcagctctcctgttattatatcaagaaacttcttagaaatggatctaagaacatcatttgacaaagtagaagcaaaaccattcaatgtccttaaatacttgaacaattcagaaccatcagtttcagagtgcatattataaaaccaattctccacagtagtattcagcttgtaaagggaatgattatacggttggaaacaattgacgagaataatttcatcgccataaagtgttatagaagaagcctcgttgaatgcggtttttacgtctctcaatattgtttctaaattagccaaatattcttcatcttcgttatgagccataataatcttattttcactcaatatttgctgtgcacgttcaaaaatttgggtaccatatcttgatttcaaattacagaaacccctctcaacatctccagtctttgtaacgatatccaaatcatgttcggattgcaaatctactaaggatttgttaactgattctatccattcatagtttttgaaactttcatcatttacgtttagtatctgtaacttgctagcagtgccacttttccataaaacgatcaaatttaaataactagcctcgacattcaactccaatggtctcgttagaactaaatctacaattgaccaaatagcagaagctgaaagattagtggggatgttattttgaaaagtataagtcaaaataccgcttgaatcaaccaacaaggtgcccatttgaaaaagcccattttccaaaggcaacaatgtaactagagtattgttatacaaggaaaggtattcccctacagcttccacttttctaaaatggcttgggtctgaatctgactgtgaaaccatatcataatcttgtattaaagtaaatgaagttaaatcccaaattttcaagtggcaattctgagtcaacacaattaagtatctttcatggaataatttacaactaatcacactatcgtaatccgatttagaactcctagaaaaaaatcgcgttaggcttttcaagtatgaattatcattgaatagtaaaggctcgtaatgtacgccgtcaactttttttaaacccaacaaaccgccatcttccaaaaaaacaactgagaactggggtgatacatagaaaaggaaatgaggaactctaactgtaaagtcgtagggattttggagatgaaaccactctccattgagagtgttggccgatgaaaataggaaacttaggggtagttgtaacgttaaaaacgaaccatcttttaagataacattaaccagtaattgctgttccacttcttgtatcgttaaagtgtatctctgattcatagaagcatttggtaagtgtatattaattgtcttcccatggtatgcgtcactcaaaggataaaatgtcaacaatgttgatcttgaggaaaaatggtaacagatatactcagagttactcaataacaaacaattggaatattcacttccgtaaggctgaggaactggtgtagagatggacttatctccttctttcagcccgttattattactgttattactgacgtataaatcaaccgtattattgggttcaggtttttcataatattggagcaaatttgcatcaattcttgagaggcatgccataataggtcagttgtgtacgagtgaaattgcgacctcttgaaaaatgcttatgaacgttggatttcgtcaatttctacttgtttctcagcttctcatgctatttcaattcaatttttttttcacgtaattggagaaaaagacaggaaaacaaaaaacatgaaagttctgtagggtaatggaaaagaaaatattgatgaactatacatatctacggcaattgataaacgtgtcttaataaaatcatagaataattaaaaacgtcctaatgcgtgttaagaagtaattaggaagtttagatacctatagaatcaaagaatagaagctaaaaagttgatgcagagaaaaaagagagagaggttacatatacattaaaaatgagaaaggggagtcctactctcaaattcaaatacaaaatacgaaaatttttctaatttcgctagacttagatcttttcttccacaataccgtgcttccagatggcaacaaatggagtggtaccatcttcacggtagttcaacatgacaaccatggcatctgggtccatggattcaccagtgaagaactcccagtccttgaaagaaccaataaccttcttgacgtaagtttgagcacccttttcgaatttaggaacttcttctgggttagtttcttgcaacttagctttaacagccttcatgtaacccttaatgtaggtcaagaaggacttcttgtcaaaagcggtttgttgtagacggaaagagtggacaacgttgttgaccatttcagcaccttcttcaacatcatcgtcaccaccttcagcagatgggttagcaccgatatcgatgttgtcacctccgacattgaccatagcacagtcggcttcgtagataacgtcatcaactaacttagcgtcgtaagcatcagacaacaattcgtcgttagagaagatatccttgtaaataatcatatttgtctatagtatgttctgtgttaatctgctaaccgcaactgagaccccagaaagaaaattgttaaaaagctaaaatgaaagtagtaaaccattgaatgaaaacattaaccaaaataaaatttttttttaagtcccaattgaaatacttctccttataaatatcatgaaaggaagaaaaaaaagtgaaaaaaaaaaaaaaaaccaataaaaaaataaaaaaatatcaattctacgagaaatgcgtgcgaaatcgatgagttttgttttgcctctgaaaaattctggaaaatttttcttagcggaaaaaagaaaaaaaagaaacgtgatgtgaaaatgtgttcactgagctcatcgatatacacattgaacagacacaaatctattatttgtttcgattttcttttacgtctccaaagcagttctactgtatagagaccagacttcttccgctatttcagcgggtgcgcttgtaccgcttgccccaatggttctctccagcatttctttagcctccactggcaaattttggatcatatcggtccctttgactaaacctggagatatcgtaaaacacctaatgtttcttggttccatttctgcagctaaaacttctgtaaatctggacagcgcggctttagaggcggagtaaacagatgtacctggaaccttcatttttccggagtgtagaatggaggaaatatttacgatggtgggtcgagcagattgaccactgagttccggccatctcctttgcgacttcatcatatacttaatacagatgtttgtcatcgtcacagggctcataaagttaacattcattatgtcctgaatttgagatgcagtggttcttacacttaatgattcttgagtcaagcctgcgcagttaatcaataagtttacgtagtagcggcgttcattatttgaccatttgttacatgggtcgaacaatgtggaatatttctgtttcaagggcggtctatctttgaaatattcgataccgtcatatgactcatagtcaagccagtgaggccatttcttaaaatcaattgctatagcacattgccgctgatatgataatcccgattgtaattggcctctatctatcgcggtgcgctctatactttctttagtagacccaagtataatgcaacttaaacccttttgaaataacttttgacatattgccttgcctatacccctagtggcacctgttactatcgcaacaggcaaataatgcatttccagacttttcttctcccacgtctataccaatgtactcatgtgtattccatagttctcatcagttgcaaacagtaacggcggaaattttgacgctgtgatatataaaacagaaaaagtggcatttccaaaaccccgcaaaataaagacacagctagctagatagataacacaacatatatataccttttattatttacgtacgtatatatatatatgcaaaatttaaatgatatatgacatcatcaaaaggatatggaatccttgcccaaacattgaagaaagtaaaacataatagtggtaataaaatgtgtatttaaattcattgtattttattccccatttcgttttttatgtgggaggttctacttctcccttattagtagaaacctcttgaatttttagaattgtaatcataaccgttgtagccatatggtacaccttgttgggcagcagcagcggcagcggcagcagcttgttgctgttgttgttggaattgatagtattgttggaactgcatttgttgttgtgggttaacaggttggccattttgcatttgaacttcaggttggggttgaccttgaggttgctgttgctgttgctgttgtgattgcttctgttgagagtcttcagaatgctgggcaacaccttgatttggactttgctgttcctgaccgttttgagtttggtaatagttgtaattgttctttggtaactggtatggatattgaccagctacaccgtattgaggttgaccatatgggaatgactgttggtaaaagtgggcgtagtatggcatgaatgagccaccgtatggctgttgttgttgaggttgggcgtgagctgtagctggagaagcggcagcagcagcggcagcactagtcaaattagcagcagcagtgttcgcgcctgcttgaccataaccttgttggaaattatattggttagcattaccactagtttgagcgttgttttgagcaagttgctgatattgttgaccgtaagcgtatccttgtgaatcaaacatacctggataagaatatccaggaaattggttttgatacatgtagtactgttgggcagccacgttgttcccttgtttttgactttgtggactttgctgtgattgaggttgttgtgattgaggttgtggatgctgttgctgttgctgagcatattgttgttgttgggacaaatactgttgctgtaactgatgctgttgttgagcgtattgttgctgctgttgttgagtatagtagttttgagataattgttcttcttgggcttgagcttgagcttgtactggttgttgttgctgttgctgttgctgttgtagttgttgttgtggttgttgtggttgctgtggttgttgttgttgctgtggttgctgtggttgctgtggttgctgtggttgctgtggttgctgtggttgttgggattgttgttgtggttgaggtacagtattagcttgatcttctggaggctctgaaataacagcactaatttcaaccttttcttcaacaactgtaacttcttcttctggagcagcaacattatcttgttcttgttccagctcttccgctgtctgttcctcttcttttacttgttcctttttttcagcttcttcttggacttcttctccgtccacttcagggactctgtcttcattttcttcagaaggttcagcagtctcctcctcttgttcttgtgcagatgtttcttgttcattaactttttcttcactagcttcagacttttggtcatccttcttaatatcgcttatttctttcttcaattcagcaacgttttcaagaggagactcggtctttttaacagcctttggctttggtgtagcaattgcagcccacgacattttctttggttgtgaagcagatgtcctagaagttgttttctttgaagataaagaaggttgctctatttgtttgtgttcttctttgttattatgcccttcctgctgttgttgctcttcttgctctttttcttgatttttctcctgcgcttgttgcccttgtgcttctaattcttcattattgttatcatttgaatcttgaggaacgtcatgtttagtatctacagaaacagctgctgcccacgatgtagtgtttgaaacaggcttggatggtacgtgcttccccttgtcgagattaacatgtttcccggttgtatgagctcgtggtgtttgtaccttcttcttatttctggcttgagtataattgttactactgttatgctttgtagaagtaaaagaattgctattattagaactcttatatgtaatatcatcttctggatttggcaaatgttgttgagggacatatgagtgttgttgctcctttttttcatatttttccttcttagcaggtttctttacttcatcccatcttgtcactgcgccggaagtaattttatcaattatagtttccaaatcatcatattcttgaactatatcaattaaatcatcactcgtccagtcagggaacaattctgtaagcgtatctattttggactttagcgcaggatttagttttttactactatgactattatgattagacttcctaaattgtgtagacattatatatatatgatgatgtagattatattgagaaaacgaccaaacaaaaataaatatgtaagtactttatgatggtgatttttttggggtaattggtaagagtttttcttgtagcttcaaaagatcaaatataaaatacgaatgtttctgaaattactgtaaaagacttaggaaaaggaatgaaacgtttatatgggagagaacgaaaatttttccttttcccgccactactttttgccaccatttcccgttatttatttgggcgagtgctcacctccgacggaatcacgggtgacggatatcctaaaaaggtaaagaattgaaacagatctattaatatacggatcactatacattattataagtcgatattgcagtattagtatttacatgttgaataatgcacattctgtgctaaaatatatacttcatttgtcaacttcttttagtttgccgccattttcaaacggcgcctcctccctagcttcgtctagagcaggcttaataccttgtttgacgagagctgcgttgacacatgtagtataagcgtaccattgttttgagcactcgttctcaacggattttcccttcaggaatttttcgctataccattcattaaaacaactatcgtatttcgtcttcaggtcagtgcattcaggcgcaaaactagctgacattatattccccatataaaactggtattattgttattgtaattcaagttaaaacacaaacagatgttttctaatgacctctcccggcatatatctggcgcacttagaataaatttctacatgcaaatactctgaatattctgaatgtggctctccctatatcgaagaaaaaatatagcgggcccattaccctgcgttctgatattcatcactagtaaaaattgtatgtacttatttattctatctattcgtagaaaaatgaatgatggtcccaggctttggtacttctttcgtactctcttcttcatcgggcccttcgttgttatcatccgcttgtcccttcgggtggtggtgcccctgcttcagaggcgagctctctatattattgctgttctcatcgtcgttatcgccgtcgttattaatatgttcttcatgagccagttgcttccgcattttattgggcacaatcggagacggtaccatgctggaactagacccgtactgctgctgcaaaagtagcgaaatctttcttttgcggctttgtctctgtattgtactttcatcttgctcatcatcagctccaccatgaccctcgcctgtaaggtctgtttgctcccttgaaggcaccgcctctgaaccagtatcttcgtcgctagagtccggaagtttcaatatctgtcccgtggatgttatattcgctgtgtggaaatcatctatactgtcgttattaaacatagaatggacatcccggttgacatgtacagctgaatctgcctcgttaggcccattgtctgtctgggactgcctactcgcctcttcagcggatgtaggaaatataccaacattattgctcacaaggcttttgactggagcgtttcccactggtgcagctgcatttgcctgcaaattcaccagcccagtctcttgaaacatagtccccagccattcggtgctatccatgatccgctcacatatttctgaatatgtagccacgtgtgggatgatgtcctgggtgatcttatgaaagcagaaactcaagttagagtctatcttctgcaggttcactgtaatttcttgaacaagtttttccaatgtttcctctttgcttgcagaatccattttttgtgtcaacaatcccttatgttgctctttccatacgttgatcaacctggctctattcccaccccaaactgtagatatctattttgttgatgcctcagctcaccaaaacaaaccaaaaaaacggaaaaaaaaaacggaaaagaacggaaacaaacggaaaagaacggaaaagaaaacaggaaaaactcgctgttctgttacccgcgcggcactaccgcatttaatcggagtagctactaatcaagcaagggcctccgttcctctatgacgcaccggacatatcgcatttccactataatagtgcaagtaggacgggataaggcccaagattatcaatgaagactaacacaacggtcttgccagccatatccaactctaaacatcttccacggctgttcaaaaacgaagatctcttacccctctgcggcttaagggctctgttcaattgaaggatccgcggcagtaaagtaaatggatgaaaaaaaaaaactggaaaaatagcaacttttttcagcctggaagatttgtcatctaagcgaaggagaatgaaaccggaattttcactccttcttaggggcattcagtttataaatatagttattccctgaagttgagatttactgatttaacatctggacaactaaaaacctaaataataagacacaattttttgcgggattttttttcctttagatacttttaacattcatagtaaaaagttctgctacatagtaaaaacacatagaaggtacaagcaatagcatgattcaatttaaaagtccaggtaactggctgttcatagtaccctggattgccttcattccatggtatggtatgctgatagccatgcttatttgctgggccagtcaaggccatcccatatattggttcatgcactcggagcaattccctgtgtacatttcagatataggtgccactaatttaaggccactgtttatatcgtgcgccggctggcagggtctaggctatgtaatcactgttgcccttgagttttttcaaagatccggctatctgcctttccaactgaaaaaaaaagacccttctatctctgattccacatcttatgctgagaaattgcacagcggtaaatacttaatgcctccatattacacaaaggatgaacggaacctgattttcgcagcttttgttctcggcagcattggtgaactagcccttttattcagttccatcttctcaaccgccctgtaccatcgcgttcacattgctatggtctctgttttcgtcgtcttcatgttcctatccacttgctgcttgattgcagagtatttcctcatgggaaggcactatgcctcagtccaccccctagccagccctcatttcaatcctcaatcatctgaaaaaagctttaaccaagattataacactgtggatgagctgccttggtataaatggaaaggccatgtatggaataaatttaccatcagtgcaactctaaaagttatatggttaactctcgcagttgtatgggccatttgttttggtgctatcaatgatagatctaagagtgcttgtttcgaatggttgctagcattttggtttggtatcatatttatgattctttccgccgacttttatttaggtggaagatacagacaatcccgctatttcaaccacgtggaatcattttcgggttattacaagtatgacaaggcgctaggcctctaccacagtgaagacgttttgccttcggacgataacgccggcgtgattgccacagaaacagcatcttcaaatatttacaataattcctcttccaacgaatctattcaagtagtcgtatgacctcatatatgctagacttgactaggaaataccctctaacctgcaagatatattcatctttttctttccaaagcacaatttaataaaacttgcaagaacatcgtcatcatttcccccttttatttttgttatccccgttactgatgtaactaatacctaattctatgcttctcaatctgtatagtagttttccttttgccgaagaatttcttctggctgcttttttttttgacatatttcgcattgtccacaatggtcattgcgttaaaagctagaaattaaaaagagaatattgttcagcatatgtagtttaagttggcaaatttgttctgctcttgatgtacctagaataaataaatattaatcagaaaaataaaaaaaaaataaaagtaatgaaaaaaaatataacaaaaccaacattaaggtatatattacagcgagtagcggcaccggttatcatcaaacgattgatagaaagttagataacctctttgaaaaaactttccttaggagaggtattggaatcgttggaatcgcgaactcttatctccgatccctcttgatcgtcttgatcatctgtaacttcattactataatcattttctatcgaaccttgagaaaagccactaaaagaccggcggccgttgtcgttacaatgggtaaaatcgtgccccttttttgagtccatttgatccaccacaggctccctcttcatagttacagactctgttttggatagtccttgtttatcggcattcttattaaataaaaattgttctatcgttatggagcctccactgttcgccgctggtcttgaagatttatccctcttgtttgcgatggaatcttcaccggtgccatctactgcttggtgcactttatatgacttcacttcatcgtcaattaattcattctccttattggaggttggtgttttaggcccatcatccaacacgccgctaacaccagtgattgacctagcactggcagaactatcaatatcctttcctgtattataagtagaaaggaaacggcttttaacaacatcttttggagatgcactcttccctataggagtcactttttcattgttatcaggtgtactcatgataacatctcgagaaaaattagaattattctttgactcctcagtgccccttctagacctcttagccgtttccttctcctcttcgagcttcttttcacactcccgcagcataatgttcctgattataatcatttcatctacctgtaattctttcaacatacattcttctgtagccatttctgcttcttcttttgccatttctgcagaaataaccaaaggatcattcacggtagcatcaagaaggtccttccttgttggaattttctgtttctgtacagctggtatagctccaccagcatctgctgtttccccaaaaccatggattgcagttttatgttcagcaatggaagcgacaagtctttcgatttctacctgtattttgctgcgctcctccaaaagctcatcataccctctttccgaatttcccaaattgtcaaagtgtgatctgacggcataatagtgttcaatgctcgaatttttgagatctctttcacatgcatcgttccaatcattcaattcatcattctctcctgacaggttcttggacaacctttcctgtagttcgtttcttagattttcacgattttccctagcattttcaagttctttttccttctgctgtaatttgatattcatcttttgtacgaactgatcataccgttgtccctcctcggcctttttagcttctttctcctgttgttgttttgaagccatcgctaacaataattgcccgtcgttttgctcttttgcacgttccatagaattcccatcctcatattcctgatcaagaactcttgaccttctctcaatatctttatcaacatcacgttgtctgctggctcgttcatcaatttcgttcaccactggtgatatcaactttttggcgactgcgttaacctcttctggagtcatccacaaaccaccacccaaatatattttctttttttcttcttgtttaacagaatagtgctgtagagctatgttaacagcaagcttattgtaagcttggttaccaaataaaagcatgtaagtatcgcgcgagtcaatatcctgcaatttcctattcgcaagcttttgagcttcatttagcactaccggagatgctacctgctttatgtacagtttcttttgtgcctctcttgcagcaaaatctgggtcttccaatgtcttcgggtcaagatctttaactgcatcagctgcaccctttgcacacatatattgttgatcacttagcctttgtctttcattaccagcatgagactctaagaactgctctgcggaatgttcaagtttttccaaagttcctttcttaaaaacttctttgttagcttttgatacaccactttgatcgctgctttgtaatccatttttaaagtttaccttttggggatacaacctgtcattaactctgctaatcgcccttctttccgctccatccaataccttagataaatcgagggatttgaaacctgcagggtgctgtggattaactaagtttgcatcaaactcattaccaataggggcaccagaaaacctcttttttttaacactggaactgtcggaggtgcccttcatggaattgtctaaagaaggactgaaagccaatgctttttgtgcagctaatcttgttaaaaaatcacgccttcccttcagacctaaattgaccgttattgggacgtcttcaggcggggtcaatggaatcttggaaaaggttactttgaaagcctcacctctggccttttgctcgattgctgtttcgacacagtcatcaggcgagactttcgttctcttactagctaaacgggccgcaagatcaactgactcactcttggagtctcctaaaccaagtgttttgtaattagccggagtattcaaaatgccatacttctgtttcgcacggaatatcgcctctttactcaatggttgtccactctgctggtaagtagaatatatagttttcagtttgtgaacgctatttgaaattgagcgaggtgtttctggagcagcgcgatgcatttcagaagaatgtagcgattcttgcaaagtggatactctaaccgcctttctttcagtaatttgctcaggggacgtctggacagattccacatcggtggtttgcaacgcagatattagtgacattatagtattgtacttgttcctaaagttttattgtcaatcacactctaaaactactgatttgaactcatgtgatcacttttgtttagacattgtagaaaacatggtgctttctatgaagattttcatgtgttaaataccatctttgagtgcatcattttccatcatgtatatcctgcagaagtatcccttaatcagtctgaaaaagaaataacctctacccttaacctttgatttggagcttcatcgcgaaatataggggactgccaaaaatgtcttacaaagccaacaagtgaacatgaaaaaaaaactgtcaacagcggagagcacttgtcgaaccgaaaggtatgctaatatgaccttataataaccttatttaaaacatttaaagtaccttaagtcaatataaaccccgaaaaagggaaaaatcggctccagccctgaagcacaaatatcactaaataaactgtcccctgattcttcttgctagttgcatgtctttcttcattatagtaattctttttgcatgcagcgccaagaggtttgtatgttccaataatcctaccagatacgcttcgcttgcttcctgtaacgccataatcgccattgactgccaacgtaaatcctgatctttagttgtaaactcgtctgtaacttctttcactagccttgcaaatggaattttggagattaataaatccgtggaacgttggtattttcgaatttcgtacagagctaattcactaggagtatatttcttttcgacgcgctttaagctctgctttctttgtttttccctccttttctgtctaacatatctgtctaaggcatatgaatgagttcgcactggtgcaggtacttcagtttccatttcagcttcttcttcattttctgtctcgatttctagattacctgcttggtcttcgtagtctgtttcgatatctaggtcactttttgagctttcataacgtcttctttcctctcttcttggaaacaggttctttgtcgctcttgttctctgcaataacgataacgcacgatcgttaatagattgttggtctcctgaagcctgttgacgttactgagtgatcttccactcgaatcactttgaatagcagaactaacccattgttgtttacttgacatgattatgttatattagtattctttctatattcagtccttcttctgttttttataaagtaaattctcaagattatctactactgtttttaagagatgttttctcaatatttatcgatgaagttttgtttttcttttgttttcaatttacttccgcgatttcgcgacacagtgggatcaagataaatcatatcgttcgatattctcgcaatagaagaccactaaactctcaattgataaatgttgatgtcgatttcaattatcaatgatggtatattatgaatattatctttagtgttattaatacaaatgcaaatgtgggtaatttgccgtttctatatatatatttatgtatttaccataaccaagtaaatcaattaataatcatatttcacatcggctatacgattatcagctaacccaatccgacagatatcatcctgtagtttcatctatatttgaccattatctgcaaagttcagatacgtttttacatcttctactgtttctcgaatgtcactatcttccgaatttatgtatgctttaaagttgagaatattacttgaatgagcaagctttctagcccctgaattgttaaccgtgcgctttccaacagtcctatccattagtggggaactcggtttgtcctgtgagcaattaatatgggttctgttcccgttctctttaggggaactctttagtcttatcatggctttgataggtgttgggattttcaatgacgaatgagaggatgactcgcttctgtcagttttcatgtccgaattctgcttatcattattcacagtcaaattaggtaagctttcatttgacctacaaaaagtatctaagaaatccgtaacctgaatggcttcctcccctaacgatgaacaataatcgctcgagtctggcgaagatctaaggaccgtagtcgaaaaacattctttatccggttcctcgtcgatatgtatcgaaggtgttactttactagttgcagataccaataccttgtctttcccttttcctgaggtctttttctttccttttttagtcagtagcctaccaaaaaatcttcttacaggaccttcgtttcttacggggttcacactggacgatgaaatttgactgtgattcctagaatctatgggctggtcacgcgacaaaacctttactaaatcctgaatacttatgcgtaaagtaacgtctttctccaataaccttttaatgactaaatcgtttaaagtattaccatttattttggaactcaatgatacttcgatgattttgtggtaggtttcgaattcattttccccgaaaaatggcagctcgttgtacagtaagcagtatagtgtcactcccaatgaccaaatatccaacttaaagccatccgtcacaaaatctcttttggaattgcccaaatgacatagctctggtgcaataaatgccggagtaccaacaattttgttcaattccctctgaaaacaatcttcaaaattagcatcgctgaaaggtaatgattggggagtgaaaatacaacttccaaaatcagaaagtttcgctactttttcttcttcatccaataaaatattggacggtttgatatcacgatgaatacaaccctgagaatgcaaatattccaacccttttgtcatatcctccaggatttttttggcaaatgtagaaacactacaatttgaaatcacaatttttttccattgcggtaaaatatcttcatcatcgtcacgtttccactgtagttcaccaaggctgcaccaattagtgactatccagatagattcgctgaaaggagagtccaagcattctattagtcgcacaatatgaacattatttcgaagtcttgaagccgcaaaaatttcccacctacatttttcgatattcataagtctcatagcctcattaccactcatatttgtcgttatttttcctttactcttccaaagctggatttgcctcattacttgatttactgaatattgctgggcattccaaggtttttttggtataatcttgacagcaacaaccttgcctaaagtagaactgtacgcttttcgtacataaccaaattgtccacttcctgcagagactcctagcgtatattggtttatagttttcttatcttggtcactaacagttatttttttcacatatggtcgaatttcatccaggatcgtgtgtatattttctcctataattgtactataggttggtttctgttgagaaaaagaagaaccaaatgaagatgtctggctcgtaggcgttatcgggggactatctaactcatcctctcttatgcacgattgctgggataatggtgcccattccggaattaatgtcggtataagctgtcgaggtgacatttcatgctaagtaattattgttaacctggcgttcaaaaaataatatctatgcgagtaagtttgtaacacctaaagaagtatcatcggggggttttcaaggccaaattagttcataggactagagactgttgcattgtttatttgttgctacctcatcattcacaaattatacgtttaaagtgatgtaaaatcatgctatatactaatttggcataacctctgttgagcggcatcatttaatgatttacttctattttaataattacttcatttcgaacaacttaatagctacttcaagaaggatcaagtaagttcctcgaagcactatgaattccggaggtgaagaaccaactataaagccaaatgtatttaatattactcaacttttaaactcaaatggtgaaaaaccgggaattgcttgcatcttcttaagtaaatttgacatgaaaaagggaaatatcataatatggtctaaaagtattaatggtgcggcaattgacttaagcaatattgaatttaaatcgttaccagccggtattcacgaacaaactgacgatgttgtcaattttgtagttcctaaagaattagatgtctgtcaaactgccaagacgacaacttatgattacggcatcgcctatttcaaacaaaattcgttcgatattattgagaatgacaatcgtattgataggagtaaagttcaaatgttttctcttggtgtaattatcgatgtccaaaatgcctcatcagatagtaaaaagcacttttataaggaaatataccatgcgtatgctgccaacagatactcaagctatctagaaagtttactcggtcaatggataaggcagcgtgatcttgataagtttgatatttttgaaaagttttttgacgagaataaccaagggcacatggctgaaaattcagtagaagtctttgaacattcacccaaagaaagacggcatttggttgaatatttgccatactggacaaggaagttagggcctctcatatttccactttggaaagcaagtctccttcagtcaaggatattgatactagttcctcaaggagaatcgttcgaattgtgcaattctttggcctattgtgtcttcttaatatcaatgcttccaaaaaacttgataggaaaccatgtaagcgatgaatatattaagcctattttcacggtatcaacatcagatattccttttctagagtcgttcaaaaaggggaacggttatgtggctacgaccagcgaggaaattttgttgtataagcctgaaatttacgacatagtagtcaaacttacttcgagctcaactatagaagaatcaccagaaaaagaagtggaaattcttaccgcatctggtgaacaaaacaaagcaactcctcttgacttagaggtgtatgaaaaacttatactgggggagttacaagaggatgcctctacaaatgcgacatgtcgacatcatgaggtgacagaacccatatcatggctacagtttttaattgatgggttttttcttttaactactgcaggctatctggtagcgccatatcaccttgcaaataatttcaagattccgaggcacgtttctggcccagaacccaacaattcagaaatacagatcgctgaaaatttagttcgctattttcaccgcagaacatcaaatctgtacaacgatctgaaggatgtcatacaaaaaagtgaaaatattgattcagaacaaccgattactatcgcagcttcatttttaaccaagttaaatttggattgctttagcaaacaagatcatcaattcgtcaaggatatcgcccttaaatggttccaaagaagcattgatattagcaacctaccagaatgtttgggaaatctctgttaaccactagaaacgagctagatcatgtgagagagatagtatatgtctttgtaactgtattttatatttatatgtatatggtgaattttacttaaattccttggtagattacatacacgactctgttgcttgttcattccctaaaaatcagggaatctaggtaaaacacatatgaacaaaggtctccttttttttttttctttcatttctttcatttttttcatttttcatttatggaaatgttaagctttcataagttctgcatcaaaagactaaccacagagcacatgcgacaattgaaataccaatgacagcggtaataatacctgcacctgcctttgaacccttagtgatatttaatggtgccaaatttgtgggttgcgcttgagtacctgctgccccatcaccaacagatgaaccaccattctctgccgtgtatggtgcgggtttatctaaggccctcgtgttgaccattacttctaaggcggacatttgttcacctagaccatacataccatcccaagtcccattgaaccaattcaatccacaggtatgaccatcagtacctccagaacatgatttcgcggccgcaatggcagatgtattcaaccaagacataatttggttcctagtttctggcactagttgtgcagtgacacctaagaaacgggcaaaataggctttgaaggaacgttgatctgtattacaagaatttggaccttgacaagcagcttcatacacaataccatcatggaaaaacacttgggaagcgttcaaaaactctttggttcttgtgtgccagaggtctgatcccgtaaagttgtaaaggtaggcagagccagccaacagcaaaccttgattatatgtccattgatatgaggtcactttggtgcaattatcatcaatgctgacaccatcgtaaacatacttataggtaccattagaaattaagttcacaccgaccatccactcgtaaactttttcggcccagtcaacatatgtttgattacctgtatatcttgctaatcttgcagctatgtgaaacaaggcaccgttagaaacggtgttcttgtaatcgtaaccagagttccaaacgaaaatttgccacctcaaaccaccaccacaggaatcggcatcccaacgcaaagccatggtattgaaaacagcctgtgctaaatatagccattgaggctcattctcgggaggattagtaaagtttctctccgcggcagtcatagcagcaataccccaaaaggcttggtcatcattaccttcagtggtagattgatttagcggaatatagtcattatcatcaccagcttgatgtatcattgctgctataatttcatcattataggtgtcgttatccatgaaaaaccagtaatctagcatacagccccaggcaccaccggcttcccaccaatagtacggatctgaaaacataccgaccgtcttaccatactgattaccagtgtaataatccattaaaccgtaggcaattagtgaagtagcattttgcaaagattcgtagttgtctagatccaattcgacggcatttgtaaatcttgttgcgaagagtacacccagtaaccctatcactttatttactagcatttttatgtgttcgtttttaaaacagactgaaaagaaagaaagctcagaaaaaaagtggtgtgtattttgttgtatccactattatatgtcctggaaaggtttccctagcgttttgaccctttcgtatcttgtaatttaagcctctttttaccaaaaatcctcccgttcgcacacctattaagctgcttataaaatatgagtatcaacacagtaacagtgaatatataatagatgagcccattatacaaagagtacctatgatcatcatgaaatccgagctttatttccatctgccagttttctttctggatgtacgaaattaaatcgcgcctcgaacgggtgcaaaaccgggtgacgggacaccgctacgaatatagtacgatacacttatacatatatggaagcatttatagcgtatattcatcgtacggtacattctttaaataaatgattgaatttttctgaaccaacagttataagctgagatccagtgcgttcatgaaacggaacatcttacatcatcaagagcccagaagcacggcgtaggattgtttccgctgctacagacagacatggaaacactgtttttatcaggccaaaggtgatacgacaggtctcttcttgtttcaatattgccttacatatctgctgctcactctatttgctttttcctgctcatttatagttaacttgatttgaaattacgcgtcgcggggaatcgcgtaaaactcgatattaaatcctgtgattttgcaaaagtaaattttttactatctacatctctccaatttgcacaactttgacaggactgataactacccaggtggagcaaccagtgacagcaggtaaagcacaataaggagaagaaatgttcaggcagtcaaaaagaagaattgcctcaaggaagaattttagttcatacgatgatattgtcaaaagcgaattggacgtaggcaacacaaatgcagctaaccagatcatcttaagttcaagttcatctgaagaagagaaaaaactttacgctaggctgtatgagtctaaattatcattttacgatttaccaccacagggagaaataacgttggaacaatttgagatctgggcaatcgatcgtctcaaaattctgttagagatcgaatcttgcctttcaagaaacaaatcgatcaaagaaattgaaaccattatcaagccgcagttccaaaaactactgcctttcaacacagagagtttagaagacagaaaaaaggattactactctcatttcattttaagattgtgcttttgtcgttcaaaagaactgcgggaaaaattcgtcagggctgaaacgtttttgttcaaaattagatttaacatgctaacctccaccgatcaaacaaaatttgttcaatcattggacttacccttactacagtttatctcaaatgaagaaaaggccgaattatctcatcagttgtatcaaacagtttctgcgtctctacagttccaattgaatttaaacgaggaacatcaaagaaaacagtatttccaacaggaaaaattcataaaattacctttcgaaaatgtgatagaactggtaggaaaccgtttagtgtttttgaaggacgggtacgcatatttaccacaattccagcaattgaatttactttctaatgagtttgctagcaaattgaaccaggagttaataaaaacgtaccagtacttaccaagactgaatgaggatgaccggttgttaccaattctaaatcatctttcgtcggggtacactatcgcggatttcaaccagcaaaaggcaaaccaattcagtgagaacgtagatgatgagattaatgcgcaaagtgtctggtctgaagagattagctcaaactatccgctatgtatcaaaaacctgatggagggtcttaaaaagaaccatcatttgaggtattatgggagacaacaactgagtctgtttttgaaaggtatcggcctgagcgctgatgaagcgttaaaattttggtctgaggcatttacaagaaatgggaacatgacaatggagaagttcaataaagaataccgttacagcttcaggcataattacggtcttgaaggtaacagaatcaactacaaaccatgggactgtcacactatcctttccaagcccagacctgggcgcggagattatcatggatgccctttccgtgattggagtcacgagagactatctgcagaattgcgctctatgaagttgacccaagcgcagatcatcagtgttctggattcctgccagaaaggtgaatacacaattgcttgcactaaagtgtttgaaatgacacacaactctgcatcagcggatttggaaattggcgagcaaacgcatatcgcgcatcctaacctatacttcgaaagatcaaggcaactgcaaaagaaacagcagaagctggaaaaggaaaaactattcaataatggtaatcattagtgcagaaagggaaaaggaaaaaagcgaagagataactaaaaaggattaatagtatacgtaatttagtctactgtaagtatggtcaaaaattttctttagtgagaaaaaaaaaaaaaaagagaaacgataaacgctgtacaataccagtgactgcactgctccgaaaacgtccgagatatgtatattgtccgaattttttcatactttaatagctggccagagaaaccttataattttgtggctgcaagctatcgcgctgttcctctgtgacaggcaacacagaacaactaaccgcctgtcttttatgcctgtacacttcattaaaatttaccgttttcttccattacaagcggggacactttccgtttaaacctgcaatatgttgcagggcctatccacgccaatttactgtggcagaagttactgcagtggaagaactaccttttccagcatagcctccgccaccaaaaaatgcaggtgctgcgttttctggatacgtggctggcctttaaaacgcatgggagggacagtatctcaccgatttggtaatgccgtgatgcaacctcgaggatccggttttcaagagcggaagtaaaaaaccgggaagatctaatatttccttatgcaggtattctgtgactaaaaagtatagaagactattttgcaccgctccctgattagacttcgtgcgatattattgatggatatcgtctttatctttccgtggacctaaaacggcaccccttcgtctaggataaacgcggtcggctctttcgaagactaaaaaagcagccacaataacgttacatgcaaaatcagcccactcgaagttagatactgcgtagacggatttgcacgatgcgatgataaatattagggacagtgcgtgcccacccataagttgctgtagagcttacaaattgtaaagactaattccaatcgcacgcccacccctcacgggaataagttagaatgttgcggaatgaacgataacttcatattaggtaaaagggaagaatgcaacgctgcggtctacgggcttttttctgcgagaccaattttcttcttttgtttttttatttcgatatttagttttcatgcaaacgggtattattcttgacaggccattatgtaagagtgtggaaacataattcttgcacatacgacgttttcttaactgttcctgtttcaagttacggaaacgcctgtggcccaggtagcgtaggcaaaatcaagctcagaatgggttacgtaattatgacgttttcgagtgcgaggatgtcagaaaggagagccagaattatatatatatggatgcatctctctgcatataaaattaatttccctttcgtacagttccctacttttttttccctctttcgtttgcaaaagaaggcggccatactcattaaaaacccctccccatttttccttttttttttgtttccatataggaagaactctacagctcgaacaatacatcaaatcaatcaagcagtcgctctcgttctattgtgtgtttctcaccaccttacatatctcccctcagttcccagcctataactttgtggttctcttcttttcaacttcttcttcttgacattatactttaataagaccattacttctttttctttgctggaattcataattcattaagcagaaaatatgtaccatgttcctgaaatgaggctacattaccccctggtgaacactcaatctaacgccgcaataacacccaccagaagttacgacaatacccttccttcgtttaacgagctatcacaccagagtacaatcaatcttccattcgtccaacgcgaaactccaaacgcatatgctaatgttgcccaattagctacgtcgccaactcaggctaaatcagggtattattgtcgctattatgctgtgccttttcccacatatccacaacaaccacaatctccatatcaacaagctgtacttccttatgccaccattcccaacagcaatttccaaccatcttctttccctgtgatggcagtgatgcctccagaggttcaatttgatggatcattcttgaacaccttacatcctcacacagagttgcctccaatcattcaaaacactaatgatactagcgtcgcacgtccaaataaccttaaatcaatagcagcagcgtcaccaacagtgacagcaacaacaagaacacctggcgtcagttcaacgtcagttctcaaaccacgcgttataactacgatgtgggaagatgagaatactatctgctaccaagtagaggcgaacggtatatcagtcgtgcgtagggctgacaacaacatgattaacggcaccaagttgttgaatgtcacgaagatgacaagggggagaagggatggaatattaagatccgagaaggttagggaagtcgtgaagattggctccatgcacctcaagggtgtttggattcctttcgaaagggcttatatcctggctcaacgtgaacagattctagatcatctgtacccgctcttcgtcaaagatatagaatccattgttgatgccagaaagcccagcaacaaggcatctttgacccccaaatctagccctgcccccatcaagcaagaaccatctgataataaacacgaaattgctactgaaattaagccgaagagtattgatgctttatcgaatggagcatctactcagggtgctggcgaactgccccacttaaaaatcaaccatatcgatactgaggcccaaacaagtagagcaaaaaatgaattatcataagcacataacataatccgttaactctttgctctatgaacaagaaccgaagttctagaaaggctgataggattcgtacaatcatttttacggtcgaacttctgtagttactcgatatataaatataaataacggacataaaaaaaaaaattgtaacattataaatcataaaatcataatcatatctatttctaacttctgactattgcgcaattcgttagagtctttccaccacgtcgattggacaaatctttatctgtctacttctaatatactgtacatcatacctgtctttttatgctgctattgtggaggaaccgtcatcttttcgcgcgaaaaaacaatatgatgcctttttgaaacatgttattatttgattttttaatggcttctattacgcgtcgtggttggtgaacctggtacaaaataaataaaaaaatacctgctaaaaaatatcaaataaagtaaggaaggtaatacaaaaagagagcgttggctcgtgttacacaaaagcggtttcgaacacaatcagaagaaaacaacaaggacttttttgcagcgccaaaaaaaagaaaaaaaaaaccaagagaacgaaagctttataatagccttttttttttttagaaaacatgaacggatctcccactcctaagcgatattcatccaaatcttcaaggctttacgacgactactataacatcccgtatcaatattccaatccgactccaatgaatagagactataatgacgtggggtcacgtatcaatgcagataaactggtaccagaggaatacaaacggaatacagaatttatcaacaaagctgtccaacaaaataaagaacttaacttcaaactgagagaaaagcagaacgaaatattcgaactcaagaagattgcagaaactctgcgctcaaagctcgaaaaatatgttgacattaccaaaaagcttgaagaccaaaacctcaacctacagataaaaataagcgacctagaaaagaaactttctgacgctaattctactttcaaagaaatgagattccccaaggtcaaggaccccatggtagatgacgaccctgtctccgaaaattatgatcagataaatgtaccaaaacacagagcaccggatgctacaggtaatcctcgtacaactaacaaagtctccaatacttcagaccaagatagcagactaaaagccattgaaagaaccctctcggtcctcacaaattatgttatgaggtcagaagacggtaataacgacaggatgtcacccttaccttctcctttaaatacgatattgccaataaataatcgtctgaattttcaagagccaaagagatataatccaaccgttaaggtaaatccgtctgatgacgatatcatgatgtatgaaagtgcagagctgaagcgtgtcgaagaagaaatagaggagctaaagagaaaaatacttgttaggaaaaaacatgacttaagaaaattgtctttaaataaccaactccaagagctgcaaagcatgatggacggtgatgacaatataaaacttgacaatgtttcgaagcataatcatgctacgcatcgtcattcttcccaatccagtcgcgattactcaccctcttcggatgcttgcttggagtgttctaatgatttatacgagaaaaatagagtcaagcctgaaaataatatgtcagaaacattcgcaactcccactcccaataatcgatgatgatttaaaaagcagttaaggagtatggcgcattcttaaagcgttctgtgtaattacggcaaaaaattccatcacaaaatagaaagtctttattttactttccattgttattttccaacagaagccggaaacgtaaaggccttttatattaagtgttttctcattataggatatataataagaatttgtaattgttacttttctttcagttttcattaactactttaaaccttagaaaatacattccaatcctacgaatagacgtataagtaaggattaatgctatcggaaagcaacttaaataactataaatggtggatggttagtgtcataatatcttaatgaatatcgcttttgacgatatagtactagcaatctgcggttccaatggaatgcgtaaacgcataataatgaagttggaataaaaatatgctataccaacaactttcatctaagtagtctttatttgacatatatatgtatatacaccgaacaatagatttaccggtgcatttcattatcaacctttagtagtttggggggcagttttctgggcaatacaaagtttacttttgatggattatataaaaaaagccatatgggggccagaccctaaggagcaacagaggagaatcagatcggtcctgaggaaaaatggtcgaaatatagagaaatcgttgcgggaactcacagttttgcaaaataaaacccagcagcttatcaagaaatctgcaaagaagaacgatgttaggacagttcgactatatgcaaaagaactgtaccaaatcaataaacaatatgatagaatgtacacttccagagcgcagttggattctgttcgaatgaagatagatgaagcaatcagaatgaacactttgtcaaatcaaatggctgacagtgcgggcttaatgagggaggtaaattcattggttagactacctcaattgagaaatacgatgattgaattagaaaaggaacttatgaaatctgggattataagtgaaatggtggatgataccatggagagtgttggggacgtaggggaagagatggacgaagctgttgatgaagaagttaataagatagttgaacaatacacaaacgagaaattcaagaatgttgaccaagtgccaaccgtagaattagcagccaatgaagaagagcaagaaattccggatgaaaaagttgatgaggaagcagataggatggtaaatgaaatgcgtgaaaggctgagagctttgcaaaactagagtgttactgtgactgtacaaagaaaataaataaataagtgaataaataatggtacgaataacacagtaaaaagggcacccgtttttagtgtatggaaaaagttgagtgctttaccctttttccatgatgaccgttgaaacatgtacggactatcaagtaatagtgagggtaaagacagtatatacacacttccttttattttcgtctcatcttgtattttcatttgaaggacggaatatttacttttcatggcttgtatttttactcgattccaactttttttcaagcttatcaaattcctttaatgctatttcttgctcaggatccatgatctgaatcacttctttcacttcatccacatagtgcttcaacatggactcaataccgtacttcaaagtcacttcactagaagagcatgaggtacatgcaccttgtaatcttaaataaacggttccagtctttggatcccacccacggtaatcgatatcaccgccgtcctccaagatggctggtcttattcttgtatctatcagctcttcaatcaattcgctgacctcttcatcttcttcggtaagttcaaatttgggcatatttattttgtagccaccttctccttcttcttcttggacagcatggaattctttggatataacatcttcaccgtaagcaagttgcttggttaacaaatctataatttcaggcttgatactattccaatggaccattctgtctttattaatagtgagaaaatcatcacctatcattaaagactccactcctggacactgcaaaaaaatttgctgtgctaacttggaatggttgatgaggttttcatcagtgttcttaataactatactcttggagccacgcgtctgtagcatctcgccatctgtggagagaaattttaaagcattttcatttggagttgttaaagtcttaatatgaattaatctctgagaatttaagtaaaaaatcggagacttccccaatttagccactgatttgaacattgttagtcaatttcttgcttttttgcttagattacgctgagaatgccttatgtattctaattagtccgctaaatacgcttctttttataatgattaataagcaatattgtaagtagatcactgaaattcggaaaacttaaattatttatcacttgatacgttagaaggctatttctacaatcaccaggactccgctaagtggtcctatagatttgatgaaatgcctgctttgacggtcttgatgatacaagctaacgcttagcatgttactatactcaatgtacattgttttatcctcaagagaccgcagacgtttcaattttgtgtttaaaagaacaatggacagtatatacgtagtgccaattttcttctatggtgtattatgcgcattgaacattgtaatatccgtaatgttgaacataatttgggaattgcttccgaatcttcaaccttcatgtatacctcttttcggctagagtgtggtactttaattactgcttagttgttttgcccgatttagatattgcacccgtgcacgtcacacataagcttggtcttttaaatagtgtgtgaaaaaacgaacttgaagaaaaagatagagcaagatatatataggagtaggaatagggagagtggaaaaaaaaacttagcctcaaactaatagtcaagaggatcaactattctgttcaggttttgcaggttaaaaattgaaatagaatattttctcggtaatttcaagaaacagctggtaaaaaggcagtaaatttacagaaactaagagtgtaagggcacaatgagagtatatcagttttgccgacctttccaattattcacctgcttcttatgctaccttctagtgttcgtaaaagctaacaaggaaaagataagtcaaaagaattatcaagtatgcgcaggtatgtattccaaagaagattggaagggcaaaatagacccgtttatatcattcaatcttaaaaaaataagtggattgagtgatgagtctgatccaggcttagtcgttgcaatctatgatttccaagactttgagcacttaggtgtgcaattgccggatgaagaaatgtattatatttgtgatgattatgcaattgatatcgggatttgtgaagaggagaatcgtgatgagtttattgttcaagatgttgtatatgatccatatacttccacaaatagatctttggccaatccaatcatgacgttttctcaaaatgaggtcggccttcatgatactagatacccaataaaagaaaccggattttattgtgttactgcgttcagatcatcgacgtctaccaagttcaacgctgtggtgaatttcaggaatgcttatggtcagcttgcgggcaccgagatcaacaaattgccactatatggtcttttggcggtcgcatacgttgtggcgatggcgttatattccttcgccttctggaagcacaagcatgaattgttaccattacaaaagtatttgctggccttttttgtatttttaaccgcagaaaccatatttgtatgggcttactatgatttgaaaaatgaaaaaggtgatactgcgggaataaaagtttatatggtgttcttgtcgatattgacggctggtaaagttacattttcatttttcctattattgattatcgctttgggctacggtatcgtgtaccctaagttgaataaaacgttgatgaggcgttgccaaatgtatggtgcgttaacttatgcaatttgcattggatttttgatccaaagttatttgaccgacatggaggcaccatctccactaatcttgatcaccttgattcctatggcgcttgcattaatcatattttactacatgattattagatccatgacaaaaacagttatctatttgaaagagcaaaggcagatcgtaaaattgaacatgtacaagaagctactatacatcatttatgcgtcctttttgagtgtactagctggtagtatagtttcgtcatttatttacgttggcatgaacactattgatatgattgagaagaactggaggtcaaggttcttcgttactgatttctggcctacgttagtgtatttcattgttttcgttaccatcgcgttcttatggagaccaacagatacttcatacatgctagccgcatcccaacaactacccacagacccagaaaatgtcgcggactttgacttgggcgatttgcaatcgtttgacgatcaagatgacgcaagtatcatcactggtgagcgtggcatagacgaggatgacctcaatttgaattttactgatgatgaagaaggacacgataatgtaaataaccatagccaagccacgggccagtgtctccctctccaacaaaataacgctacctccagcagatttgattaggtgatgagacaaatagtttcttcgagggcagtcacgaaatgtttacaagcgaaaagaaagaaattatgaaccatatgcacttctgttcaatgcgatgtgaatatgaatatgaatataaatatgaatataaataaataaataaataaatgcgttgcacgtttcttttcatttatttgtgcgtgcttttacctgtttataactgtagtcaccaaagctatgctatactctagacctaactttttcgttttgtatttatttagccgctcgctggagttttttttttttcggtgataagatgatttatatcaaaccgaaacaagcgaaaagtttctgttcatcgactataaaatggaagagaaaattggtccatagacttttcatgtgtacttgtttatgagaagagacgcaggaagaccagaagtgaggaattccctttgttcaaggatgaacaacgaagccagataacgtaaggttgcgcgctgcatcagtgctaaccttattagctttctctggctttttcggtctttcctatgtaacataacatgtatattctatttgtttatgatgagaccacgtccttagtgacaatgctataaacccagctcttcgattcgtttttaatgaaagggagaagatttttttgtcaaacgctctgagtaatagaatatacatgcgacaacatttgtagttacttgtcttacgcttcctagggaacggatcatccgagtagaatatcattttacgggatcactttattcggtgtgattgctcgttaagccgcacgaccattttatgggcacgcttccgcaagttggttctttcatcagaagctttaccacgattggcaagtcatgtagcatgtgcgctaacatcgtttatcgttttctgtgacgtggcttatgagcaccagagacgaataatcaacagtacatcaaacaaaagctacgtcacctcaccaataatccgagcttcttgaaatggcaggtattggattcataaaatatgtcgctgctttgtgcattttcctttagttttttccttttttttcatgtagctaactaagcaagacgattatgggaagggaccttttaaggaaaaacaggaaaaaaaaatagtagcaactagtaaaaattcaaaaaataaaaaaagtcaaaataagaacacatcagttaggaaccgtgcttggagttttgagactggagtattgtccatccaacatattctgctctttcaccatagacttcgttggaaatcgcctctcccttgtactatattgtgcagaaccgttcccgcaattttcattggtgcaataataacacgcttcttcgattctcacatttgtcaagaagctgtactcttctctcaaactccaatatatttcaaattatgaacgagctgaacactgtttcgactaactccagtgactccaccaagaacggtggtacatccaatagtcccgacgatatggactccgcagcagcagcaagtcacgcaataaagaaaagaacaaaggcctcccgggcctgcgatcagtgtcgtaaaaagaagattaaatgtgactacaaagatgaaaagggggtctgctcaaactgccaaaggaatggagaccgttgtagttttgatagggttcctttgaaaaggggaccctcgaaaggctatacgaggagcaccagccatccaaggactaacgaaatacaagaccacaataactcaaggtcgtataatacgtttgataatagtaacaataccctgaataataatacgggcaatagcggcgacaacggtataaacagtaacacagttccaagtaccccttcgagatctaattcagttttattgcccccactgacacagtacattccccaggctggtggcattcctcctagtttccaaaatccagcgatacaatcaactatgcccgcgggtaatattggccaacagcagttttggaaagtgccctaccatgagtttcaacaccaaagaaaaggatctatcgattctttgcaaagtgatatatcggtaagaacattaaatcccaacgagcagttgtcttataacaccgttcaacagtctcccataacgaataaacatactaatgattctggaaatgcaaacggaagtgtcaccggctcaggcagtgcctctggtagtggtggttattggtcctttataagaacttctggtttactagctcctactgatgatcataatggggaacagacaagaagatcaagttccataccttctttgctacgaaatacttcaaattctcttttactaggtggccagcctcagcttcccccacctcagcaacaatcgcagccacaagcacaccaacaaaagttgcaacaaggacagaacctatactcgtattctcaattttcccagcagcaaccgtacaacccatcgatatcatcttttggccagttcgctgctaatggttttcattctagacaaggatcagtcgccagcgaggctatgtctcccagtgcacctgccatgtttactagcacatctacaaaccccgtaaatgttgcacagcaaacacaaagacctcaaggacagcaggtaccgcaattttcatctgagttggatggaaataaaaggcgacaatcagcccccgtatcagtaacattatccacggacaggctgaatggtaatgagaataataatggtgaaattaacaacaataatggcagcaataatagcggttcttctaaggatacatctcaacattcccaagaatctgtaactacaccagcggctttggaagcatccagccctggatcaacgccacagagaagtacaaaaaaacgcagaaaaagttacgtatctaagaagacaaaaccaaagagagattcatctatatctataacatcgaaagattctgctcacccaatgaccacttcatcaactatcgcgtatggacagatatccgatgtagatctaatagacacctactatgagttcatacatgtaggatttccgatcatacctttaaacaaaacgaccttgaccagtgacttattgttagttaacacacagccaatttccaatatacacgaagtcaattcatatgttattttgtggtttagaaattcattggaattgttagttcgtgttgctctgaaacaaaagccaggtggcaagtttttcgataatattgttggcgtggctttgtcgccaagtaatgacaacaacaaagctgggttcactacagccacggcaagggatgatgctgaaaaaacaagacgtgattcacataatgaagtacaggatactttggaagtgcaaagcgtttttattgccgccctcaatgaatgtttccaaaaaatcgtggatattcatcccaaattcagagaaaacaacgaccaaatttcgccgaagatcaaagtcatttatttatctacttttattcttttaaattacattttggcatttgttggatacgataactcatttgtacttggaatgtcggtgacaatttttaacgaatttaaattatacaaacttctattatttccggagccggatataaatgatgtgaagcctccagttgatgaagaggtcagcactggtaatgggaatacaaaaacgtccgaatttgaaattggatctgaaagtgctgggcatatgaatccatccaattcaccaaattccatggacgaaaacattagtcactattcagtgttgtttaaaagattatacgttttgctttcagtgtttgattctttacaaagctgtgcattcggtggtcccaagctattaaacatttccatccaaggttctacagaaagatttttttctaatgatttgggctcaaaatggtgcctggaacaaagccaattgagactgaaaagcgtcttgcaaagcttgaaattgggtgaattgatgagtgagcttaccaggaatagaatatcaatgaacggcaataggaagcctgggttcgatattacgaactcgtcttcactcttatcggaatatgtggaaactcaacctctatccgtagcacagttattttgcaagctattaattggcaaacacaatttcatcaattgcttattatcattatacgattcagaagcaggagtctattcagatttgacattggatttgagttcgaaaatagcagactctctgtgctcattgatatcaataattttgcaagtattgacgttgatattaagactgaatcctacgaacagtattgattttaattatagaccaccgaacccacccgctaataatccgacagtgcaagagggcccatctgctatgggctcgtctccagtcgctgggaaccttagcgctgcacctccatcggaggggaatccagatttttacaagaaattactaggcctgaaacaagacactggcactatcctttcagacctttgccgggggataatttccccctttgctattgctatcctgcacgaggtctacaacatcactgaactggtcaagcagatgcctacatcactcattagcattatgatgacggcaactacaacgcagaatactcaggacaccaagaagtcgcaggacctggtcatgaagctgtcaaactcgatgaatgaagtagttcaaatcaccagcgtgctgacaatgatcaagccattcaagatcttcgagcacgagcttaataagcccataatgtccctgacaggaggactttcgtccacgaccagaaacgacgtcatgtggccaaagtcgggccaaggcctccgcgagtcatcagtcatgaagacattgcttgatgaacgccgtacttctggtacacaaccgacaacggcgccagtagccgcagaggaacccaggcttgagaacgttgccctggaaaatttcgttagtatcggctggaagctgttggacgattccgagttaggctggtattgacaggtaactatgctcccttctcctgtaggtcaggttctcccttctcctcaggcagaaattcgcgtaaagaactaccatgcaatgaatgaccaatttaagtaaaacacataaataatacttacttacacatatacacactagctgttttaacctgtaacaatactgccttgtcagagtgcgcacggccttttactctggtgctccaccatcttccacggtattcgagagtcgccaagctcaggggcgcatgcagacaatgggcggggagcaccttcttctttcacagctaaaggggtctttctttctcctacttttggcatactttttcaggggcagaagtccttattacgcacgttgctaccgccggcttgctgttacacctggtgccatcactattgccattgccattgctacagattcaattccggcgcttgcaaagtccaaagttctggtgtcggtttgttctcacacagatccctgtacagcgtcttgtaacctgatccccttcccccgccccttctcgaacagcctgacgcgcttcctcttttgtttgggctcggcccgtttttgcatttcctttccctgttttggattgagtatataaatctaaacaaacaacaaagttcttccagcaggtaccatgagattgaagttacggttttaggagttggagattcaatttctggttctttccacatcagcaacgttaaaaggcctagtcctcttccgattatataatataacttccacagcaagtgtaccataacataataatgtccactaagaagcacaccaaaacacattccacttatgcattcgagagcaacacaaacagcgttgctgcctcacaaatgagaaacgccttaaacaagttggcggactctagtaaacttgacgatgctgctcgcgctaagtttgagaacgaactggattcgtttttcacgcttttcaggagatatttggtagagaagtcttctagaaccaccttggaatgggacaagatcaagtctcccaacccggatgaagtggttaagtatgaaattatttctcagcagcccgagaatgtctcaaacctttccaaattggctgttttgaagttgaacggtgggctgggtacctccatgggctgcgttggccctaaatctgttattgaagtgagagagggaaacacctttttggatttgtctgttcgtcaaattgaatacttgaacagacagtacgatagcgacgtgccattgttattgatgaattctttcaacactgacaaggatacggaacacttgattaagaagtattccgctaacagaatcagaatcagatctttcaatcaatccaggttcccaagagtctacaaggattctttattgcctgtccccaccgaatacgattctccactggatgcttggtatccaccaggtcacggtgatttgtttgaatctttacacgtatctggtgaactggatgccttaattgcccaaggaagagaaatattatttgtttctaacggtgacaacttgggtgctaccgtcgacttaaaaattttaaaccacatgatcgagactggtgccgaatatataatggaattgactgataagaccagagccgatgttaaaggtggtactttgatttcttacgatggtcaagtccgtttattggaagtcgcccaagttccaaaagaacacattgacgaattcaaaaatatcagaaagtttaccaacttcaacacgaataacttatggatcaatctgaaagcagtaaagaggttgatcgaatcgagcaatttggagatggaaatcattccaaaccaaaaaactataacaagagacggtcatgaaattaatgtcttacaattagaaaccgcttgtggtgctgctatcaggcattttgatggtgctcacggtgttgtcgttccaagatcaagattcttgcctgtcaagacctgttccgatttgttgctggttaaatcagatctattccgtctggaacacggttctttgaagttagacccatcccgttttggtccaaacccattaatcaagttgggctcgcatttcaaaaaggtttctggttttaacgcaagaatccctcacatcccaaaaatcgtcgagctagatcatttgaccatcactggtaacgtctttttaggtaaagatgtcactttgaggggtactgtcatcatcgtttgctccgacggtcataaaatcgatattccaaacggctccatattggaaaatgttgtcgttactggtaatttgcaaatcttggaacattgaaggtgcggcttgcaatcccttttttactttcaattctccgttaggttatttattctactacacgcagtttttttttttcaatgggttatatatctctaatatatacacatttatatgtttagacttatacagaagcaaaaaaaaatgcaaaagaagcttagtgttcataattcttcactcacgtcatgttatatatttgttaagcgtagcttcagtatatatagagattttcctttggcggggtaagggtctgtgaactttagggaaatagaataaacgtaagttaaaggtgacaagctcggatcgtcatctttcaattatcaccccaaaagatattgtaaaaaagcaagttcaatctcgtttgttacatttgtcccgtatttctactaattcaggcaaaaaaggaaagtcctacagcaaaagaggcaaaagtacagtatggaaatcgatggcaacactctggtgttcataatagtgatccttttcctatttttctcctcaccgggtggtgatggtgtgtcttctcaatatgagttcaatcaactccagagactcaagcagcagttccgaacagagcacaatacgttcgtcaatatgacatatacagatagttttcgaaatattaccgggcttaaactcagctaccaagacatgctgaataatcctctccaaaatgccacttacccactaccaggaaaagattatgatcgatggtttcccaatcaaaactacatggttttgcccaacgatgtcatagaggccataaatactgaagtctggaatacttcgaatgatgacgcttccaaccttttccctcccaatattacaagcaccctgttaggtaaaatcgaccttgtatcaaataacaagtacgaaaagataaggatgcctgtacccagattctatgagccggcaactgatttttcagaggatattcctcctgaaggtgagacgtactggtctgagtggccttcgtatggcgaacttcataatgtgagttttcagcatggcgaaatagctattcaaatttctcatatgagcaatcttcaggacaataataattacttaaggagaaatttcataaataagaaaaatgaccgttggaagttgttaaatcttcagattgatttctcagataaggctgaaaaggaaaagcattccatatactcgaaggctgtatatgacattcaacgtggtagaattctttctatttctcagagttctaaatttcattcattgttcgcccttcctcattacatgtccttccagaatgattataatgagaaaatatttaatgatgtcaaggaactcgttgatgaattttggaatttcacggattacacagatgtcatgaccatgaaagacgtacaggatgcttataataatgccaactttaaatgtgagtatttgatttttcttcagttggaaccatggaatcagtacacaagagatcagatcaagttaatagatgatgaattgaattggcccctggggcgtccggcaaatctgtctagtttaccgcccataaatgttgtctctggattactgtattctccagactgtggcgtacgattagggcttcataacgtaaagggtacacggtacgaattaaaaataatgtcgatcagaaaacatctattgttcggtattgcattatttgcagcccagatatacttattgcttactcagatgcatcatacaaataccccctccatggtcaacaaaatctcattctattgtttctcaatgataaacttagtcgatggttccttggccactttgtactttgtcgcagctagtgtcgttcccgaattgtacttacccctagttataagtgctttttcgtgctttatcttggcatctatttttgaaatacgctacttaatttcaatttacgcttcacaggttaacgaacagaatgttgggattatcaacctcctgcgtggtaacactggcacatatgatgagaataggccaagacccgcattcattcccgatgaagggtctatcggtggctcgttatatggtaggtttttctttatgctaatcattttcacgtttttaatattgagttcaacttcatggccccgtcagctaaggatggtatttgagtatatcctaatcttcatattaaactcatattggatccctcaaattttccgtaacgccgttaaaggtattccttcaagaagagaaagagcaagatctagcattggaggaaatagaagtcaaaacaaaatgccattattgtggagttttgtaattggtacaacaataattagaagcttgcccgttgtgtatgttttcacttactcctctaatgtgttcaggcaccataaagatgttcatttcgtcgtatttttatcattgtggctactgtttcaaattagtatactgtattctcaagatgtattgggatcgcgctggttcttgcctaagcacacaatacctgatggatattcgtatttcaagcccctttcaaacgagtatatatcggagcatggtggtggaactgctgaacataccgttgattgcgcgatatgtatgtctgatgttccaatttacatagaggaaattccagaaactcataaggtggatcagcactcttacatggtaacgccttgtaatcacgtatttcatacttcgtgtctagaaaactggatgaattataagttacaatgtcctgtgtgtaggtcaccattacctccgttgtagatagcatctcttgatcctaagaactatatactgtatttgtattcaagatccaagataccgtgacatttcctatttgtcaaccattgcaataagaaattttacatgaatagtgcattaactttttattaccactaaagtagttttgcttaaatatacaataggcaaactagacttaggataattcacaagggtttttagtgttaccctttttccgtatgacacatttttcgaggaattaattattgggaaaatattgccgatcaagatccattgaggtgaatctaaatcgctccaactccaagttggggaatcttaagaccgtcactgccttccaattacactgcttttgtttctttgacaataagaacgcaaaagtaaatttcttttttttaacaaattatgacacatcctgtagcagtgaaggcatgtctatttgacatggatggtcttctcatcaacacagaggatatttatactgaaactttaaatgaaactctcgcagaatttggtaagggacctttaacttgggatgtgaagattaaattgcaagggcttccgggaccgaagcaggaaaaagggtgatcgaacactacaaattaccaataactttagatgagtacgacgaaagaaatgttgcattgcaatctcttaaatggggtacttgcgaatttcttcccggtgcattgaatttgttgaaatacttaaagttaaagaacattcctattgcattatgtacgtcttcgaacaagactaaatttcgcggcaaaacaagtcatttagaggaaggttttgatcttttcgataccattgtcactggtgatgatccaagaattgcaaaaggtaggggtaagcctttcccggacatttggcagttgggtttaaaggaattgaatgagaagtttcataccgatattaagcccgatgagtgtatagtgttcgaagatggtattccaggcgtaaaatcagccaaggcatttggtgcacacgttatttgggtcccccatccagaagcacatgctgttttgggggacacagaagctttgttagccggtaaaggtgaactattgtcttctttggaaaaactggaaatgtccaaatatggactgtgaatttccagtatttacgtaaacaatatatttgtatattgcactaagtataaaaagggatgatttgtatttgatttatcacactactttatgtggtgagctcagttatttttgtataatatactatagtacatgtttgggtttttatcgttttatttcaatctcattacaataaaatattatagtgaacatgcacatcgaaaggaaagattgcaatagctggtgttcaaaagctttgtgcaaatgaattcagacacgaatgcatttaaggacataagaatttcatgtgttgaactttctaggatcgcttttttacccaccgaatcatttgatccaaattcattaacgctattggcatgtttaaaaaaagttgaagagaagttatcagcatacgaagacgattcactttcgccaaaatttgcagattatgtttttgttcctatcgcgagtttattgaaacagccagctctcggcgagtctcaaacagaatacgtcctactaattatatttcatctcttacggacatgttggtcatctaatggtaaattctccgagcaattgggacaacaactgttccccttaatcacatttttagtcagttctgataaagataatcaaaaattaattactagatcagacgagttcaagtacgctggttgtttagtcttgcatcagtttttcaaatcagtaagatcgcaaaggtaccataaagagttcttttcgaactcaaaacctaatttacttcccgctctaggacattctgttaccattctgttgaaaattctggagcaatcgccccaaaataatgagcttcaattcaaagctttggcatccttagaagtactatttcaggacataatatctgatggtgaaatgctttcctttattcttccggggaacgtttctgttttcgctaagatacttactaaaccaggccgtcaaatacattataaggtgtgtgttcgcacgctagaggttctggcaaaattattggttttggtttacgatgattttagtttggatatcaaagtaaataagttaacagatattcgagagttgagcgatacaaagttaaaacacgagataaatcaatcatttatgtttaatggacctattgttttgttacgcacagatgggaagacgcatagagatacaagttggttgacggcaacttctgggcaaatcaatattgctttggaggcctttatacccaaactattaaaacgtaataatgaatcaattgatgaggcattagcgacatttgtatcaatccttttaactagatgtgaaaattctttaaataattgtgagaaagtgttggtatccactttagtacatttggagcgtgatccgatgtccaaattaccatcgcatttggtaaaattaaaggaagttgtcaatgaagacctgcacaagctaagtgacattattcggtttgaaaatgcagataggttatcatctttatcatttgcaatcactattctagagaaaaataacgaaagagatacaatgatcaatgaggtagttagatgtttatttgaatcgcttaatgaatctattgagccaccaagtttgatcaatcataaagagagaataattgaacaaagtagtcaattaacaactacagtaaatttcgaaaacttggaaagtacgaatgctctgattgctttaccaagattatcagaagacatgtcactcaaactgaaaaaatttacataccatatgggttctttgttgttagaaagacatattctcaacgatgtggtgacagagttgatttcagaacaagttgattcaccaagaacgcagaagatagttgcgctgtggttaagcaccaattttataaaggctatggaaaagcaaccgaaggaggaagaagtctatctacaatttgaatctgatgccaactattcctcttccatggttgaagaagtgtgtttgattgtattggaattttgcaatgaactttctcaagacattagcatggagattgaaggtaaaggcataaaaaaaagtgatgagtttgccgtatgtacagttttattctctattgaaacgatttgtgcggtaatgagagaagaatttcaaccagaattgattgactatatatacacagtagttgacgccttggcatcaccgtccgaagccattaggtatgtgagccaatcctgtgcattgaggatagcagataccctatatcatgggtctatcccaaacatgatcttaagcaacgtagattatcttgtagaatctatttcctcaagattgaattctgggatgactgaacgagtgagccaaatattaatggtgatttgccaattggctggctatgaaaccattgaaaattttaaagatgttattgaaacgatatttaaactactggattattatcatggatatagtgatctctgtcttcaatttttccaactatttaaaatcatcattttggagatgaagaaaaaatatatcaatgatgatgagatgattttgaaaatagctaatcaacacatttcacaaagtactttttcgccctggggtatgaccgattttcagcaagtactcaatatactagataaagagacacaggttaaagatgacataacagacgagaacgacgtcgattttttgaaggatgataatgagcccagtaattttcaagaatatttcgactccaaattaagagagccagatagcgacgacgatgaagaagaaagagaagaagaggtggaaggaagttctaaagagtatactgaccagtggacctcacctataccatcagattcatacaaaatactattgcaaattttgggttatggggaaagattattaacccatccatcaaaacgattaagagtgcaaattcttattgttatgaggcttatatttcccttgctatcaacacagcataatctgttgataagggaggttgctagtacatgggactccatcatacagtgcgtcctatgctctgattattcgatcgttcagcccgcatgttcatgcgtggagcagatgataaaatattctggtgattttgtcgccaagagattcattgaactttggcagaaactgtgtcaggattcttttatattgaaagaactgaggattgatccaacggtgcacaaccatgagaaaaaatcgattagtaagcatgtcaaattcccaccagtaactgaaaatgcgctagtatcgatggtacatatggtgctagaaggggtcaaaattacagagtatttaatttctgaagcggtacttgaacaaataatatattgttgtattcaggttgttccagtggagaaaatatcatctatgtcattgatagtgggggatatcgtgtggaaaataagaaatataaattaaacttatgtggctaaacatatgcatttgtatatggtaatacagtggtttattattgctcacattgttcacaccagtgactatagtgattacaataagtaattagacaataaatgttatgagtgatccagaatgaggaatgatatgtgacttcagaattagcagggcagctaaattaaagatcttttaattcaattttagcttacgatttatatctatgaaagacatgaattgtcactttgggtaaccaatgatatcggtgactgctatttatacctatctcatattatattaagaagaccagcttttattctcggttggtagtaccacttgtctactaatcatcaacaatatattctaataaagtattatgtacatatatatatatatattaccagctcggccaggcattggaaaacagaagaaacatttctcatgattgaaatggataaacacgttaatcaacagggactatgttgcaggtgaaatattagcaattaataagaagggcaatacgcatattacaaatgaagcgatagaacagacagtgtccaagtaatgataataaccaatatatgcgagtattagtattttcctaaaaaaaagcaagattatatacacggaatggaggagcagtagctactttagattcggagttcccttacacttggagaagtaagtctgctatcctgaaaatatccgttatactaagggctccagtaatagcgggcatcttgacaatcctaatatccttagggtggtgactagcactcacctttgttggagtgaaatcgtaatatcatctattgactagtatttatgttattagtacacattatcccatgcggcgtcaaaagatgacatgaaaactgagaaacagtcataagactcaatggaagcgcagaatctcggaactaaactagttgtccaggtatttacacgtttaactggtttgtctaggcagggtatcgtttgatgtaataaattttgtctgctttgtaacgagtgtttctgacatgtttcaaacatattttatgtgtaagttgataagtcgcccttgtgtatcgtacaactatgccactttaaaatgatcaattttacagattaataggtttcgtggtctagtcggttatggcatctgcttaacacgcagaacgtccccagttcgatcctgggcgaaatcaattaatttttttggcttcatcacgctcgtcagttgagctcgcacagcatcagaggcaaacttgaatttggcttaagtatattacaaaaacaagaaggagggaagactacacacatgcgtatatgtatacaggcaaatacatatagactgaagttagaaaaagggaaagaaaaattattattaaataaagtaaaatttgtagtaataggaaatagagtagtacaatataaaacaaatgttgaaaaaggaattccttattctcgttgtttgcgtgggataatgttacagtggaaaactaaagttgtttatttgttattcattttttatgatcgaaccatttgtagtggggtcagccaataacatgtgttgttgttgttgctgctgttgttgttgttgttggagcggctgctgctgtaatgaaatcggaggagaaacgggcgtatttgggttggtactgttactgttgcttccggtaactgagtcgatggcatttgcggttatgtgctcgatactgtcttggttctccatgattttagtgtccatattcaaattcatgttcatggccttatgtgagtgaccggttgggttaccgtttggatcattttcgtcgggataacaactttcccattcctttaatcttttcttgtaagtttcagtgtattccgcctttttggcagggtctaactcgcgccatctttcaccgattatcttggtaatttcgattaaacctttatcaggattttccttgacgacggtaggtctaatctcctgggtgaactgaataaagggaccagagggtctctttgggggcaaagtcttttcgtaagcatctctcacaactctgtacttctcccagttggttctgaattcttcgtagaatggttttttttgatcatccgttaactctttccaccttgcagaagccaatttagacaattcggggacctttgcttcagggaattgttgaagcaactcatttcttatggacatagaaaacaggaaataagcggaagaaggtctctttgggccttgctttttcagttgttttcttctctcaattctgctttgagtggaagataatttcttcaccactggatgctgttgttgctgctgttgctgttgtagatgatgatgttgttgttgaagttgttgttgttgttgcaactggtgttgctgttgtagctgctgctgttgctgcaactgctgttgttgttgtaattgcagctgttgctgcatctgctgctggtggtgagtcaattgaggttgcagattgggtggtaacaaaccaggatgagtagcggtgttggcatttcctgcagcatttcctgcagaggaagggtccaaaagactagacagagcgttcatgttgttcgggtagtatctctgcacctgtgggagctgagacaagtacgaagccgggccagcagcattgtttgcggcggccgcagcagccgtggcagggtttaattgggaggctgccagctgggcaggattactgctagtgctgttattgccgctactaacattgttgttgttactgttgttgttactagacgcgcctgtacccgtgacagaagggtttgtctgtttttgagttaaatgacttaaaaaggagttgtaaaactcggaaaattgttgttgattgatcgtcggatagttttggcccgatccggtttgttgcatgtaaccgaaatcctgaggtagcgcgttaacattaacattgttgtttgaatttgagttcgaattagcatactgttgttgttgttgttgctgttgttgttgttgcgactgcgaagtaggttgcgtcaaagattgtggaggtagtggataataaacattttgctgttgttgttgaggcgactgctggaagtgaccttgataaggcgcttgttgttgttgctgttgttgctgctgctgctgctgttgttgttgttgaggctgggcttgaaactggttcaagtattggtgaggtgtctggtgagaagcatctctgtactgggagtcgttgtgttcgagaccctgatactgcagcgaatggtcttggcctatgttgagtaagttggagttagaggcgtcgtcctgtttgggcgagataccggtgttcattgcagttgtgggtactgttagcgtcgtacgtatatcacagaatggatagaagaaggggatatagttgtggtcttgccttgacttgcgttgccttgccttgtctgtgtgtaatagagttctttgtgggatatcagagcgaataaacttcagcgtcacagtctcggtagcagtagctgttaggcagtgacctagcagtagaggaaacagaatacaatgcagtacgattacggtacagaggataacgaagtaaaccacatttacagcgagaacgagagacagaaggagagagagaacgaatgcgccgggccgtgtctatacttggctccaccagctgatgtgtgcattttttttttgttcccattcgttctctcaccaaggggaggtggaaaagaaaagaagaaaaagaaagtaaggaaggtccgctgcgcctctcctttgctgctgttgcatccggacatcacacccaacacaaaaccccgcgcggccgtcgtcagtaaccgttccacccattcctccacggtatgtagatcgctaagcacgatgtgtatgttttatggatatgtgccgattttttccgcatttggtatcatattttgttttgataattaccgttcttgttattgctagttgcttgggttaatgttcttgtgctattgttgctgttgttattgtttttattattgtattattgtattattattatattattattattattattattattattattattacggtatgtcaagtattattttttttttaaaaataaagaaaaaaattgtacaaatatatatatttatatattactctatatggttttttttttttaagtgcaggcgttggttatgcttcgtctacaattggttggtgtgcaccgatgggtcatgttggaccttgatcataggtctgtacacaggctcccacatttgggctttgacccactgtaaacattcgtcaaagtcacgaggaaccttgacagtttcgccgggagctcctcccggtacttgttcttgctcgatacgggcggttccctcctcgagtgcttgcaagatcacagcggtagctagacgcgcagaagtgttggtgatggtgtccaggccgggtagcaacccaggtctcgagtcgccctctcttagtggcgacaattcggctagttggtccactgcagcggagatcatcttgtctgtgatggtggtggcacgcgatagtacggcacctaaaccgatacctgggaaagagtaacaattgttgttctccgagatacggtaaccatcaacaggtgggaaaggagatccggtagctacaagagcgttgttgttggtccacttcattaaatcggcaggaacggcttcgtgtagtctagtagggttggataatgggaaaatgatcggtctaggattgtgcttgtgcatttcttctacgacatcttgagtgaatgcgcctgcttgtgtggagcagccaaccaaacacgttggtttgacgttctccaccacatcatgtaaagagcgggtgttgataccagcccattccgcatcactcttagcgtatacgtgttgggcgggagtggagttagcctcgtaagattgtagaattaacccacgtctgtccatcaagaagattttcttgcgcgcttcttccttgtcaacgccgtgcgtgaccatatgattcacaatttgatctgcgataccgaggcccgcagacccggcaccgtaaataagcactctggtgtctttcaagtctctgttggtatgtttcaaagcagcaatcaacgaggccatcacgacggcaccggtgccctgaatgtcatcgttgaatgatggcaattcgtacctgtacttttctagtaatcttctagcgttcttaacaccgaaatcttcgaaatgcagaacggcgcttggatacactttcttaacggccttgatgaatttttccaagaagtcgtcatattgcttacccctgattctggagaacttgttacccatgtacaattcgtcacgggctagtttcttgttgttagtaccgacgtccaaacacacaggtagcacacggccgggatgaataccaccgcacagcgtcatcaatgccaatttggagatagcaatacgtacaccaccgataccttggtcaccaattcccagaataccttccgaatccgacacaacgatgtagtctacatctttgtctccaccgtatgtagccaatctacattcgatggaatcaggttcggtaatgtctaaaaacacaccttctggctttctgaacctgtgggaataggcagcaatagcatcaccttcggttggggtgtaaatgataggaactaattccttgatatgtctccttattaatgcaaaatataggactttgttctgtactctcaaagacgtcatgaagtcgtttttggccaagggcgtcttcaaatagcataactgcttgtagcttctttccagttgttcgtccaaagtgttcacttgtggtggtagcaatgcttctaaattaaacgcttccctttcttcttgtgtaaatgcagaacccttgttaaataaaggagagtttaaaagttgaaagctctccaagggacattctatggcaccttctacagtcaaacgagtggcatgtgggtgaggagcttcgaagatctttctggcgcgagaaccgacgggtgttttagtgacctcctcgtcgctgtatggcttttggaaagtattttctcttgttgtggtagctttatgcgatctagtgttagaagaatataaacgcgattgctgaataggccatcttcttaatggtgctgtccttgatgctgtcaaggatctggttagttgcgatctagcagcaacggaaacggatagtctggttctaagcataaccgtatttctaccttttgtcttggtatttatgtgcactaaactcgttaaaagttgtaggtttcaaaagcacaaatatccgaagctggacacaatatacgagtaagtataaagatacgcatatatatatatatataatatgtcaatcatgccggtaacgggtacgacttcgaaactctatagcgctaaagctgtagaccaaaggaagtcaaatggagcatacgcggtacagtaataggaaattgcgaaaatttttcaccatagaaaggcgatgatgagtcgaagccaaggggactcagtcactcagtcagctgatgcgatgcgatgttagcgcaaacaataacgcgtacgataataaaacttcaaatgcgccaattcttttttttttttttttttttttttgatttcttttcatatatccgatttaaaccgcctagggaagagtaaaaacccgaattgttccgtctatacttggttgtatgggtgttttttcttcgatgcttttcgtataagaagatatgcagtgaatatctttcaatcgccttgaacggttgacaagacgcaagaatttgaaaaaccttgcaatgcacgatgcaatattcaatttgcacacatcgaaacgaattggtatcgaaaataaacgcgaaacatatgagaaatttttctaacttttcttccttcgttaagagtgatccttgcactgtgatgaatcgctataattgttgtaatgattgacactgggtgaagggcaaaggatgtccaaatgataaaaaaacaaaaaaatttggaagtgtaaattgtaccatgggcgaatttcaggttactattgtagtctggtgagttaatacgtaataatacttggtttttttttttggttttttactaagcgttaccgtgtgtagtgattatctaagcggttcttgcaagattaggaaaaaagctaattaagtgtaaacttggcagcatgattgctcgtcctaatcgagccaaagatagaaaactactggaagcagctgctgcagtgagtagagtatggatagacctatagatgatattgtgaaaaatcttttaaagttcgtcgttagggggttttatggtggctcctttgtactggtactcgatgctatactatttcactcggtcctagctgaagatgacttgaaacaattgttgagcataaataagacggaactggggccgctaattgctagactaagatcagacaggttaatatccatacacaaacaaagagaataccctccaaactcaaaaagtgtggaaagagtttactactatgtaaaatatcctcatgctattgacgcaatcaaatggaaggtccatcaagtcgtacaaagattgaaggatgacttggacaaaaattcagaacctaatggttacatgtgtccgatttgtttgaccaagtacacacaattggaagctgtacaattattgaattttgataggacagaatttttatgttccctatgtgatgaaccgttggtggaagatgattctggtaaaaaaaacaaagagaagcaagataaattaaataggttaatggaccaaattcagccaatcattgattctttgaaaaagattgatgattcaagaattgaggagaatactttcgaaattgcattggctcgcttgataccacctcaaaatcaatcacatgcagcatacacgtacaatccaaagaaaggcagcaccatgttcagaccgggagattctgctccattgccaaatcttatgggtactgctcttggtaacgacagtagtagacgtgccggtgctaactctcaagccacattacacatcaacattaccacggcaagtgatgaagtggctcaaagggaattgcaagagagacaggctgaagagaaaagaaaacaaaacgctgtccctgaatggcataaacagagtaccatcggtaaaactgctcttggtagactggataatgaagaggagttcgatcctgtagttactgcatctgccatggattctataaatcctgataatgaacctgcacaggaaacatcctatcaaaataacagaactctgaccgagcaagaaatggaagaaagagagaatgaaaagacgttgaatgattactacgctgctttggctaaaaagcaagcaaagctcaataaagaagaagaggaggaggaagaagaagaagaggatgaggaagaagaagaggaagaagagatggaagatgttatggatgataacgatgaaactgctagagaaaatgcattggaagatgaatttgaagacgtaacggatacagctggcaccgcaaagacagaatcaaacacctccaacgacgtaaaacaagaatcgattaatgataagactgaagacgctgtaaatgctactgccactgcttcaggtccgagtgcaaacgctaaaccaaatgatggtgatgatgatgatgatgatgatgatgatgagatggacattgagtttgaggacgtttgatatggtccgttttttttaaatcttaccaactagctcttacaatgtagaaccaacttttcctttcttcattttcttctctattgtatcaagcttctcttaaaatctaaaaaaaatgagagaaaaaaaaaagaatacgtctggaaaaaatcacatgaaaaaatttcagaaaaagaaagcggagctactagacatatggcatctttatagtaataataaaaacattactagtgagaatattgaggtgtaaaaaatattttttcgagcatatttagtttatatatatttaataaagaacctcaacttatagaaggcacagaaggattgctttatcattcaaccaaagtacaaaaataatatggtagagaaggatacatggaaactgataactgccactgcactattcactgtggcagtgacgacgattacagattatgcttggaccagttggcaagcacaaaagcaagtaattgcgcaacaaaaaaataagaataaaggtgggcaaacaaaatctgacacggataaatatcatcaatatgatgaacagtttattcgccaatctttgaaaaacaatgttgaatttcttggtgaggacacaattgaaaaactatccaatcaatatgttgttgtcgtgggagcaggtggagttggatcttgggtggttaactctttggtgcggtccggatgccgaaagatcagggtcgttgattttgaccaggtctcactaagttcactaaatagacacagctgtgccatactaaatgatgttggcacgccaaaagtggaatgtctacgaaggcatatgcgggaaattgcaccatggtgtgagattgatccgattaatgaattatggacgttacaaaatggcgaaagactgacccttggtaatggaactcctgactttatcgtggactgcattgataatattgatacaaaggtcgacttacttgagtttgcctataatcatggtatcaaagtgatctcttccatgggtgcttccgcgaaaagtgatcctacaaaacttaatgtgggggacttggctaccacggaggaggatcctcttgcaagggtagtgagaaggaaattaaagaaaagaggtatcttatccggaattcctgtagtatttagtgccgaaaaaccagatccgaagaaggctaaattattacccttaccagatgaggaatatgaaagaggaaaggtcgacgagctgagcgccctgaaggacttccgtgtaagaatcctacccgttttaggtactatgccaagtttgtttggattgaccatcactacgtggattttatctaatatatccgataaacctctagaacctgttgagggtaagaatagaattaaggtatacgatggtatatatcaatcgttggcaggtcaaatgagcagagtcggtataccgagccaaagaatcccattggctttgaaggatgttagttaccttgtcgaagaggtgtttaagggtaaatctccaattagcggcatttccactagactaactttaaccaaatgggatccctctaaacctatctctttgcaaaatgtggtagtactaactaaaaacgaacagaaagtgcacgaagaccgtgtcttgaagggtaaggaaagcttacaagatgtttatgatgccaaagttctaaaactggtttcacaaagattcagagaagaagcttattactctcaattcagatgatcttgttcctttccaacatataaagcattttcttccatagagttacgtactattccaggaggcttttcggactcataccatatagaaaactatttttatgcttcttcatttacttctacttgtttatgtttatttgtaaaattacattatttaatttcttgaaagtaaaaaacttgaatttctgaaataaataaaaactagagaaaaattaacgatgaggcatgcgacggaaatcaatattgaaacttctcaaagctgaaccactgaaagggttctttaggacaattttcattcccttaatcaacaaaaaatgactaaaacctacatattcttcttagaaaaaatacatacgcaaaacaagatagaagagcaactgttgatacgatagcaagggtgacagagactattcaattatatgtcttttattttcattcttatcaccacttttccgttttcaacttcgttgaccgcaaattaaatctgttcttctggtggttgattcagtaattcttcgattattggacaaagctctagtggcctagtcatgcatgaaaaccttttaaccaccttcccatttcggtctaccacaaacttttcaaaattccattttatcatttttattccagacttcccgcttactgaattctttaagaacttgtagacgggatcttgcttttgcccgttgcaacggatcttatgtagaatagggaaggttacaccatatttatcttgacagaacttattaatctctttatccttctcgaactcttgatttccgaattgaccacagggaaaggccacaatcactagaccatgtgatttgtatttttcgtacaagtactctaattccttgtattgaggtgtgaacgcacaatgagatgctacattgactatcaaaaccactttgttacgcagggagttgaaggggaatggatttccgttttcatctattggtgaaaaagaataaaattcttgcatcgttacttataaatattgtgtttctccgcttatattccttatacgggttcacaatcagagaacctcgccgtgcacaatatcacctacatgactaaaatatatttgtacattactgtgttatataatcacttaatattgttcaccataagcaatctctgtagtagaggtgagccccggctttaagttctcttagatgtggcgaacaagggatgaatcgcttaccctatagaattagggaacagaaggggaaagcaaatacggaaaattttccacatgaagacggtagtggggtatgtcaaggggatactaatgtataattaatatatatgtgtgtatctacattatttggtgttgttttattgggtgatggatcgaaaggtggattctatcaagtccttcaactccttataggatataataatacagtttaactcatcgggcgttaccaacattaacttttcttgaataccagcgtctaatttgttcaaacatcttaggacatgagttaaatccattattggtttcccattcgaatccacttgatggaatacgtagtcataaaatagtataatggggaatttagtcccagattcggaccaatttatgtctattcttgattcgattctaccaaaaatgcaatttagcttgttgaccagcctaaataatctgccattttctagttctcttgataagacagactccatgtattctgtataggtttgtgacgattccaggaccatgaacatcttatcataaaagtgactagtaagatcatgaatgctctttttggaatcgccgttgtctgatatcagatacttgagtacatccttgaacttatcatcgatctgtctcatgtcatcaattgattgaggggttatttcctccaatcgatattctttaggggcagtgttgttattagagttttcaatattaatggataggttaaataatagctctcctaaatatttgtagtctagctgttgttgtccctctatggtacttccgccggaagatactacggtatcagtatcatcattgaacaaaaggtccataaaattgcagtgtgataacttgattctccctgggtccccagtaatcaaaacttttctccagtttaatgtattgccaatactcaagttttgtgaatggatagagtttattacattggtgagttgaactaaatatatccataaataattattcgttattggaaacttagggaaattaacaaagtggtaatcatacaaagatagcgagtttgggtagtagtcaaagaccaaacaaatagacagatcaccaaatttagtagtttgaaaaatgtccctaaactttatcaaatttgtacaattaatttttgaccatatctgatatattttggatattttgtttggattcattgacttatcgatgttaggaagcctcttcaaaacgtaggctttaccgtcataattggaaaaaactttgaagagcgtagttttatttaaaaaatcgttattattgaagttcaatggaaccaaattaaaataatcttgtacaatacttggtataactttacctgaagaggggaaaacctgcaaaatcgataagtttttcttggttaaatcttctctaatattgtttggaatgaaaagctgatctgcagacctttcattaggctttaataatgatttcaatgatgatggctgttcaggtgcatataggtgatactgtagaagactgtgaggaggcggataaatacgtgggtacttaagattactactctctatgggtggcggttgcataggaggtggcacattattagccatactcatattgttactattatcatcagtggcgtttatatttatgccaccagaatttgcaatggagggaaatggaaaagaatgtgcatttgcattagtgtgaattgaggaggttgaagacggagtgaaaatgggggcattgaaggggtcgtaattggaactcgaagcggtagttggtattgatatgcttatattactattattgttattgttattcactaacgagctattaactatcggattaatcatcggattaactgtagaagcagtagcagaggtagctgccatggcgatattgccagtagcatttgtagcagcggaggtggtattcgtcacagtggttaaggagtcactaccgactgtcatcggagtgaaacttgcggatactttagcattgaacttaggaactgatgtcatggtcggagttgtagcctcacccacatctattggaggaggaacgtcatttatggtagtagcggtagtgttatcgctgtgtttgaaagggcaaccttctttctcctttttgcagtagccataaatagtgatatttctgcacggaatatccttcgcccaatcaggattgattttgtccatggcgtaagatacgtctgactagtcttttaggcttacctatcatcgaaacagtgctcccgccattgttattattgctcttttaattcataaaccaaataatttagcagtttattttaaggttaccctgtaaaggtctgatatgtaggggagggcatataatcattttaatatatatgtatatattcttacatatatatataatatcgccgtaacttatagcgtaaactatataaaatacgtcttagtctataagctatcacggatagcgtcttggacgtctttgtacacatcttcgacggatctgtcgcaacgaacacggacgactttcgatttggtttcaaagtactcgatgacgggcatactagtctccttgaaagtgttaaatctcttcttaatggactcaatgttgtcatcgcttctaccactggtcttgccacgctccaatagtctctctaacatgatatcttcagggcagtcaaagaacaggatgaatttgctttcaacgatgtctctttcaaaggaaatggcttgatccatcttcctaggaaatccgtcaattaagaacttatgcttgttcgccttgacgttatcggaaatagcgttgcgtaaaagcgccaaagtaatctcttgagggacaatctggccctctttgatgcagttcttgatcaattccccatattgggaacctgctctgccctgctcagcacgtagaaggtctccggctgacaaatggacaaatgaatagtccttaactagtttttcacactgagtacccttgcctgcaccgggtcctcctagaacgaagatcacggaaacttggtcaggcgagaaagctggctgtgatgtagtggcagctgtcatttgtcttattcaagaaattcaactggttcgttcttttgatagtttaccgaaataactgatgtcacgagtgctaaagttcctacgagtaccaacaatttgcctttgtgtttacccttgctttgacttttgttagcgcgtggtacgtttacgttggtcttcgaaggtgctgtattgtggaaagttggttttttcgaagaataaaatctcagtataaacctgtagcgtggattcataatataactaagctaacataaaaacgggagagggtgtgtgcgactaaaggcaaagacaggaatgcatcgctttaaaagatcaccataactacttaaaagtttcgttaacgtggtgaaaaagaaaagaaaaagaaaagtgaaaaaaataaacctagggttgaaaatataatcagttaggtgtcatgatattgatacatttatttctataggtctgagagtactaacttagggtatatgaggggtgttaagttgggatgatgacgcattaattaagagttcattatatgaggatattgtatacaatgcaagaatagcgccccaatcccggccaggtataacgtgcaagcatgaataaagaagaattattgggttttctactagatgacagtattgatagccaaaaaagatgcgtcacggatcacgaggcctactctaattggttaaagaatgataatgatgaacgtacggcccatgaggaaagctcttcacaaagtacgatagccgcattgaataagaagaagcagacagaagctgctcaagaagatatagaagaactgttaaacggcttagaaggcattattggaggagccgacccccgtaatctcaagagtaagtcaaagaggaaaaccaaaaagggcggatcgaaaccaagggaagaaaacgtgaatacggagaaacatattgtaatgctcgaggtagaagattttagtgatatgagcacccacgaagatgtcaacggagcaagtccgtcgccaaatctggaccggtcgaagaagaatgagaagcgaaggaaaaacgccaaggagctgtcatacgatgaactaaaagacaaactagaagttaccactcgcaaatcacgtcttgagtgcaaagacttgaaaaagaaagttcatgggctcgaaagaaggaaccttgaacttgaacagcgtttagaagagctgaagattgagaaccagactttgatagagattaacaataaactgttgaaaaacactaatgaggatgagattaacaagagccagaggaacaaggagaaggaccgaaagcggagggaaagaagaacggcaaggagaaaagatgaaagaaagcaggaaaaaaagcaggaaaaaaagcaggataataaaacatctcaatcttttccttcctcaactgacatgaatggacagcctatagaattttgaatgcattctaatgacataactatttgacgacgtgaattagaaacacatacttttacgtgtggctgcctctaagaattaaacttcttttctttttattcttattttctttaatgaatatatacgctatacttgtactaagtcgtgtctttattcctcgcccgccttcgtactttattccagttccatatctgcgtcaaaatcatcgtcggcattattacttccagttttgctgtcatgacctccctttcttagagctttgttattctgatcaaagatctccttttgtgttctcaaccttttagccatgttgacagggtcataagtcaatgaagatctttttttattgagcgaagccttgtccttacttgcctgactcattaaattcgacttgtcaataagtgggtggctggcatccaatgataacgtcacgtttagctctagggcatttttcaaaagcgctgttgcagatgaattattaggctttaggtacaatgatttgtgcaaatgatcaatggccttttgtaatttcttcgtcttcaaatataagtaacctaaggaacaatgaatttcagagtttttatcatttttctccaaaacgcatctaaaacatttaatggcaatttcgttctcatttaactttctgtaagtgtgtcctagatttaattgaattgatattgtcgttcttgaacttggatcaagatctttcaccacttccaacgccttcttcaggtatttcttggctttgacaaattcgttcttcttaaaatacattacacccatttcattgagtactaatggatcgtttggacaaatgtcatatgccagaacaaaatacgattctgctaaatttaatgaattcatcgccataaactgcatcccgagaaacagttttggtaagtgcattccaggaaagaatctggaggctgtagagtatgctgttaatgcttggtcttgttcaccttctagggcatacgtgtgtgcaaatcccagccatgcggcagcaaagcttggatccagtattgaggatttggaatagtatttctgtgcttcactaattctgtccaagctcatataataggtcgcaacgctaaaccatgttatcgcagacttcgggaaagtttccgctaatcgatgcgacagaaggaaaagcttatttttatttgatagttcatatagacatccaatgtatgctggcaagatattcgtattaaattcgtcgttttccaaaacggtctcgcacaactctaagcattcgttgaatttgcattgcgtatagcagatatccaccttacttcttacgacatctacattgtcagctaatttataatctttcgctaaaatctcattggacttcgttatatcttccgtgttgatgtatttagataggttgatcttataaagattcttcataatctctttatcttccccaaattctttgaaatccaaagagtcaaacaggtcccattcctcttgtggagttaacaggttcttggacaggagcatttcgaaagcttcaaaattttttatatctaccaaaatcgcttcacgaaatgcatcccttgccttgttaaaattattttgtgcaaaatatattttccctctcagaaaacataatgatgactccatttttataccgccgtcagtaactggctgtgacgtattgctgttattgccattattgctcatggtgtttgctgccgtcgtagatgggtcctcgctgaatggattgtattcgcctataacatctagagcgtcatcaaatctctgtaatttaacaaaggagagtcccaacagatatcgacacaggatattaacgccatccaagttgttcctggtaataagttctacagcccttacgtactgattattattgtaatatacttggccgagccagaaggcatcatcaggatcattggatatgttatacactttatcagcaatatattctgcggtcctatacatatgctgcatcaatgcgtcgaacctccaaagtctcaatctttctatagctgacaattcagaaacatctagttgagttgctgtagttgttgtcgttaatgttgttgtcgtcaatggcccattatgccctagtttactctcccgatcattattagcattcgcagctgcatcgccattgttatgaacatcctcatcattatcttcatcacgaaccacaccatcaactgaatccttatattcacgctgtaagctcaccttccttaatgtggacggtatggtagaaccgaacatactattcttagacatagaagctaacaaattattgtcgttcacaacattgcccgtaatggaattggaattagaattagaattagcagatggctggtgcggagtcataatattcgcttgcaacttctgtattaaagggctatttgctaacgactggtagggactcgtagccgtattggttctgttccagggttgctgcaaacgatcattctgagcatcggttggtaaactctgttgtgttcttgctgcagatacgttagaaacaaatggcgaggcggccaatgtagaattatgttgtgaatgttgctccgaaggcgacatggggtttctcataagtaccctgtttgacgatttcaagtttgatgtggcttttgatgacttgtaataatgtgtagcctttccacaaataacgatataacaatgacagcaataaagacaaaacttcatatcatctttaacgattaagataaattattttatattatacatataaactaactttagtacgcaacaattctgagctgcacgcatgtataaggcgtttattcaagttctactgatactttactcttcttcaattgcttccgcttctttttattgagtttcttcttctcaccaaacattatcttctttaattcttcggtatcactttccacctcactttggtcacctatatcagctgtttcagcatccctcttcttcattgtgttgtatttctcaatgctttcatcgcatagcgttaagcaatttagcctttcgccacagtcgtagactgctacttgttcttttgtagacatatcccatacgacaattttaccatcagaaccaatggtgactaggtaggtaccaaattcattcgtataaaacttgaaatctttaatacggtttgtgtgacccaataaagaaaaagcggggctgatatcctccttgtcgtcatcatcttcctgcttttcattttcttcaactttttcgaataactcctcacaaggatagaaatgaacattaccatcgctgataccaacagaaaggtattccttattatcgaatggtaaaatatgtgtttcaatatgcataagagttttcctttgaaagactatttctttaaaaactttagccgatccagtttcataaataagcaccctatcccttaaacccacggcaaaataatcacctttggcgcctaaccatctaacacaagtcccgtttgtattatattttcttagttttagtacagcagcatttcttagagtcatcaaattccaaagacgtatagaatggtcatcactaacactgatggcaattctattggtggggtgaatatccacatcattaacccttgccgtgtgtccctttaaagtccccactgtttcccagtcctttactctccaaaccataattttgtggtcttctgatgctgataataaccatttgctattcttgctcccctttgaaacagcagcatcctcactggaagaagctggatgtgagaattgtagagcagtaatagagccctgatgacttaacaaagtacccagttccttcctcttttgcaaatcataaattctgatgtgctcgtcattggatccagaaactaggtatcttcttgaaacagccaaacatttaatactcaacgaatgggcttgaaaatgaaatattggcataaaatgtggtgtctttgctgcatcattttccttttgatttgggatatctaaggataaacacaaaatgttgtgctcgtatgagcccacaatgatacgaaattggttcttgtcgcctatagcactcatttttctacacgaattcttgacttggcccttaggatcttttcgagatgaggtaccatgagttttcaatttttcatgttctaaaaaattttcggccttgatcttgaactttataattctaagcaaaaaaaaaatgaagacagtataagtagtattcagtaacataaagaagataaaattcaaaaatgcaaaataataaaaaatgaatctatatagtgtaaggattatgtagctagaaaaatgtctttaattgactcgcatgtcgtttagaatgttattgttttgaaacttcgataactgcattttaaaagaggttttcatcctttcgttgcctagtagtaccttggctaaaccaattcttaaatattcctgaacaattttggataaattatgaaacatatcatcatctttccccaaattcgataatgtgaaacataataagagtactaaagttaaggggatccaaaagaataggagcatcttatcattctgaaagttttgcttcttggaaaagattgtgttgaacccgacctgtaaagcttctaattcatcgtcttcagaagaagtttgagaatcatccacggtcatttgggcagaattatctggcccaatctccacagatttgctaccaagttcccagtttttgggtttttttgggaacaagtcttcatactttgggagctcgtcatttaaacgagttagcattctgttccataaagatccgtcaggctctatgctagtcttagtagtttttggtatttcatttggctttgaagagaagtccttgattttgtgggtgttaaagaactccaaagcaatctcatctgaagatgattcacaatcacttatgtcataacctgaatccgaatctaggattgagaatgacgtattgtcattacagttggattgttcgggggcaagggcagcggaatccgccaataaatattttctttcttggacatagtcatgatcagcatcgtcatcatcaaataaacttgagttgaaacttgactgggatacatttctctcaaacggttgagtatcactggatcctgttgtattcttcgttaatctagtcagaatgtcgtcaaacagactggtttcataattagaatatctggtcttgttgacagtataattcatcaggaagaactgtttagcgataaagccgtttctggttttcttcataatattaacgttgcattctaacaatagtcttataattctcaagtcaccattaatacacgccatatgtagcggagtaaaaccaaataaatcttggtcgttcaaatgcgacccatatttgattagtaatgagacaagactataccagttattgaatgctgccagatgtaatagagttctacccctaacgtcacacatggaaagattgacggtagagagattattatttctcttaaatgacttaataacttcagtgatcaattgttcatcgtttatatttcgcatcatattcgtgtacgaatttaaagagctattctgtgagtgtaatcctgcgttattattagatggagatgaatcactgccaacaatccttttagcaatatttcttgcatcttccagtttaccgttcattttcagccccacaatttgcagagccaattcaattagttgcctatcagtatcatcaacataagtaaagattgctttctcaccggtatacttgtttaagtgcagaatgtcattggtactattgctggtggaaacactactattgctattatttctcatagacgtttcacttgggtcgactatggttaccaaaaccggtccaggtttagatgaaggcggtaaataagtcaccatcgtagattcattccagcattggctggacaatgctatattttcgccaaacttgatgattaagccctgcttaaactttgagccaagtagagtcacttctatacctccgttgatggaaccttgtgcggggatgacacgctgaatagaaggcttgttatttagcgccacggggacactattatggttcgatatatctttggaagaatcgatgaatttctggggaagacgggaaaacgtattaggcgtagacataaaaggctcgtttaccgaacgctgcctcttgccagtgtgtctcgcagaggccgcactgaaatcactagttaatgtagtaagagcgggattagatgaactattaaaacctgtggacgaccaagagtctagtgaacgatgtaaattgttgtcgttgttattagaaaaatgaatatctgaaaaagaatggttgctgtcctcactggaggaatttggtgatggaaagtgtctgttgttgttcatcattgcggtattagtcttaatgttgtttttgttatcattatcattgttgttgttattacaattgctatcaagcatacagttcgtagaaatgacaaaatttttactgttagaaggcagggggaattcggatgggaagtttaagtcactttgcggcgatgaaaaggatctagtgtcatttgtcattggcgaaacctgggcattgctggtgctggttggagttgtggtattgctggcatttttcttgtccatgatcattatgggatctgttatagttttcgccaagatatcgccgttatggtcccttagaaggaacaaaactacaaacccgttagttgccttgtggtgtctgcagtaacagacgattctcgtcggtaagtcgaaattgatacagttagagttaccactcaaaccgttattactaatgatgaaaagttgtttactattgaatatgattgctcttttgttttcgttattttgccagatggagttgtcgttcaacccagactttcttctcgacgctcttcttttttccctgttgatacatctattacaaacataggtctgcttgaagttgttgctattgttgttagatgcacacaaaagaaaggcgtccaagaaaagagtcctttcgttgatgtccctattgggtattgtcaagttggtgggatcgtccgagctggtgaaaaacttgtccttcgctatacaatcagagggcagatgaataaagaagttttttcttgcatgtgcgtttctaatccgaaaactcagcttcatctgagtttccaccctagaaaccttcggcaacccaataatttctagagacaatggaagggactgcgggttaatgttgataaaatccagtggattcgcgtatggcgtcctcagaggtagctttctgccaaattgaacgtgtcgatcaagcaatccttgcaaagatgcgatgtcatccctgagctccccttcatcttccttacctggtgtagtagtacctgctgttatcattttctcttggttcagactcaataaaccagggtcttgcagagaggacccagagttgagcagagcaatatccagtaattctgattctagtaaatccaagtccggagagccatcgttgtgctgtatgttggcgctatagctgtggagcatcgaggaaacgtttcctgtgccactcatcattttcagtggtgtactactgttgtgattagtcgtttagaggatatctagagtataattattttgaatgagtttcgttgacattttcagttcatgcgatcatcttactttcatggttgctccttgccgttaaaattgaaacgaaaaaagcgggaatacaacaatgtcaccttacacgagcagagaaaagggcagcaatagcgacaataaccgataatgccaggccttccagagccctatgctgacctatattcatcatgacgctatccatatgcaactagagacctgctgggaagcgctctctcatttttgaaggttgcagcagtgctcgcgccggttttcgattgggcctcgtgataaaacacatcagcaaagtttcgcttttgacattctgttaaattggtccttaactgttggtgcagacctactgcaagactgttaattatggtatattatatatcaagtgctgatacaacgtacaccatcgaaaatggaggagtacgattattcagacgttaaacctttgcccattgagacagacttgcaggatgaactgtgcaggattatgtataccgaggattataagcggttgatgggactcgcaagggctctgatcagccttaacgaactgtcacccagggcactacagctaacagccgaaattatcgacgtggcgccagccttctacaccatatggaactaccgattcaatatcgtcaggcacatgatgagtgaatccgaagacactgtcttgtacctgaacaaggaattagactggctagatgaagttacgctgaataatccaaagaactatcagatctggtcctatagacagtctcttttgaagctacatccgtctccttccttcaaaagagagctgcctatcttaaaactgatgattgatgatgattccaagaattatcacgtttggtcgtacagaaagtggtgctgtttgttcttcagtgactttcaacatgagctcgcctacgccagcgacctcatcgagacagacatttataacaacagcgcatggactcataggatgttttactgggtgaacgctaaagatgtcatttcaaaagtggaattggccgacgagctccagttcattatggacaagattcaattggttccgcagaacatcagtccgtggacctacctccgtggtttccaagagctattccatgataggctacagtgggatagcaaagtagtcgacttcgccacaaccttcatcggtgacgtattgtcacttccaattggctcaccagaggatttgcccgagatcgagtcctcatatgccctggaattcctggcatatcactggggggcagacccttgtacccgagacaacgctgttaaggcctatagcttgctagcaatcaaatacgatcctattagaaaaaacttgtggcaccacaaaataaataatctgaactgaatatatgtaagcactctatttgtacgaatatatttacgtgtgtacgtgcatgcacgcaagtttaatctagttctacaaacctactgctgtattgagattgatctcttccccttcgttttggaccgctatcattgatgcgtccaaacccgtcctcgttcaactgctttctgaaaaatttagaacgtttaaccatcttcagcgtccttgtgtagcacatctctccccatgacagatatctatgtatccagccgcccaactgatactggttgtaaaagaatatcattcccgtctcccttcttattgccgataggagcatagctaccaacgtcccctctactacccaccttatcattcccaacatcttgcaatatgttacgatctgatcttcactctcttttgctccttctttttgctgtttaactgttacctacactcatttattcgatacctttttttacccattttttcttcatgcagtttagcactagtacattaaaaaagaaagaaaaaaaatgaaagcaagactaaaatatcgagcaaagcacaagcaaatacaccgtttgtccttttagcatagccaacaatgaccaccgtgtccatcaataagcccaacctgctgaaattcaagcatgttaaaagctttcaacctcaagaaaaagactgcggacccgtaacctcattgaatttcgacgataatggccagtttctactgacctcttcttccaacgatacaatgcaattgtacagtgccacgaactgcaaattcttggacactatagcctctaagaaatatggctgtcactccgctatctttacgcacgcacaaaacgaatgtatctattcctctacaatgaaaaattttgacattaaataccttaatctggaaacaaaccaatatctaagatatttttccggtcatggcgccctagtgaatgatttgaagatgaaccccgtgaacgatacgtttctatcgtcgtcatacgatgaatccgttaggctttgggatttgaagatctctaaaccgcaagttattataccaagtctcgtaccaaattgtatcgcatatgatccaagtggccttgtattcgcattggggaacccagagaatttcgaaatagggctatataatctgaaaaaaattcaggagggtcctttcttgataattaaaattaatgatgcgactttcagtcaatggaataaattagaattttctaacaatggaaagtatttattagttggctcctcgataggaaagcatttaatttttgacgcattcacaggtcaacaattattcgaactaataggaacaagggccttcccgatgagagaatttctagattctggatctgcttgtttcacaccagatggtgaattcgtccttggaaccgattatgacggtaggattgccatttggaatcattctgattcaataagtaacaaagtattaaggccgcaagggttcattccctgtgtttctcatgagacctgccccaggtcaattgcattcaaccctaaatattcgatgtttgttaccgcagacgaaacagtagatttttacgtgtacgatgaatgactgctgctactgcattgatatactagaggatataatatataacgaacattttttacctactgtataacgacgtatactctatacatcttgtgtattctttacaaataatcgtcaatgttggggtaccttacgtcagcgttctcttcacaccattctgaccaactttttaggtacttgttaccgcacctttgcagaacttctatattgccaacaacaactagttgccttctgggtcttgtcatggcgacgttcagtcttcgttcttccttaaggaaaccaacttcaaatttttcattgctacgaactaaactcaatatgataacatctttttcacggccctggaacccatctacagttgatatttcaatatcagttaattttaattcatcatggatcaattttttcagatgagaaacttgtgcattgtatggagaaataacacctatagagttctccgggacgttgaatgaccttaaattctcaatgtgttcttttacaatggcaatttcgccctcattatacttagatccaaggatagtagcttcatctgcagtctcttgaaattcatcaccttgcgtatcataccaaattaaaggaatttttgtatcgtcatcatcctcagatggcgtagcatcgacggtcggtaggtctatcaaaagtctgttcgcgaccgttgcatcggccaatagtttcccattatacattgagtgcgatggaaattccataattttttgattcatcctgtattgaacgttaagaaattttaccatatcccttttcgggaatattttgattattctgtcaaatagtgtggtttccaaattgtgaatgacatttttgtcgtcttctgttttgattgtgggtggcaattgtttattgtcaccagcaaggactagtttgtggaactgattttgatgtgcaattagtgggatccagcattgtggttccatggcctgtgagacttcatcgatgatcaaggtatcgaaaagctggaaatttggatcatctctataaagggagcatagttctctcgatgatgaaccgtgtaaagtggtgacgactattctcgattgtattattaagtccttaatggttttgaactctcttttctttaaatctttgcgcagcagtttaatttcgttccagttttctttacgttgcttatagttttttagttttttattctcctgaattaatttgtcaatctcctgggaaatgtccttcacaatagtattctttttactaagtatatcaagagagtgtcttttattagagtctaatagcctagcaggatgaccgattcttaataataaattattcggcacaagaggcgttagcctctccagaatcgtatccacagaaatattggaaggcccacaaattaagattctctcctcaggatttttaattagcaattgctggatcaattcaattaatgtgaatgttttacccgtaccaggaggaccatgtataatggtcaagtcattgttaatggcaaaattaatggcagttttctgggagtcattcagattcgggtttaaaaaagatttaatgttttgaaagctgtttgtattggggatgaaggggcgttcgtttaccaagtattgtataattttgtcttgtatgggtgaactaatttcagacagttttctcattgtggattccattctattatacgtgacgacattggtagtctttaaaatgtaaagtttgctataagaataaaatgtggtagcaataacatcttgagattcttctagagctatggtgatttgagtatcactcattttgtagacaacgcctgagcattccgcttgctcgccattggagtcttcagacacctttttgactttgggcttagtcttggtatttactttggtttttgcagggcgtaccaaaacaatatcaccaaccttaatatcacccctttgaattttgtcgttaaccgccaagttaggtcccagttccatatataatttgccaatgagaccggatcttatgttttctagatgtatgttgtttattgccaagccattttgcaccaattgttggatagatagcgttgttaatagcctagaagttgtttgaatgtcttgttcacgttcatgcttgatgcttgataaaaacttagaagccaattctttgttcatttccctctactcttttttctatatttctcaagagacaactttacatcagccttcatatttttgaaatatatgtaacgtacaagattttcttagcgtaaggatatgcaggcgcacatttgtgtatatatgacagtaagaatgtttaattataatatttgccagttatataaacctgtgaaaaaaataatagaatatggtgcgtaatatatagaggtaaagggtactacatcacattcaaattgccgaatctgtccttgtaaccaggtacgtcccatttacccttcttgaccatctcttctaccttagcatcaatttcaggtttgatctttgtcaggtcgtcaacagttaattcatcgaaaggtcttgcagattgaatattatctaaggtgctttgcaaatcctttaactccttggaaactaaggattctgtctccttggcgttggtcattgcgtgcttttcaaaagactcaatcacttgtaattgtttggaggcatcgattttgaccggcttatattgcttaacgtatgattctatcttgtcaatgactgaagtgtttttcaacacagatctataatgactgaaatctacttcggtgggttgactttgcagctctagtaattgtctacgtgcctcatcgtttctctttttaaaactcgataattgagtggcagtcgaccctgttatacgtagagaagagatgacttttgcccagtcaagtttgttagcagcggatttggccaaagacatagtcgaacaaaaatataattaggtgattctgcaattaagtgcacgaaaaatttcttttaaatcctaagattgttcttttgcgttacgtgtcaatatgaatatataaacttatatagaaaagtattgtactagtagaaatatgttttacacctacgctaagcagcaagtggtaattggtgtatcttttacttttttgggggcatcaagacaaatatccaatcaaatcgaagagaaaataattcttgtaacccgctcattagtcacgtggtcatcacgtgagcataatatatcacgtgatatacacccatacctcgtttatgggattgagtcatcggatatgtcattataaacgatatttctccgcggcaatgaggtggcgaatattggagtaaaaatgaaaacatccaccaggtgcttgatgatatacttgacttcggcggcaatttaaagctttctaagcagcaattagtaagtaaccattacaataacgataaatacgacactggtccaactaactcattgataggataattgcagtgatcttaacgagtttaatggtgaccgaccaaggcagtaggcattcgatacaatctaagcaaccagcctacgttaataaacaaccgcaaaaaaggcagcagagatcttctgtcgcatgcctttcttgtaggaaacgtcatataaaatgtcctggtggtaacccttgccaaaaatgtgttacgagcaatgccatatgtgagtacttggagccgtcaaaaaaaattgttgtgtcgacaaagtatctgcaacaactgcaaaaagacttgaatgataaaactgaagagaataaccgcctgaaagctttgctcttggagagaccagtgagtgtacgtggtaaggataacagcgatgatgacgagaggcatataaacaatgcaccctcaagtgacacattggaagtatccagcgctccggcggctcctatatttgacctcatgtccaatagtaacactgcgtccgataacgataacgacgatgacaacagcaacagaatcacaaataataggagctatgatcatagtttggaaaaatactacaaaaaggccatcagcatctttaaacaaccagctaatgctaatggcgaaaatggcaacggtgccaatggtcatgaggatgatgatgaagatgatgaagaaatatcaacaaattttgctcaaagaagtggtaggctcatagaatctcacaatggattccattattttgttggatcttcttcaatgacattatttgggttagaaattcaatctttggttacaaagtatatttcggtcaagaattttcgacctttgccaataaacaccaaaaacaagattttaaattcaaacctgaacccggctataagttcttttatcaattcaaacaactatcttttctcgtcctataattttttgaaccctatatcgactattgtcaacttaaactcaatcaacgataatttatctccattgatgtttaagataattttgaaaagcgatacggatggtagtagtggccaggaagaggtaatacagtttcagttgccttcgtataattacacaaaactattaattgactgctttataaattataacgatggttgtttttactttttcaacgaaggcctggttaaatgtggcattaacaaattgtacttggaaaataaatggctatactatgataataccaaaaaagctttggacaatgagaatgatccaattttacaagctgtttggttttgcaaaattttgttaattttagcagtaggtgaaatgtatctgggttccatcaataatgaaatgttgaagaattattctaatcagccaaaattgcccggttcaaaattttttcaaatgggttctaaaatttttaattgtttgttctcaagtgaaagattagaaaatgtgactaagaaaggcggtattgaagtcctgttgttatacgcgttcttcttacaggtggctgattacactttagcctcttatttttacttcggtcaagccctaaggacgtgcttaattctaggcttacatgttgattctcaaagcgacactctatccaggtatgaaatcgagcatcataggagactttggtggacagtttacatgtttgaacgaatgcttagctcaaaagctgggttaccattaagtttcactgattatacaatctctacagcactgccagcggatattgatgatgaaactatcgaagagaaaaatagtcactatgttttcagaaaggcagaattgatttctaactgcgttactattgtgaaaatcaatgcacaaattttgagcaaattatatcaaaggcaacctgagacaaacatcataattactttgaaagttgtcatcaagcagttgttggaatggaggaacaatttgtccgattccttacaggtggattttacgcaaaaggatgaagatttcaaaatatcgagattgtcaaccaatatgtttacggaatattttcaaggaataaacttggccgtgagacctttattatttcattttgcatccattcaattgaaaaggttcaaaacgagcaatactttcgtcaacttacaaaactattctgccacaatatcttccttattaacatgttctttgcatgcttctgtgaatactattaggtctctgtggagtttattacagaatagtatgcttgctatgtttagttatatggacagagagtatctttttacttcttcttgtactttattactattcaacactgcttttggtattcatgaacaaacactatatcatttggatcattctctggaaattttcacacaaatgagaaacttaggcaacattccagcaggcttaagaagagcacaattattaacattaatggcaaatttggatttccacggcataatgaatgacttgattactaaatataacgatattttgaaatttgattctatgaattgtgaaaacgataacatagtagaagatagcaatgaacccaaaagagaaaccgaaaagtgtaaacctcacaaagatggcgatcgcattgacccttcaattatagactgtgataaatcaaacaccaatacaaatatgatcaagaacgaatctatatcgaacattgttagcatacttccggaaggcgcgaaaccaacgctgactgattatagtaatggtaataatgatgttaatgatattaacgtcaataactcggaaccttctactttttttgatatcataactgcgagcttggaaaattcataccaaaccacgctaactgaaaagggctctcaggtgatggaaaaaaacatggatcagttggattccgttcataatctaaatgatgacgatttacaacaattgttggaggatttaggcaatattgatcattccgatgaaaaactttggaaggaaatcactgatcaagcaatgtggctgggaaatactatggatccaactgcagctgctggtagtgaaattgactttactgattatttaggaccataacaccattacaaagacaaagaagaaaatactgatttctttgttttcttatgcatatattatacatttcgcacattatatagaaaagtggacatttaattcttcaaatcttatttaaaatatctatcacaagacagctcatttacgtagcctcttgacaacattgtcgctatcaccttctgtccataatattagccttttttgtgatttgacaagctcgttgtagcctaatagtagtttttcaattccgttttgttcttgggctaacctcaaagtagtatttaatgtacctctgttttcgttccgtaaagtaccaatgttgttcagtatatcgtcctgtggtagtctagatttgatgttattgttcaaaacctcgaaaaacgacacaataccgtttctgctaattaaattcaaaccaccatcatctgctaccctttggactttgtaaaaaataaaatagattagttcgcgtaatctttctttcaagtatggcatattgatcaagtttaacaaccattcaaatacacctttcttctctaacatcttgtaatcttcatccgttttaattcccttacaaatggttgttaaaacccaactcaattctccatagtatatttccatatcaatttctttcttattgtcatcttgttgtctcttattgtaggacatcatcacatcagataccatagggatgtcccaactacgtatggtagaatttgataatacccagcggtatgccttctcatgtaagggcgcagttggacttcccaatagatcaacaattctagagatagaaaaccaaattaacggattgataggatcttgattttgttgtctctggtataaaatccttttaatcaacacttggtaaatgctattatatttgattaaatcgctatcagattcttttctttcattatccttgctagttatttgcttttcaagattcatctgggcagttttcttctccaaagaagaagctaaatttgataaatgttcgtaacttatattggcaacggtatgacaatcgcttaatgagcaaataataaactgaaatattttgcaatcaaggaaattttcaaattcatatctgtatgttacattgccctcgtcatctttgaccatttttaccagctctttgttatggattattaatagcagtaaaaataatggatcgtacatatcaacaccagatcgttcggtatcatcgtagtactttttgactaggtcacaccttgtagtagcatcataattgtttgtattagaatcggtatataattcagggacttgaggcctttccaatacgtatctgtcaatggactttttgatcatgtttttttgtagtgttagtatcaacccctccctttctttggtaatcagcctcgtgtctccaatggcttccaagatttcttcctcttcgtctttgataaattcccaagaaaaaatcatgtttgtccatgaagtagcggtgtgagattcgatagtttctagaattttcagtatcaacttgtcgttactggaaatagtaccggagtaaaaagtcaataatttctcttgaactattggcgtcgaatttacgaccgggtcgatgctgaataaagagaataatatcattgtgcttaagaactttcgatacgatgaatcttcatcattgtctttaatcattattgatgagtaactgtcattgcttaataaaagttgaaccattctttgcgattgaattgactttttgctcacacaaaaaattaatacaataacgtattcaagaaccttaatttgtttgatccactcactgcctagaatagcctctaattgagaattaatgattttgacattcaacttatttggtacctcttcaagttttaagagctcagccatcgctcttagtaactcaaaaaaagaattggagataacttttctttctgaaaggtactttgtaaggtaaagaagagttttatgtaaccatgtttctacccctggataagtaaaattattgtgtgcagctatgtatcttactgtagcagcatgatatttatggtcgctctgtgataaaacacatttcaaaatttcatttcgtttcgtttcgtcatagaaatcaatataagtggtaatcatatttaatatttcgtcaaaaatctcacttttcgaggtagtgtaagtacttttcgcaatttcattaccatacttggaaatggtttcatgcgcaaatgcgctaaaatctttatcctgcatgtgcttgaacaaagcagccgttgttacaatacttagtaaaggtgaatccttgatcctccagatacttggtatgaaagatgggaaagaaaaatgttcccatctgtaaaaagctttcagtactagataattcaaatcactagacacaaaactatttatcagagaagtagtttctgaaagggatagcttacccataggatcagatgaagcatcaacacaaactttgttttcttcaaaaaatttagccaaagagatgtttacttccttaattgaagcaggatcttcatttgcagctttgttcagtatattctttacaagggatatttttatagtttttccttcgttgaataatttttggagaatgtttcttgtggactctagtttggtgctacacatgagtagcgaagttaaagctgaagtacttaaatactcactaacacttgttaagaaagcatttacatcttctttctgatacaactcattatagttggcatactcttcgacattttcaccactaaacacgactttttgaattatttctcggaattccactaattgatggcctgtttcaaagcatactgcaccgattaaattgcacatgaaccttgattttttcatgagtagagcatttcttttttcaatggccagttttggtaaagcgaaatttatatacctttccaaaactttgataattgggaattctgtgtctgttaccatgtagctagcaatcttgccagttaactcacaggcagttgcttcgaaccaattgtcatatacaacagaatcgtcttctaccaataactgaactctaaaaaggattcctgccgcatctaatttgttcactggtaatctagaaatattcattagatttttagatggaagcgccgaaatatactggaaaaaagatgagctcttcattgaagaaattaaagaattagagctattagttttctttatgttttcttcaaatgagtcaagtttcaagtatatattaacatcatgatcagagacctcaggaaagacatttttaacaagtttatctatgcctatatggtcttcaccaatgaaaatcatgtttctaagaaaaagtataagccatttaattaaaaactctgggtttccactcttgtcaacgtatttccattgctctgaaaggcacattatgaagggagaaatgtagttatactcttttgccatatcgacgtacttgtatggtgtttttacgacacgagatatagtttcgtcaaaccacttccagacttgttccatgttgtcaatttcagaaacttgaagggaaagcccttgaagactattcactaaagccatcactggtgaaattaaagatatgttgaagataacgtttgttctcgtcagctcatcgagcaagttggatattcttgtagttatcacgttagaagcatttttggaggatgctagctttaatagtagggtgaataaagaatttccaccagaacttggattccaccacctggtttgagtagagttaaattcttgaaattgtaagtagttgtccagaatagcaaattctatgccagaaatcttggatttttgcatgatatctgtgtaaatatttgatgatggtaggttaattgagaagaggttggggaacattttactatagtagttgaatatgatggatatggacagaggtaaaattctattatccttattggaagccaaagaattgctcaaagtagatacgaagattggtaaatcaggaattctagtatgaaactcgttgagtaaaatagttttttcatttctccagcctttttgatcataaaatgtggaaactttttctaatttttttaacgctagaactattgattgacaggctaattgtcttatgatgggtgtttcaaattgtagggatttaaccaacgaggatttggtgagcaaagatggcagaatgttttctataactaatgaagtggcaggtggaatattgctatcaactttctccataaattgcggtatcttaagattaataatcttgttaatcagtaacgttataccaaaccaatacgaagtcatcttagggtcatagttaccattcgtcgttaaaaagatgctgtaaggagcaacaagttcgggaacgttctccaatattttgatcaacgtacctaattgcagcgtatcttcccaaggtttgaaaaggcgtaaagtgttgaacaaaagtttattatgaatttgaaattccacttggttgacggttatcggagctccatgagaagctccatcagcaactgaatttttgaaccaaacgcaattatcaggaaatgctacgctaaagtcacgggaagctccaaaagttaagaaaaactcatttgccttcttaaccaaattcttgtttgatgaataataaaagtgatgaatctttgaagccgctagttcatttaaaattttggttttagtagttctcttgaaggatttctcctttaaaatgtcgtttatgaataccgatagtatgtgctcagataacttgtcagaatcagccttattcatgaatttaaataggttgctcataatcttaaagttttctgtcaaaagttcttttctcacgaatggggaagcatttgagatcaatgtcaaccaaaacttgataaatgtaaatcttaatgagtcatgtttggatgaatcagcagatgaattcccattggctaactcagacttgcttggtaccaacagtcttggtaaaataggtaatgaaaaatcgaaatatgaaactaattcctctatatgttgcccattgttgaaattgactatttgtttgagtagacgaagaattggattagttaattgcgcacgcatattgttcaaccctctatagagaacttttgtgtaatcggtcaatatcaatctaattagaccgctcccaatagtcactgtactagtatcagatgacaaaactcgtaaggttttagtcagtaatgaggtagttttcgagaatttcccatggttatttacttgagcataatatgaccaagtctgtaccaattgagcaccaaatcctctttggaagaacactattagaggttggtaatctttggagagagtttcatcttcgactgcactgattatactttctagtgtttctaatgtaccgtcttcgaactctttcccttgggtgtacttctcccttctctggtcgcgagatccataggcttcgctatgattactcattatgtaagtgctcctctagttctgttagatgaagtagtaccgcatagattagagaaataatatccaatcaagaatataaccgaactattctttgcgatgagctttattgctgaaatttttcatatttcgtctacagtgatataatattgaaatcctcatgcaagtcgtgcataggtaaaagctgtttactatatgttggtgcactattatcatataattttagtttggtcgtatactagtgcggcagtaataataaatgctttagaatcttcaatcttcatttgtttacgtaaaatgaaaacgttttgtgttagaattgacagattgaagtttaattttaggtgtcgggagaaacattttaatccctttttatgaatataatttaagtactaaaaaaatcaccataattatacaaagtaactgcaatttaaaagtacgtttataattaattcacatacacatgttattgtatctaactaaatagtctcgaaatagttcaattgagtacgcaaactaacacagtcagtacagatcgtaaagttttccgtcaatagggccctgacggagaaagattccctttcctatattaggaatctaatagacaaattcatcaagatatgcttccgcaacaaatcttgctctggcattcaaaaacagtttaatttcactgatttccttatccacgtcctccatgaattcaataataaaatcaaccaatttcccagttttcattgattcagtatgcttattagttattagaaaagaaatactgtagccaggtattggtacacgtctcagaatgtagaatgcttcagcacgctgttccaaaaatctagtaaacttgtgaactaaaatctgctcaatttcatctgcctgtttcaccattaaactcatacgcaccgagtttacactgggctcaatcaatacttgttcattttcattacgagatatatgcatcggttggagcaacaattcggcgctagtgttagggacttcaacttccggtctgttgtgcctctccacttcctgcgaagagaaattgctcaaagtcaacgcagcttccagggaataacgaacagccgttagatacggacgtaatgattgtgacatttcctactatcagttgcttcctcttttatcttttgtcaaagtgacaccgagttgttccgaaagcctctatttgcttggctttacaggctttttttgttctataattgtattttgctatacaaaaggggcgacgtggtaaacgatatgaaattatcgacaataataatgtacttggaaatctggcagttgatgacatcgcaatagcgtgcctacctatcaggataacaaggtctgaagccagatcgaccactagacaagcattgccggaggtgggagacgtgaaactatgtctatttggaaggaagctaaagatgcaagtggaaggatatattattacaatactttgacaaagaaatctacgtgggagaagcccaaggaactaatttctcaggaggagctacttcttcgagaaaatggctggaaggcggccaagacggcagacggcaaagtatactattataatccaacaacaagagaaaccagctggactattccggccttcgagaagaaagtagaacccatcgcagaacaaaaacatgatacagtatcccatgcacaggttaatggaaatagaatagcccttacggctggagaaaaacaagagccgggacgaactataaacgaggaggaaagccaatatgctaataactctaaactgcttaatgtcaggagaaggactaaagaagaagcagagaaggaatttattaccatgctgaaggaaaatcaagtagactctacttggtcattcagtagaattatttcagaactggggaccagagatccaaggtattggatggtcgatgatgaccccttatggaagaaagaaatgtttgagaaatatctttccaatagatcagccgatcaacttcttaaggaacacaatgaaacaagcaaattcaaagaagcctttcagaaaatgttgcaaaacaattctcatataaaatattacacccgttggcctaccgcaaagagactaattgccgacgaaccaatatacaaacactccgtggtcaatgaaaagacaaagagacagacctttcaagattatatagataccctcatcgacactcagaaagaatcaaaaaaaaaattgaaaacacaggccctaaaagaactaagagagtatttaaacggtattataacaacatcatcctctgaaactttcataacctggcagcagcttttaaatcactatgtttttgataagagtaagagatatatggcgaaccggcacttcaaagtcttaacccacgaagatgttttaaacgagtatctgaaaatagtaaatacgattgaaaacgatcttcaaaacaaactaaatgagctccgactgcgcaattataccagagaccgtattgctagagataactttaaaagcttattaagagaagtgccaatcaaaatcaaagcaaatactagatggtcagatatttatcctcatataaagtctgatccgcgctttttacatatgcttggaaggaatggctcgtcctgccttgatttatttttagattttgttgatgaacaaaggatgtacatctttgcacaaagatcaatagcccaacagacgttgatagatcaaaattttgaatggaatgatgccgatagcgacgagatcaccaagcaaaacatagaaaaagttctggaaaatgaccggaaatttgacaaggtggataaagaagacatcagtttgattgttgatggtttgataaagcaaagaaacgaaaagatacaacagaaactccaaaatgagcgtaggatattggagcaaaagaagcactatttttggttacttttgcaaaggacatatacaaaaaccggtaagcccaagcctagtacgtgggatttagcttccaaagagcttggcgaatctcttgaatacaaggcactaggcgatgaagataacataagaagacaaattttcgaggattttaagcctgaaagctctgcaccgactgccgaaagcgctactgcaaacttaacgttgaccgcgtcaaaaaagaggcatttaactccggctgtggaattggactattgattctgacgtgtcgacctctatcttgttaatcattatataaattatacatagagattacatgttatttcaagtttgcgatcaccgcacaatttcttagtcattgttgtaagtgttctgcaaaaatttcagcttttgtaccttattttcacaaaattcaaacacctgtccgaactgtgttttaaccagtgtttttgaattcaagagttcagtaatactttcataattttttaaccactccatccaagacaaacaatggaggaatgaatctgccaaatcgtcatcttttctcacccccgaattatcttggatctctagtatatcacatagcttgaaacttttttttttggtaagggcatttcttatcctattattccaaactcctatgaactcgaccagttttgtagaactagttgaattaccttctagtattgaggttgaaagtatttttttcactagctttattcgagaatctttgctatgtttgttagattttaacttttttgaactggtcggtgtctcttctcttggaatgcaccaatatgaagtcatccgatgtggatcggacgaacataccatatacctcaacttggacgtattcggtattttattcgtatacttcattttattttccaagttagagaaaagaatctgttcgagaatattcacttttaaaattgggtctaaaatatgcctcgaagacatagttctggtacgttgcctttcaattgtaaacatatctggtatcggcatagattcaaataaatactccgtaaggttaaatacaagctcagaagtttcagcaggattcaagcttaactttttgaggttttgaaaaaatttctcctctagatttatcttttgccagtctagtactttagggagcggatcattattgagcaattgcatcttagagaaagcaaagttagaaacaccagcatccatagacaatatgttaattcttccctctcttatcttttgttgtcgtaacttctccaaaaattcacactgttcttgaatgtaggttcttttagcttctttcgtcgtgccatttactgctccaataacaaatgataaagatttcagttgtgtgctttttgcattttggcagcaggaatcgatgagttgcaatatcttagctttctgtgctgtcgacatattactatcttttttagctttagactgtataaccgtaagccttcgttgtatgcaatggataaacaaatatggaatcgccagttgaaacaaaaaaatgagaaaagtacggataatccgaagaaatttagtctgattccatccattttttgtatcttaagaaataattttgaagtcatataaaacttaaatagaaaaagtaactaaaatttaggaaagtagaaaagctcctgcaccctcttcaatggcttgacaaagacgagaccgcataatatctttgctagtatacttcggcaatttcaaataattagcacatgtcattacacttggtagatattcgtctgctgttaggccatcttcagcatgctttaacacaactgtaaactttgggttcaaacttttaaatcccccaattggaagcttgggagatcccgttaaaaattgcaaaaataatcttctttcatgcttaccaaacgcggatattattgatataaaatcatgaatgattgaagaatccattgtatagccatgttcagcgttcaagtttgtgtataaagttgccatagaccagtcttcctcaactcgtccgaaaatatccactaattcatccggaaaaagtattagcatcctctcataggaaaacacctttgaaaaaccttcaataaatgcttttaactgtttttcaatgcccttacctaatatttggtcgataacgccatggatatattcttcaacattagaagagttcaaggatttattacaaccccccggaatcaactcaatgtcatcatttccaggaacggtaaatgtcaaggacaacgattctagggtcatattgtcatccttattcgctactatgtatttaagggattttgcgagtaacggatctaccaattcgatcattaacagacaggtttcaacgtcgctcggcactgtcgtcacattgggcgtagacattctgtgcaataactcaaaaaagactttgctaaatctaaagtcaagaattctattatcaagcaacgatctggcaacaaatgtccccaaatatccaaaaagttcaataactttttcattattggaaaacgggttgaggggctctgggaacaataaagtggtaatataatcgtcagtagtatcaacatccatttcgcttctgtaactataagagttacaacgccacatatttaacgactttcttgcaaaatacttggaaactacggagtaaaattccaaagtcggtcctaaacctgttcctgcttcttcttgatattcaatttccagtacgtcagggctacttccgtacttggataaaatcttgagaccggtagcgaatattgtttttcttgaaatccgcagcttacgcctagtaattctcccaagttgttgtaaagcttcgtcattccttaaatctttcgagcctttactcttattcttccaaagttgaatcaatcttccgtaaccaaatgaagtacattgtaggaaaagcatcctggtatcaaacggaaacaaaaatgggaatctcctggtcaaaaatagtgaccaatccggcaaagctccacttgctactaccaatggttcatctagttgtctagcgagcttagcgcttagttttgagttgataaaactgtcgcttttaacaccgcagctatgtagaaaatccagcaatgtcagaatatccgctgaagatccagtatcaacctgtgcgaattctctttttttataaaaatctcttaactttttcccctcattagcttcctcggctgcctcactctctctattgttaccttctaaacttttgcaaaatttgattgtatgtgtatcatcccataaagtttttaagtcacgatttcgcctgacgaatgtattaaatatcacaccaaatactgtagactccatgtcaactttttcattatcataaaaaaagtcaaagttcttttttctcatatgatccaagcaattttcttcttcttccctatcagcttcggtactggaagatgtaaggtttgggattaatgaattcaaaaaacgcattcttaccattctgtgtctcaaaaactcattaagtgaggtaaaagaagctatgcaatggaccgaaacgatagtagatgataaatcagtaccaatattatctttgcttgcatcgccatcataaaccaacttaatttttatctctttagccagtgaagatacaccaccaccatcgtgtaaaccgcaatcaactatagagaaattctccagccttgtgagagcagattgtaggatttctaaaaatctgtcaatacaatcctcaaatacctctaaaaatgatttagcaagaatgaaatgggataccgttgaggatgtaattcttttagttatggaggaagctagccctgtagaagtaaattcgaaacctgacacgtcgaaatcttcatggaaaatacatttttttaaaacagaccaaattcccttccaatcctcttcagttttgtccggagtggaaggattttctaaaatagaaacaacgccttcgatttgatggagctcctctgttattgcttcttgctcaacgttcatctgagaaagtactctattaactaggttcacacccttgtttttaatataagctagagatagagttctgaaaatgtgtattgaaattttctttggttttactgaatcaggaatttccatatcagtaaattcgtaatcatattcttcatcaccctcatcacattcctcaatactgctatgcaaatccccttcttcgtcagaaagtgaaatattttcattcccgtcttcctttaaatcaatgttattgaaatccacagacaaatccttaaccaaatcaaaaatgccctctcttttgatggaaggaaagaacagttcggaaaactttttacaaattaagtcaagcaacgagagaccaccaaccaacagtgtaccagcttctgatgagtaagtaccattagcgttagacgctgtttctttttgggccaggatagatccgattaacttaataagttgatcattgattgcctttgctgtggaattatttatgcatgatacaaccctcagtaaagcaataagtacgtatcttcttacgtcaaagtcagcagcatttgtataaatttcaacgagaattggaattagacattgaactagggaatcaaacttttcctggttagaaattacgccacggtcgctatttccggtatatttatccgctgacagtattctttcatcctcgggaggaaacaatacaactataaatctagaaatgctaatcaataaactgtttgggacataaatcagtgtttcatgtaaccctgcgttaggacttttactataatgctggaatgatcgtgttgccatgtcgacaatgtcagttttctctctcagttctcttgaaagtacatcactactcatcgctaatacggttaaaatatccaaacatttcagtttattctccaagggggtatcctgaatagaaactagctgaactattctttcgattaaatccaacgaaaacaaagtctcaaatttgtcaaccccatgcaacgccccgcaaataccgtacatggcatttacaagcctggttaatattggttggtctgtcgcattcgagaaaattggcttcagcgttggaagtacttcaacaatggtcttaaagtcatccgttcggatactgctacaggcgttcgaaacaattgcgatagccttcctctgcgcatgtatagttaaaaaatcgaagaattggacgtagattgataattggcccgtttttaaaatgtctctcccatgtactctagaaatatattccaccgtttctaaaacttgttctgcgaggtcaatgtaactgatctctaccaattttccttgtaaaattggtataacgtgttcatcaacagctattgaaatagattcagggcagacctcaaaaagattatacatgcatctacaagcttgcatttgtaattctaattcttcccgtaaaattttatcagagagtatggcagctatattacctattaaggtttccatcggtataattctatcgacaaccatttgattcatcattaatatgttttcagaaagttcttttaaactctccattgcaatataaggatcctcggaggcattcccagtattctctatcaatttagaaatccgctcattccttgccgaactctctgcgctcctctccatccttcctccaatcatcgataaaatctcgggtagtgttcttccaaccgggtgttgcccaagtccttcacttgtttgtcttctttgttctagtctttgtgcgaatgtttccaaaatgtcaggtaaatgtagggggttgctgccaaattcattattatcgtgagaacgttcaagtccatcttcttcttcatttctgtcttcgtcactgccattctgagttctatgatatccatataaaagtccagaatcatcttcatgatggtaatcgttatcgtcatcttcaccatcatctgcctcaaaacttccgacgctagaaagcatatgttcatcttcatcttcatcaggataataagagtactcaccctgtacatggccatcctcatcatagtcatcttctacctgcgtatccatcatataatcactgttttcgctatgggactcatgttcatcaaggttgtgcgaattattttcagacatgcttggctactcttctattttaaatgtttatccaaaattttcacacctgagatatattgttgttaataaagcacacagaaaggaaagtatcgatcccagaaagtggtctttccctgggtatgatcaaagctattcccctttccaactactgttggctatgatcccacaatttgatttcagttcagaaaacccaaccattaggactttacccggcgaaggtgaaagaaaaaatttttttccagaaaaatgcgatgagcttttgaaaagttgcaaatatttgtagtactttggctaagcagagctgattccttttgctatacgtacatcactgtctatcgtccataaaagatttattatagttgaatcatgccaagatcaaaacgttccaagctagtcactttagcacaaaccgataaaaagggcagagaaaataaagaaagaattttcgatgaagtgagggaagccttagatacttatagatacgtctgggtcctacatcttgacgacgtaagaactccagttttacaagaaatcagaacatcttgggcaggctctaagttaattatgggtaagaggaaagttttacaaaaagcattgggagaaaagagggaagaagaatacaaagaaaatctgtatcaattgagtaagctttgtagcggtgtcactggtttattgttcactgatgaggatgtcaacactgtcaaggaatactttaagtcatacgttcgttcagactattcaagaccgaacacgaaagcaccactaacatttacaattcctgagggcattgtctactcacgtggtggtcaaattccagctgaggaagatgttccaatgattcattctttagagccaactatgagaaacaaatttgaaattccaactaaaatcaaagctggtaagatcaccattgacagtccatatttagtttgcactgaaggagaaaaattagatgttcgtcaagctttaatactgaaacaattcggtatcgctgcttctgaattcaaagtcaaggtgtcggcctactatgacaacgatagctccactgttgaaagcactaacatcaacatggaataagctgaactattatttggaagccttttttaatagaccattgtataaaaatttcttttttttgtatagatatactaaagcaacgctcataaatgtaacatagcttcttttcaactgagaatttatattcatgctaactaagcgtaaatcacttttgatcttcacagctctttagcggcacgaaagcaagaaaaaaagataacactgtatgtctggaaaagaatactataaaaatacctgtttacataaaccaataaggaagaacgtgagagcaggaccgtaaaagaattaatgtgtaaagaattaatgtgtaatggttatactacttaaaaacaccgttttccttcaaatatcctttttcgttggagtactgtcagttggagtagtggaactttcatcactttcttcgtctgattcactatcacttctgtcatccttgagaatacctctccatagaatcctgtaaagaactctaaaaataaggaacagccaataaagattcactaattgcaaagcgcctatcaatacaaagacaattggtaaggaaatccaacatttatattgctgagtggcaaaattcaagacatagttaccttccgtgcgaaattgcgttaaaacggaccataggatctttaaatttatgtaatgacgcaaataaatccacgcaacaacaaagatagcaaaagaaaaaaaagccaatccagagtccaaataatttagagttttggagaatgacaaaagaaaatcagaaacatccattgtgatatagattggcagtcccattttagtgaaatgaaatacgtaggaagaccaaatcaatagtaaagtaacaatatgatggaaagtcaactcgttatgatcttttcttggcttttctagttgcaatacaagaatgcaggcttgttgagcccaaaatgcagcttgacccaaatagaataccttgaataagaagggattagtgaaatctggatatgttctgtacattgcctttgtgttgaaaaaccataaatccgaatggtacatacaatatatcccgaaaggaccggaaacaccggtgtagaaaatagcgtacatttgttccatgattctttttattctgtgcttagaagtgacgtgtaacctaatagcgaacggtctaatgacaacatccattaggaattcacgtaagaatgtgaaaaaaatcatatagtaaaatacaaagcacaaatcgttaatacctttaccatatgcgttggtatcacctatttggtatgacacagcgacaaatctatgtaacacatttgtctttgtagtgttaccagaagtgaaataggcactatataccgcgattaaaatcatcaagggagctatccaggcatgacggtaacttatctctcggaatgaaaaccagattttcttgaccaggtcgctatcatttttggtggcttcagataatctctgcatacgccttttagcagccgttttagattcttttgtctcgaacatagtacctaaactaggtacagtgtccccgaggtcgatcttacctatggaagacttgcgtcttggtcttgacctcactttcaaattgttgtttgaagggcttggctttattgtcgacatagctcttgtttattgatactgtgtctatctaaatgtttaccggaggtatgaataataaaaacaatagcgatcaaccgacaaaaatatctgtatggaacagaaaaacggtaacgaacaagaaactgtagttttaacttaaatcaggtccggattataaagccgatgtagcagaaaaacgggttcacggaatacaatagccaaataacaataaataaataaataaataaataagaaaaaaaaaaagcaagtaaataaaacaaaacgggatgcaacaagccaaggagggaaacaatagaaaaataacttaaaaatctttgtctagattccaatactttctccctcctcccacgttatttgtctagcatgatcaggtacaatgcccaccgatatgagaaaaaagagtgaaaaaaaaaaaatgacgaaaatggttccgcggatctagcaactttgttggaatgaccggaaaagacagttgtttcctttccaactatttttcattcctggtctttttcctgttgaagcccagcattttttttttcgcgtcgcgttttttcacaacagttcggatcacgtgataatcactgcacgtgactatcatgtgatacgatagccgggttatgatcccctttttcttcctattggaatactgattttacagtggctagtactggatttgagtataggaaggtgttagcaactgtaaggtactattcagaccgttaatccaacggatcataagagcgacagaaaatgtctagtagtaaattcgaagaggtcatcaacaagatcatcaatgacagccctccaggagaattaagggaagtatacgacgatctaatcaagatcacaagtgaaaactccaaaaatactattttggatgctattgagaattacaacgtgcagaattgcatccctatagaagtcaacgggaactctgtaattatttccaaatacaacaaggaaggagcaaagttttttgatcccgtaaattccgtaatattttcagttaaccatttagagcgcaagggccttgacattgaaccatatgagttcacgcatgcaaagatagagaaagggcaattgaaagaactgcacgataaattgcacgaatatcttcttcagagctttccaggtgatgtcagttttgctgtttacccagtccctgaggaaataagtaaaatttctattattattgttagcaccaaatataatccaaacaatttctggaacggccattggagatcaagctacatctacgatttggagaccagggagttatccggtcaaatctctacgcaagtccactattacgaagacggtaacgttagtttccaatctgggaaggatatcaatcaatctaacgttgatgacgttgtttgcacaataagggatattgagacgaatttcgaaaatgatctagatctttcatttttcgacttgaacgaaaaacagtttaaggccttaagaagaagattaccagtcacgagatccaaaattaactggggtagtgcgattggcagttatagattgggtaagaatgcggcagaaggcaaatgaaatttcatgcctgccttattccattctcttcctatttcttaaattgaatacatctatgtacattatttatttttggcttgattggctcactaaaataacttaaacagggtatatagaatgaagaatattaataacgccaaacccaccattctccatatgctattaccagcctttaatgatcgggttaaccttgaggacgaatttttgatatcggtaaacatcgatcccaatgaatctgtcatttggtttatgacagaactgtcagagaccgctcggtctccaatctcttggtttatgtttctgaatgtagctaatttattggctaacccctctagtttcctatcattctgtttaaagtacatgtacatgaagggatgatacatctgctcatccggtgtacagaagcaatagttagtagcttataacatccatatagcaagctaggtcccattctaaacacctatgcgtgttgccggtgatttacatacgtttgattcggtctgagaatacctagaatttgacatcgctatgatgattatatattacctttctaccgttctctccttgttgagttcttccagtatccttcttaatgatataccttatattatttcctctttttttttctgcatgtagcaatgcgcggcttcttgcaataacaagaaaactagagtagctaatttactgcatgaaccgtacattcagcaacaagaaacataagatacttaccgcacaatattcattggtcagttaccgtacacacgaagatcctttctgagtagcgtagtttaagggagcacacatttttaaattctaaacattgcctcaagatgttctcccatatacaaggaaggaatattgagcaacatggttaatctgccagttgcaacaacgcaagtgttattagaaatattgttcaaggaaaatatcagataaaaaatttttcgcacttcgctaatcacccatatagaacatggcggtgttccaagtgattagccctagatcgcaaattatatcatcattcagttacctttctcattgaatcttcttgataagaactactggtacctcaaataggaacgaaatatgataccactgtatcatactatcattctcaacacatttgttatatattttatgtttctactgaaccttttgtcagtcatctcactagcagctgcgattaacagtcatcggatatttaaaattgaagcttttaaaattgaagcttttaaaatcaaacatgaatacacattggagttcactgaagaaattaggtttaaataaaaaaatccagcattagttgtgaagtaaaaaaagacaaaaccagcaaattcttgccagaatgtaactatactctgagtaaaataattgacagcgcaaatacacccatacactatttttacatcttgacatcacatacataatatgtgtgaaatatcaaattttgagtgtccgttatcaattttttttcgattttgcattttatgaagcttcaaacaggtgtcggcctaactttccgcccggaaaagagcggtttacgagagattgctgcttgcagctgcgtgcatttttccataatcgggtttcccttcagcgcgcagtgtttccattctcagcccaattggcaacggagagagcgtagagctttcagtggactgcccttcgtactcgtcgagtactattgaactgaaaaaaaagtaatctaaggttaagttgatcaggtctgccgattgtataacaaatttaattgtttgtcttagtgaacaaagagagtcgtgaaaaataaaataaacaatgtccaccgattctattgtcaaggcttctaactggagattagtcgaagttggccgtgtggttttgatcaagaagggtcaatccgcaggtaaattggccgctatcgtcgaaattattgaccaaaagaaggtatgttaaatccggaaaacctatcatcgatttgaggagggaaatgaacgaggaatgagatttaggctacgaaaaagtgctggcaaatatccaatccgttaccatggatgaagctacttgtaaacgataagtaaatgtgaaaatacacattgcgatagagatacaaaaaagtctttatttccctgttggagtggcctatagtggattatttatttattttgctagcagcttacctagtttcagaaaggtgatgacccatatttgcgcagttaattcttaaagagcctgaccatgtttcctcaaatattaaaccatgccttccatcgttttgaaaaaatttcgtttactaacaacttttatgaataatttttttaaattatttgttataattattataggttttgattgacggtccaaaagctggtgttccacgtcaagccatcaacttgggtcaagttgtcttaactccattgacctttgctctaccaagaggtgctagaactgctaccgtttctaagaagtgggctgctgctgctgtctgcgaaaagtgggctgcttcatcttgggctaagaagattgctcaacgtgaaagacgtgctgctttgactgactttgaaagattccaagttatggttttaagaaagcaaaagagatacactgtcaagaaggctttggctaaggcttaaaatatgtacatgatctttaattctgatatatttcgtatgtaattttatctttaactggtgattcttttaataaataaactacaatattataactattgaaagcctctgttattcacacatctttggaaaaaaaaaaatacaaatacccagtgagtactaagtaaatttggagtacctaagggcttgtatcggtggggttcctgacctagctttatgttttacaaacgcatgcatataaaatttacaaaactacaaaaaccatgaacacaatgaaaagaaggaaaaagagtaggtttgtcgtgaaagtacacgcctctgaagttttgttatcatattactataatattgttacaactcttaggaatcttatatttaatggataaattcctgtttcacgacaacaaatgcgaataatgttctttcatctgatttcattcgcgaaaatctctcagatctttcatcattgtgactgcctaaaatatctttcaaaatttcaggaatttcaccgcccttcgatggaacgatataaaaatccttctcgtatctagtttttggctttatacctgcaatgcgacctttgttttccagggagtctacaacgtcggcaaaagttgtcttactttcactatcattcgaaggaaataattggtatactaatatagctctagagcaagaaatttccttaagatatggtgcagcagtggttgtaggtaagcgcccttctacatacagttttccgtcaccaatggcttccttgaaaatatcccgtcttaacttttgtgaagccccaatgtagtttaggtaacctgtaaactcaagtcctaagccgggatacaaaaatgcgcagtttaaagattcttcgttgattattgtacttgggctgggttctttcgaaatggcatgagtctgttctattttactcttatcgctgtcgatactgtcaatgttgtgtaatcttatgctgtcttttgagtacaaaatatcctcttgaggttcagcgatatcttcgatcagctcatcacccttgtgggtcttaacgtacatgggtttgtcaggtacctccacgataaaattttctaagataatcttatcccttttctctttaaattcttgtaagtcaggatttgcgagttcagatgcgttcatgttcaccagtttatttaaaggcaatttgccctcgacaacgtgtgccttcagttccaaattttttttatcctttaaattagagtataacgacctcactttctctgtgtatatcttgtccaaagtaccaaactcgacgttaaggcaagctttgtaaagttcttcttccagattgtgcgcaaactcttgcgatatcgatataacgtctttcccatcaggaagctcataaagttttgcctcaattgtttcgggaacgatgaatttgctaaataaggtagagaacattttttctgcattatacctcagtttgtgttctttttcgctttcaaaatctttcctagtaggcatttcgttttcggcagtatcagacttggcggcatcaatgcttttattccttttttttgacccattggatttcttcacctgtttggatttgatatgaattcctttggcactatcggggctcctttttcgtttcctagggctttcctcatcaagaaagacatctgcatcattgtcatcatggtcatttacgggcttgtaaacatcatcatggtaatcttcatcctctgaaacctctgcctcctttgacgtttccaaatgtgcatacaatgatgggtcgcacaattcacagtagtacttagaatcttcactcattagcccatctatggtgtctttaccatcagtcatacatttaatatgctgccaagtgtcacagccatcgcactgtaccatgtcgccatgcgaatattctgcagcatcgtagttttcattgttcgccccacacagacatctaacatagccctcatccgcttcgtctacttcgtctgttcttacattttcagtatctttccttggctcctgagaagaatcagacttcttattcttctctatggctgaatcaactttctttttagttctttttttctttggtgcttcagtctcctcctgtaacaaatactcaatatatttattctgacccttattagatcttgaagaagtacggacagacataataaatttaaactaaataaaagctaaaagtaaaagagaacctaggataatcgatagctccctgtgtatagaacaagtcaaaatactaagatctcgtcaacctatcctctttcattgcaagccttttggccaaactgcagtctgggcatccctttgcatgtcttgtgaaatagtatccatctctccccagctcccagaaatgatatgaaaagttattcgtgaagagtgatcctaaaactgaaaaaaggaaaaaacaaaaatgagctaaaaaaaccacaacaaaagaatatcaacttcattgcttggcgggtcatcgcttttttatttctttctgtcaaagaataataaagtgcccatcagtgttcatatttgttacaaagtggttttctgatttggtactactgcagaggcgtattttttgcttcagttaccatagcgtaagaacactagcgacttttgttcgtgaaccaacagagtaggatttctactgctacatctcttaggtagttggttagtccgatcgctcacttttggttgttgttaagtacttcataagtttatccttttcctttttcacactgagctactttgggtatagcttttggcccaaggatctttgaattttctccaaaagtactttattttatatcctacaggttgcggttttcatattttaaaaagcttttaatcattcctttgcgtatggcaaaccctttttcgagatggtttctatcagagagacctccaaactgccatgtagccgatttagaaacaagtttagatccccatcaaacgttgttgaaggtgcaaaaatacaaacccgctttaagcgactgggtgcattacatcttcttgggatccatcatgctgtttgtgttcattactaatcccgcaccttggatcttcaagatccttttttattgtttcttgggcactttattcatcattccagctacgtcacagtttttcttcaatgccttgcccatcctaacatgggtggcgctgtatttcacttcatcgtactttccagatgaccgcaggcctcctattactgtcaaagtgttaccagcggtggaaacaattttatacggcgacaatttaagtgatattcttgcaacatcgacgaattcctttttggacattttagcatggttaccgtacggactatttcattttggggccccatttgtcgttgctgccatcttattcgtatttggtccaccaactgttttgcaaggttatgcttttgcatttggttatatgaacctgtttggtgttatcatgcaaaatgtctttccagccgctcccccatggtataaaattctctatggattgcaatcagccaactatgatatgcatggctcgcctggtggattagctagaattgataagctactcggtattaatatgtatactacagctttttcaaattcctccgtcattttcggtgcttttccttcactgcattccgggtgtgctactatggaagccctgtttttctgttattgttttccaaaattgaagcccttgtttattgcttatgtttgctggttatggtggtcaactatgtatctgacacaccattattttgtagaccttatggcaggttctgtgctgtcatacgttattttccagtacacaaagtacacacatttaccaattgtagatacatctcttttttgcagatggtcatacacttcaattgagaaatacgatatatcaaagagtgatccattggctgcagattcaaacgatatcgaaagtgtccctttgtccaacttggaacttgactttgatcttaatatgactgatgaacccagtgtaagcccttcgttatttgatggatctacttctgtttctcgttcgtccgccacgtctataacgtcactaggtgtaaagagggcttaatgagtattttatctgcaattacggatacggttggtcttatgtagatacatataaatatatatctttttctttctttttcttagtcaggattgtcgtttagcataatatacatgtagtttatttaatcacataccactgattatctttagaattttataaatttttgaaataaatgggtggcttttaatggtgtctatgttaagtgaggcttttagaatgctcttcctgctttgtttattatatgtgtatgaaagatatgtatgtatttacatgtgtttgtagcgtccccagtcaaaacctgtgcgctatacctaaatggattgataatcttcattcactaattctaaaatagacttcttccccaaagaacggtgtaacgatgaggctctatccagctgcttatctaaatcaactttaacgatggatgatcttatgacacggggatctttctttaaagttcttagaatttcagactgtaccgcagctgatgaatcaaacagcattaaaaagtgatatgctcgaaaatgtttttcctggtctttcttcattattttaggaagataccttatgcccatgggtacaatgtccctcaccacacctctgttttgaataatcagtttcccgattgtggaagacaattcttttgcttccaactttggcgcattggagttggttatgcgaacaagtccgatcagctcataaagcatcttagtgaaaagggtggttttgcgttattctttcctctgttgaagcttttctattttgtttaagctgaactagtgggagtttccattaaaaggctaaagtcttgttgaaacttttccgggttagatgataactgcgaaaagatagataaaatcagcattaaagggacttcgtctcctcctaatcagaaatcatcctttcgaattatgcgtattcagttgaagcgtatttgtgaccagtgtacttcaaggctgattgtttcacccttggacacagaacgttaaacaatgagtttgtttgagtgggtatttggaaagaatgtcactccgcaagagaggttaaaaaaagtatgttgttctgtatttggatcagttattttagtgaacatactaacgttaattatttgagtttttagaatcaaagggctttagaaaggactcagagggagcttgaaagagaaaagagaaaattggaactacaagataaaaaacttgtatcagaaattaaaaaatcggcaaagaatgggcaagttgcagctgcgaaagttcaagcaaaagatttagtaagaacccggaattacatccaaaaatttgacaacatgaaagctcaacttcaggcgatatcattgagaatacaggccgttcgaagtagtgaccaaatgacacgttctatgagcgaggccactggtcttttggctggaatgaacagaacaatgaatctacctcagttgcaaaggatatcgatggagtttgaaaagcagagtgatttgatgggtcaacgacaggaattcatggacgaagctattgataacgtcatgggtgatgaggtggatgaagacgaagaagctgacgaaattgtaaataaagttcttgatgagattggagtggatttgaattcacagttgcaaagcacgcctcaaaatctggtttctaatgcgccgatcgcagaaacagcgatggggattcctgaacctattggcgccggatcagaatttcacggtaatcctgacgatgacttgcaagctcggttgaacactttgaagaagcagacttgagcgctctgagtatatttaatgaataataggtctatactataatacatcaactactgatatcaaagtaggcacttagaatcaaaaggcttccgaaaatttgttcagtttttcactttactcaatctcgtcactaaagttttctttttttttcgaatgaatcctcgaataaatatgttctatattatatatatacatcttttatatatcattaaatgtacagtaatcggtcaaattacaaatgcttacggatgattttttcactgattaagtactcataaataatggtagcacattcttcaaccgtcttctggtcggttctcaaatgtagctctggagcttttggcgcttcatatggggcagaaatacctgtaaactccttgattacaccctccctagctttcttgtataaacccttagggtccctttgctcagcgacttctaatggaacatcaacaaatatttcaatgaacttcaaaccagcctccttatgtagttcacgagctctatctctgtcaactctgtatggagagataaatgaggtgattgaaatagcacatgaatcagcaaatagcttagaaacttcgctaattctacgaatgttttcatttctgtccttttctgagaaacccaaatccttgttcaatccaaaacgaatgttgtcaccatccaatctatatgcagacaagtttttttggagcagtaactgttctagcgcacaggcgattgtacttttacctgacgcacttagacctgttaaccaaatagtacaaccgtcctgttttctcaatgccttgcgttcgtcgtaagtaagatttggatgccaagtaatattagtagccattggtgtacagtgtgcttggagaaataattccaacttttcttgatgtcaagttcgaacaaagagagaaaatgaacgacattaacggatacgcaactgatgttgtatagaaattttgcatcttatatagatattttgacaaattcatgaagttgaagtcatattgagtcgttcatcctcttctccattgccacattttttgaggtggcttgtaaatatattgatcacgtgaaattagtggcacggtcttttattcctggaaaagcgtgcagctatttttcgagaataatgtaaggtaccgtgggtgccgtaccatcacgccgaaatgaaagcaactgtattctttaatgttacgcattcttggttgttggcttatttacatttctcgcgagctggtgatgagccaaatgtcgtagtggaatgattctagaagtgcagagttatctgctacattgccaaggcgtcgtaaccgggagggctcacaaaggcgcttgctctaaacatgcatagggaaatttgaaaatgattgttatgagtaaacctgttaatgctcctttaaacgtaatcttatttcaccaattttaaaaaaagaaattggtaattaacctcacctaacttctgtaatcacttgtcaacgctatttacaattttgctttgatttatacagaggaagcagtttactctcctttctatgtgtatttgattattttaattaccaagaaaacaaattctcgtaacattcttattttatacgttcggaaatcatgaacatttatttttatgattatgtaattaaaaaaatataataaatttattttgaaaattaatttttttaaaattttaaatatgtttttatcatgtgacttatgaaaatgatatttacggttcaagagaaagataaatgcagaatcaatcaatacaatgaatagtaccttatttagtattggaccattgaggtattaggtattagtagaaatatcctaaacactagtattgacaaaagaataatattatatgctatcaattatcattcccatcctcatgttgaccttcttcatattggacaaaagatactaggatcgtaatgcgagataggaaattcttcaaaagcataatttatagactagcttccacgtatacaagaacaatatataagatttgcagtaaatattagggagaaatactcaaaaccaagcttgagtcgaccggtatagatgaggaaaacctaaacagaggagacgatttgactagcgtttctcaatatctcgaccatcttcttacattcttttcttctttgaatggttatgtcgttttctttcgttaattcttcaatatcttgctttccgtaaagtttttcgagtaaaactttctgaatatcagttttacttttcacaatcaatttaagcatcaaagcctttggtataatatcggcaatggttcttttgacaatagagaaataactactaatcaacaacttgattacttctgtttccattgtttccctctctgtcatttggccagtagcttttaaaacaggaggtggggattccaaagctgccaatttcttcttgtttttagtggagaagaacccaccaaaaaatcctgatttctcttccataactggcgccttactagacgatggttgggttggtaatggtttacccgtctttgggtcaacagcgacttggcgaggatgtaatttttcttccaccataaccattgcttgagaacccttcaaaaggtcgggatgggctgtattgatgtaagtttgttcagctttgatgatatcgacaacaaactcattcgtaggaatagtagcatcctttaagaactgaatgaactgattagaaatcgcttctcttagagcaggataccttgagtactttggttgtgaaataatctgttttagcatacgaacaagttcatcaaacaccagagtaactaaacgtagagatggttcttcaaatcttctaatttgctgtttaactaaaacttcaaaagcttcggtaccgacaaacaaagatggggcagaacctgaactattgtacataatggttctgatatcagaatctttgatctggtcgaatggatccaaagagtctacaccatttttgaaagtttcatggaatacgtaagaaattctagcaccaccagaaagttcctgactggaaagctccttcgcctcaccgtccaagataccggcatattcattggaaaaatcagtaatcatgctcaaaacaaccgaactagctgaatccatagtttctgggcccaagtttataagttcgttttgatattttttcaatgtggcttcgattttcgctttgatttctggcagagtttgcctaatgtggtgtaataagattgagtttaactttttagccaaatatggtgtaccacagtaatgagctttagaactgtaagagggatggttctcaaaaaattttctttcgttttcaagggcttctctgattgtttttttgtgttcaatatccttttgacctctattgataactgggatataaccatatctcaaaggaatgactcttccagccaaaatatctatgacatctgtaccttgatccatcaaatcgacttttgtcaagacaccaatagttctcgttccttctggatcgacctctctagccagcttcaaaccatcgctgttggctaaatcggtgttagcggcattaacagataatatgatagcgtttggtttcgaaatatactttaacaacatgtccttaatttgtctttcaatatcaggaggttggtcacctacgggaaccttcgtcaacccaggcaaatccactaacgtcaaagtaagaacatgcggagaataaattctcaagttaatgggcacagaagaaatacctgaattggcacctgtcactttgtcagtttctttgacgatttcctttctaatttcgtcaaaattataaaacttcttaccaggtaaatgcaaaaattcaccccattcctctttattgtcttcagattgtccctcgttctggtgctttcctgattcatcctttttcttgtcatcatcgttgatgttcaagtcaatcaattcattagcagtttggtttactttagcatgttctgacttttttggtctcctattaatcaattgtaacactaaaggtctcctggtgacaataccagtacctcttggcaagaaatccctaccaacaatgttctccaaaacggacgactttcctgacgactgggaaccgacaacagtgatctgtggtaaatcaataggagattgagatcctcctcctaagggcgccaaagcgtcctgaagcttgttaatagtagaaattaaatgctcatccatgatatctgataatataaaatgtgcagttttcgtacggtccttattttggtgctataaaaggcctctctaattcttttttaggagtaaatagatgaattatctcggtctgtcttggaagatatgttgttctcttgatggcaaagcgacgcgaatcaacggcgcccaagtctttgggtgacccggccacttaataatgtttggggaagaaatcaatccattagaacattggttttggaaactaggccagtccaagcgcacaagtggtttaccctcgagcatttttcgactattagaggattcaagtatctatcgaattctctgaagctatcatactatcctctggacgatattagaacgatttttcaagtgaaacgttttagcaaaagtttaaagacactaaactagctaaataatttcactgtgagcaagtctttaaacggtcttttttgaatcaaaagaggcctagaattagcaaaatatttaacgcataaactttttttagacaaataatgagctctcaaaaggtttttggtattactggacctgtttccaccgtgggcgccacagcagcagaaaataaattaaatgatagtttaatccaagaactgaaaaaggaaggatcgttcgaaacagagcaagaaactgccaatagggtacaagtgttgaaaatattgcaggaattggcacaaagatttgtttatgaagtatcgaagaagaaaaatatgtcagacgggatggcaagggatgctggtgggaagatttttacgtatgggtcctatagactaggagtccatgggcctggtagtgatatcgatactttggtagttgttccaaaacatgtaactcgggaagatttttttacggtatttgattcactactgagagagaggaaggaactggatgaaattgcacctgtacctgatgcgtttgtcccgattatcaagataaagttcagtggtatttctatcgatttaatctgtgcacgtctagaccaacctcaagtgcctttatccttgactttatcagataaaaatctactgcgaaatctagacgagaaggacttgagagctttgaatggtaccagagtaacagatgagatattagaactggtaccaaagccgaatgttttcagaatcgctttaagagctattaagctatgggcccaaagaagggctgtttatgctaatatttttggttttcctggtggtgtggcttgggccatgctagtggctagaatttgtcaactataccctaacgcctgtagcgcagttatattgaacagatttttcatcattttgtcggaatggaattggccacaacctgttatcttgaaaccaattgaggatggcccgttacaagttcgtgtatggaatccaaagatatatgcccaagacaggtctcatagaatgcccgtcattacaccagcttatccatcaatgtgtgctacccataacatcacggaatctactaaaaaagtcattttacaggaattcgtaagaggcgttcaaattacgaatgatattttttccaataagaagtcctgggccaatttattcgaaaaaaacgattttttctttcgatacaagttctatttagaaattactgcatatacaaggggcagtgacgagcagcatttaaaatggagtggtcttgttgaaagtaaggtaaggcttctagttatgaaactggaggtgttagctggaataaaaattgcacatcctttcaccaaaccctttgaaagtagttattgttgtccaaccgaggatgactatgaaatgattcaagacaaatacggtagtcataaaactgagacagcactgaacgcccttaaactggtaacagatgaaaataaagaggaagaaagtattaaagatgcaccaaaggcatatttaagcaccatgtacataggccttgactttaatattgaaaacaaaaaggaaaaagttgacattcacattccctgcactgaatttgtgaatttatgtcgaagtttcaatgaggattatggtgaccacaaagtattcaatctagccctccgcttcgtaaagggttacgatttgccagatgaagttttcgatgaaaatgaaaagagaccatcaaagaagagtaaaaggaagaatttagatgctagacatgaaaccgtgaagagatctaaatcagatgctgcttcaggtgacaacatcaatggcacaaccgcagctgttgacgtaaactaagacattcctatttatagttgaatagtttattaatataggttaatcagtcataaacaaatttgtacccttttttttgaatcaaagtactttttttacgaagcagtaaaacgtttacgagattctctctacatatgctctttcgcgtgtagcgacattttaccattaggtgagaattttgtgttacaagctggatgtcaggatgatacctttgaaggcatagttaaattggctgggaaaggaacggaaccttttcctttccgagtttcggccagatatttaggcttttttttttctgacggaataggggacccaggattgacaaatataacaaaacaagcttcaacgagacgtttatctcgagaattacgtctgacagttacatgaagtgtgagttcatgcaatctgtacctttattgacacagatatactaaaagaagttacaatgggctccaaaaaactgaccgtaggatctgattcgcaccggttgagcaaatccagtttttcaagtaataagtcgtcacattcagcaacaaaagatcagccaattgataccgacgatattgatgaagacgatgaatctggtcataatattatcttgaacatcatctcacaattgagaccaggctgcgatttgaccaggatcaccttgcctacttttattttagaaaaaaaatcgatgcttgaacgtgtcacaaatcagttacaattccctgagtttttgttacaggcgcattcagaaaaggaccccttgaaaagatttttgtacgtaatgaaatggtatttggcaggctggcatattgctccaaaggctgtaaaaaaaccattgaacccagtccttggtgaatattttacagcttattgggatctaccaaacaagcagcaggcatattatatatctgaacagacaagtcaccatcctccagaatgtgcatatttttacatgattcctgaatcttcgattagagtggatggggtcgttattcctaaatctagatttttaggtaattcaagtgcggccatgatggatggatcaacagtcttgcaatttctggacataaaggatggaaacggaaagcccgaaaagtatgttcttacacaaccaaatgtatatgtaagaggaattctttttggaaaaatgagaatcgaacttggagatcatatgataattaaatctcctaacttccaagctgatatagagttcaagacaaagggatatgtttttggaacttacgatgcaatcgaagggactgtaaaggattatgatggcaatgcgtattacgaaatatctggtaaatggaatgacgttatgtatttaaaggacttaaagcaacctcgttcttcaccaaaagttttccttgatactcataaagagtcaccattgagaccaaaagttcggccattgagcgagcaaggtgaatatgaatccagaaaactgtggaaaaaggttacagatgcgttggccgttcgcaatcatcctgttgcgacagaagaaaaatttcagattgaagatcaccaaagacagttagccaaaaaacgcattgaagatggcgtagaatttcatccaaagttgtttagaagatcaaagcctggcgaagatcttgactattgtatttataaaaatatccctgtcgacgaggaccctgagaagcaaatacgaagcatattgcaaatagcacctattttacctggtcaacaatttaccgacaaatttttcatccccgcatttgagaaaataaaatcacaaaagaagatgattgaaaacgaaaagcagaacccagcaaaacaatagtgtatatgttggatatgatatttgttgtaaattatagattagtttttttatatgtttttcttttttttgttctaactatctgattgttctttcttatttttatccaaaaacttatttaagaaaagctttttatagccaaaatgtgcaaaattcacagaagttagaagatcgtttgaaaatttctcaggtactattggagtattatttatcattttgatatgaccactgttctcttcaaaattcagaatttcatttctccaagtcaataagacagagtccatttcaattctaagggtgatattaaatttcgtaatttgcagaagacacagatatggaggccaatctgcagcatacgttcgatcaatccattttactaattcctgagtaaatgcatccgcaggctgtacttgaaaattcaaatccactttatttatcttgaacggaacattaaaagagcttgttagtctttgaaaatcacgtatattatcggtttttttttcctcctgctggcataccatatatgctaatgcgctccatgaggaacaatccttaacattttgaaagcaaaatctcttagtcaaattgaagagctcaattcttttattgtaaggtaaattatcgtagaaccacctagcagtattccaacagtagtaattagagaaatgttgggatccagaagaatgaaatacaaataaaatatctggaagaaccagtgtattagcatcaagagataaaacgaatagttttcggtataatatccaaagagatgacgacttgttgatacgattgtttgatgaacaaagaagccgttgaatcagtcttacttctttgaccaataaatccggtattactaaaacactgttgtcctggaagtatctcttgagtaaatcttcgtgtacattatataccgttttgttttcaggtgttgtaagtagaaatccaacagtcatgtaataaatattctcattagaaatgccgcctaatttacatcaatatgtagaattgttagtagccgtaacaatgaatccaaaatgcgtattgtaaaatagcaatagttttttgtattttaccgttgagacatactttgatcagagaaagttttgttaaaatatgtatgtgcttcttggaaaagagataaaaatgttgttttgaagataattagttctatggaatgggctttttcgtctacgtagtaagggagagtaattgaaggctgattggcagtaatggttaacctgaaatcatgataatctaaatatgcagttattttttcaaaaaattctctgcaaaggggaagagaagattgcataacttcaacaattgttttgagcgtttccttttagcatttttttgtttggcttttgtttgttcttttgtgtacttttcatgtatttgatcttccatgtgcaaaaataagtgaaaaagagctgaactaaatgtagtattaaaatcaagaacaaaacataaaaaggaaaggagaaaatggaacaattgcttagtcaaataatgtgaagttataaaactgccggaagcctataaaaaatattttctttactgagaccgtgatcaggagaacgaatgtgtattaatagctgtatatatcttataaagacgaagcctatttactatcaacgctatgtaagtttgtactattatccttgtgaaacaaataattggaggacagtcaatagcatcatctaacatcgtgaaacgaatcagtgattgaaaggaattaaatgagcaacgtgcataaataatatcggtaaagaaaaaagagcgcaatggtttcatgactattctacaccaagttgttgcgccattttatctaagctgatccccttttctggtatgcttacaggaagagaatagaaatactcttcgtcaaattcaacttcgtcatctgaccaatcgttatcatcatctgagtcatcgatactatgatctctaaaagatacccgcgaccggtaagaaaaccccaacatcatcaatgtagtaattgatactgtgatggcagtgaatatgaaaatccttttgtctaattgagatgccgccgatatgaattcaccagaatctagttctggtaagtgcggcacttgcgaaaaggttgtagagaacagtgtggcctgctcattagcagcgcctggatcagaaatcttatctcttcttactactgttggtgtacctccttcatctggtgaagcgagctcaccattagcgctaaagagaccaaaatttattcccgcttttttattcaatccatccggattaagtactgctactaacgacttcgttgcgatagcatttgttgtcgtagtagtcgtgatactcaaaaacgtcgaagttgcggtacttgttacgattttagttcttggaaaccatcttcttttggcttttgtcgacgtgattaaagtcgtccctgtttcagtatcagtcttggtcctgtaaaacctgttcactgtggttattattttaggactttggtattcattcactaagtaacgagtaaaaattttctttggcctccaagaactccaccttgtcatatgaatttcggtggcagtgtgaaataatggggccttcgtatttcgttcttttttactgccacttttatcatcggtatccttactacagttttcagaactaactttcttgttctcatggtattcgattttaccttcccacttcttatctttcacactacagtcaccgtcgttttcttcttcataaccagtagctggagacagagttttaccacttatcgttctttcgcgcaaatattgaacttcattattagcgtcaaccacttcgaacatgtcaactgatgatatagtcttttgattattggttaaagaggttaatagtgcagaaattaattggtttttttcgaactgcaaagggttcctaaaaagagtattgttttgaccaacgaaataagacaattttctactagaaaatttgttgcctctaggtttcaaaatctctccgtcatctaaaactccatttgtcaattgaaattgttcaacaacgatctgcaacttgtcatactcatctttggaggtacagtaatcgtgaaagcagctattattaagggaactcaaggcacactgtaaacatttgcagttatccaagtcctccattgtttcattattcacagtaacgcatgaccgacaaaatgcatattgttcatcaaaataacgggacacgcattcacttaaatttcgtttcttcacatggatcttgtcagtaataaaatctagagaatattagtacctcggtaaatttgttgtacatacgcaactggagaggaagggggaaatcagttgtgaattgtaacctggacataagttaggatctgccacagttttgctttgaaccgctgcgagaacgctcccaccaccaccggcaaagagaaccagcagagcgcttagacattccaacattatcagtatatctcgtgtgttcctgcctcttgatgattttagctagctgtaatgtgtaacgaattattcccttactgcttcttgagttagccgccaaagaggaaatatagccacaaaaagaacttacagaaaagataaggtaaaaaaaaaaagtgatctataatgggaaagaaaaatccaaacttcttcaaagagtatatatatgtacaggatattaaaatgtaatgatagtagtaataatagtattaacataagctaagcggatcttgctgtttccaaagcttttcttgttgcatcatcctctaacttttgaatttctttcataatagtatcatatttacttttttgctctttagaagtaacatcgttaacaacatatatgtttggtgacgcgtaattatcagaaaatgggtggatagcatttggctcagcttctttataagcgagtttaggatcgttggcagatggcaaaattttttccttaatataccttttaaactgcaagggtgtgcttaaagtggtcagttcataatcaggaattagatagccagatttagattgcaaaaatttggtgaactgaaatttagctaccaaatcagagaattggacgtcctggtctactttgcccaatgttttttccgttgcctgcaatatcatatcatctaactgattatcagacgtaatcttatccctggataaccactgattgaatggcgcagaggagaccgcaagcttcaactccttctgtctcttacaccgtctagacccttcgccaataaaattttctggtattagctccaatctgtttttgttattggaagaggattgagaggaagcctcgttagtgccttcttcaatatcctttatcaactgtttggtgtccttgacaggctcttggtgctcttcttgcttcttcctcttgaaccatgacataaagtccccgtttgcagcggaactgtgaatacatctggctttctgcttgtagccagagagccagaccgacctttgcggcaatggtctaatacaatgtaatttaagcagtgacgacatcctcatactatgtccgcctttccgtctacccattattcacttcaggactgatgatcaggcatgcagttaatttgacagaagtcgttgtttcactataaatttgtcagctacccgcctcaccagcagcgataaagaacgaagaataaaagagagcattcacagagtacgaatccagtatagcggtagtggatacaacgacagatttaagtcgtaaaaatgggagccgtactcagctgttgtagaaaccattccggcgaagagaatgaagctttgctgagggaacagcaggcaggctatggaagtcaaggaaacgcaaatgacgaatacgatgccgaacaaatgcggttgaaggaacacgaacacgaacagaaactgctggccagggaacaagagttaagagacattgttgcaaacaccaacgataaactaatagacatatcgatgataaacaatagtggcattgtaattcaagggacagacctgcaagaagctcttgataaaagacaacaggaagaaggtggagattcccgggaagacgaaaggagtgcaggtgatgacaacctcagtgggcactcagtgccttcaagcggatccgcacaggcaactactcaccaaactgcaccaaggactaatacgtttactctgcttacatcaccggattcagcgaaaatatcaaaggaacagttaaagaagttgcactctaatatactaaatgaaattttcagccagtcccaggtaaacaaaccaggccccttgacggttcccttttaatgaactttttgtataacatcattggtatacaagctttataaataaatgttaaatagttaatgaaataaaaaatcacatttgacgaattcggaagacaagtagcccaagaaaaaaaacaacaaaagcatgctagaggatgatgtttaaaacgaccctcagcctgttattacaatagagagcaaaccaaagaataatagataaagtacacagatatggtagttaagaagcgtaagttggcaactgaggccggtggcagtgatgaaaggcctaaatacttgccgggaaaacatcctaaaaaccaagagaaaactccgcatgtggattataacgccccattaaaccctaaatctgaactttttctagatgactggcatatacctaaatttaatcgatttattagtttcactttggatgttcttatcgacaaatacaaagatattttcaaagatttcatcaaactaccaagtaggaagtttcatccacagtattattacaagatccagcagccaatgtctattaatgaaatcaagtcaagagattatgaatacgaagatggtccaagtaattttcttttggatgttgagctactgacaaagaattgtcaagcttacaatgaatatgacagtttgattgtaaaaaactccatgcaagtagtaatgttgattgaatttgaagtattgaaggcaaaaaatttgaaaagaaattacttaattaacagcgaggtcaaagccaaattactgcactatcttaataagctagttgacgccacggaaaagaaaatcaaccaggctctgctgggtgcgtcatctcctaaaaacttagacgacaaagtcaagctaagtgaaccgtttatggaattagtcgataaagatgaacttcctgaatattatgaaatagtgcatagccccatggctttatcgatcgtaaagcagaacctcgaaattggtcagtattccaagatatatgatttcatcattgatatgcttttagtttttcagaatgctcatatattcaatgatccaagcgctttgatttacaaagacgcaacaactttaacaaattattttaactacttaatacaaaaggaattcttcccagagttacaggatttaaatgaacgtggcgaaattaatttagaatttgacaaattcgaattcgaaaactacttagctattggtggtggtggtccagccgcagcaggtgcgttagctatatctgctcttgataatgatattgagccagaatctaaccgtgaagatcttattgatcaagcagattatgatttcaatcatttcgaaggtctcggcaatggttataatcgttctctcctaactgaagattatttactgaacccaaacaacttcaaaaagttaatagccataccggaaacagtgcaatccgaagtcaaaaatgaaagatcaacgacatctgatattgagaagacaaactccttagagagcgaacatttaaaaatccccaaatacaatgttataaaatccatgcaaaaagaaatgcaatcactctcagagcaacacaccatggagtataagccctataaattaatacaacaaatttacattttttcttctaaaaatttgtattcgcaggcaactaagcctttactgggttcaaggccatcatgcaatcaaaattgggtagagtatattttcaatggtaatgaattgagtcaaaatgaaaacgctttctccttcatgttacaacccatgcaaacttttttaacattacagtctcatttgacctcatcattaaaggatacagagactttattaaccattaataaagagccagtgaagtctagaacttcaaatgtaaacagtaacctttcccaacctcagcaacaagaaaatgatgttattggaaacgatacgaagcaagatatagaaaatttgacaatcggcggcggcaacaataacgatattgttggtaacgataatgataaacgtaataatataaccgaaatctttgatattcgcttatcagaaggtttaaatcatttgatgtttaggtgtgaggacaaaatatctcatgaaacggaattcatgaatttctggataaatgtcttaccatgatgactatctctctcttcatagtcttcccatcatatgcatgtatctatatacaacctatatacactttgtaatattatccatcctcttcctctatatagattaaaactgttaatattacacatgacaaaaaagttgcgtccgtaaagaaaaagtacttaaaatgggtaggttagttatgtagggaaagatgtatgtaaggatatggcttaacaaagctgttaaatgaaaagaatataatcgctattttttatattattcaaatctttttttgtattatagtttagattttgcctgcgatagttttacagcggcgttatccaatacaatgacgtttctggtcgtatcaattgtttgaaaaacgacaaccgagccttgcttccaagctttaacctttagagtatcacctgggaaaacaacattggtaaatctcactttcaactcctcatatggaccataatgttcaaacaatgctttcgcactaatacctaatgtacaaagcccatgcagaattggcgtaggaaatttaactgctttggctagcgtgggatcgatatgtaaaggattgaaatcgccagataacctgtacaatgcggcttgatctttattcgtagaaatctccgcctcaaaatctggtacctttccatgtggcacttcaaaattttggacagcaaacttggctcttttcccatccctcacttccttttctggaggtacatgtgcgcccctgatgaagaacgatccttcgttataagctatgagtttcttagttttaatgtcataagtttcgaagccaccaacaactaaagcggctttaccattcttgtcaagtacttgtaaaggtttagcaagtgtctttagagttccattacttggcattgtcggcgtgcagagcttaaaatattgttctccatgcagtaacattgcataattgaagttatcgactaaattgtccatagctagtgtggcagtagcttgcataaatggaatgacggcgaacgtgggcaaaacttggaagtctggatcattctcgtaggtgtacttaagctctttgcttgtgcatccaagtcctaaattgtacaagatacaatccttggtagtgtacttgaataatccatcatccaactcctttgaagagtgcgctttttgcacggcttgcaaggttgccatagaagactcctctgtggagctcgggttgatagtgttgcgactgaaatcagtgatgtggttccaattttctttaatttcttccggttcaatagtctctttaatagaaacataaccggaacttctttgccatctggtttgcccacaccaaccaccgccaacttcgaataattggccaataacccttcttccagaatacttttgtagttcttcagatgccaacaaaacaacaagtggggagacttgagatgcatcaaagtggtttgataattccttctccgagaatatagtctttgtcatagccgtttctgcatgaggagcgataacattaacaataattcctctcttggcaccttccagtgcaatagttttactgaatcctaaaatggcggcttttgcagcggcataattggcctgtccaaaattaccataaattcctgaggtagaagtagtattgataataaatccagacttttgtttggtaaatattggccatactgcttttgacaatgaaaatgtggaaaaaaggtggactttcaggacagcaaaccattcctcatctttcatttttaaaaaagatttgtcacgcaaaataccagcgttattgaccaagatgtctactctctgaaacttacttattgcagtttggataatgagaggagcttcggtgaccacatcatgggaatctggaatggctgtgccttcaccatatagtttatttatttcttcaacaactgaaaaaggatccttgatgtcatttacaactaccttcgcaccgtaccgtgcaaaccagattgcatgagacttcccaagaccacctcctgcacccgtaactactacgactttgttgcaaagcgacttgattttcactgagccttgttcattgggaggtaatttttttgctttggtgattaaatcattataatccgagagttgatatggatgctgagttttgttaaatggcttgtccctatagtctgtgatttccttccacttatttaaaattgcttcaggagtatatgtcttggggtctggattgaaaatttgtccagaagacctctcccatctgagctgtccaaagaatccagcagcgagttcaaaaatggagtttgacactttcgtactttcgtgtgtcaaatagagtactaagggaacaattttttccggtcctaactgtttcaagatatgtggtggtaacacgttttctgtcatacgtgatctagccaatggcgcaattgaattaacattaatgttgtatttggcaccctccttcgcgagggtttccgccaaaccaactaagcccattttagctgctgaataattagcttgaccaaaatttccaaatagaccggcaggggaagcggtgttaatgattctaccaaatttctgagagcgcatataaggccaagcagcacgcgatagcttatagccacctgtcaaatgaacatctaccacagatgcaaactcacgttctgtcatctttgcaaatgaaacatcccttaatattccagcgttgttaattagtacatcaaccctgccgaattcttttatagccgtttcaattattttctctccattttcattaacagagtcgtaatttgccacagctatacctccggctttttttatctcatccaccactaagtctgcagctttggagttatgtcctgaaccacccaaagtgccacctagatcattgacgaccacttttgcacctctgcttgcgtaagctagtgcatacaccttacctaagccccctccagcgcccgtgattacaacaactctatctttgaaggataaatttccaggcatggcttactcaaataagaaataaatcgaatgtttgtttagcttcgtatatgtgtaccttgcttaataaattagctgataagtccttctacctttcaacactgggagtaaagcagccagaaacgacttcttatataatttctttacttgtcttccttgtttttttaccccatcctcctttgctttcttgctgatgttgatccccgttggagtaaaaattggcaaataaccgccgagagttctagtacggatacggcgttaacaaatttccccgtcgatcactttcggacttaaaactaggcttccggaaccacacaagattaagaaattaaggcttacaacaagacttgagagaagtgatcgaatattaggatactctttttgtttatgtaaacaattaccgtaacagactcgggagaatcagaagggaagctgcctctagatatcaaaatgaacgaagtaaaaatatcgaagcataaacaaaacgataaaaactttagaaactattgattctcttccagccttgccttagctcaagttcctgaatattcttgttttttatcgctacgtactcaatttttaatgcaccataactactcaacataacgggttagtgaaatctactgtgctgctagaatagtatcacgtacagtagtttaattgatagcgtaaattgaaaaatcagctaaataaattgtcatcaattttacaatagcagaaatgtagcgattaataattcaataggaaatgaaagggactttaaattcagaaataggtgaatttatgatgattgttgggatttcttactagtaatttgaatagtagtcacatgatcgttgattattattccaatacaaattttgtgtaaagtcactctttccccttctgaatggtgcattcgtgaaagaattttcgatattgttgtattgtaaactaggaatcaaaggtatcgttctataatgagagaagtattaaaggcacgcactgatcgattgtatcagatatgactatagctttagtgtttagagtcatctcttcatacatataaatgttgcaataaaaatcaactaatatctatgtcgtcatattgagaaatgggtgaatgttgagataattgttgggattccattgttgataaaggctataatattaggtatacagaatatactagaagttctcctctccggtctaggaatccccaaaatggaatctatatttctacatactaatattacgattattcctcattccgttttatatgtttcattatcctattacattatcaatccttgcacttcagcttcctctaacttcgatgacagcttctcataacttatgtcatcatcttaacaccgtatatgataatatattgataatataactattagttgatagacgatagtggatttttattccaacacatataaagtttagaaagatgacataaagattaacttaatacatgactgggtatacttgaattctaaaattttcaacaaataagtggttgtttggccgagcggtctaaggcgcctgattcaagaaatatcttgaccgcagttaactgtgggaatactcaggtatcgtaagatgcaagagttcgaatctcttagcaaccatattttatatttttttatattgtgttcaacaatgaacaataatgacgaataatccagaatgatataaacgtccatgaataaaagtccgttataatcatatataattgatgcataccgtacgctattagttctcttttgttggttgcttttgaagatttaattatgatatcattaaccagtctaaaaaattactacaattcgccaagaatatttaagatatggttgagagatcccaacataattactgacagacttactggtcgtcttcatcactttcaacatatttaggtgtttggtacttctttgtatttatttcattgtcatccacatccagcattggttttccattagaatttccagctggtccatgacttgttttgaaattaatttttttaacttgcacgttcctcgaatcagaatcatcatccgaatcatctgaggaagagctatccaatgaagattcaagtgacatggaagaagaagaagaaggtgaagaatgcgacctggtaaccttgactttcttgagctgcggtgttctttctaaactggacggtatcgcttggccattttttctttttccaggagttgaattcataactggcaacttgggtgagacttgttcttgttcctgagccgtactattagaagttgcctccactttgtctttactattatcaacaggatctctcattaatttgactacttttatggtcgaagctgcatttggcggtttcccagcattggcaaaaatatcttttagggatctattccccatatttctttttcttttaaactctataactttcgatccaacatcatcagtttttcgtttcacttttattttaccaaattttgcgaatttctcaccggaaataatggtattgggatcatcaaagtgctttgtttccagacttaccccttttgaagttatggatttgggtttatctttcttcattattccaaattttccgtaatatggttccgtaatactattccttttttggaccttagtttccccagttggcttgaacctatttagtttccgaatagtttcttgtatttttacgtcttttgcatgcgaagtagatgacgcagcacccaatgatttatcaggaaactccttctcaacaagtcgaaatagggcttccttaccttgactttgatgtaaccgattattcaattctttttcaggaaaaaagggaggagaaacaacatttttggtactttgagtactttgtactgcattttcaatatcactgttgaatgaaacgctatccaagtcggaattgatatcccgaaatcccatcgatgccttcttagaattgttgataaacgaatccgcacgatcattatcggtttcattaaaatcctcttcatctgaaaatgcttctatccttctacaattctcacctatatctttgtcgttcaatggcagatcatcaccttttttgttttgaactttaatttctaaggaactcttcctgggactatgagcaccactagaggggttagaatattgtatatgcatatcagaattagtatgagaagtagtgctcaattggaagtcggtatcaatcgaatcaaacgaaatttgaggggagttttcatctgcgggttcataatcagcatcttctgacgaattgcgtaaaagatctaaatcctttgattcggcccttttagcgccatcatttttctgttgttgagtggatgaaggtatattttctttattgttatcactcccttgcgttacaactccctctttagcacgagcgtgatcttttacgtctttgtgtacatttgatgccactactgtggaagtaagtggcatgggacacttttctttattcagtgcatcatacttgcttgcaagcggtagaatttcgttcattagcggcgttgatactcttgatttattaatgaagttattcttgagcgagcttttagctattagatgcattgtatctttatttgatatagaagataagtcttccttagagatcttttttctcttttcagtaacgatggattttgtggatggcttgttgtcctgccgtctccgctgtcttgccaattgtaaaagtgaaatatgttgatttctactccagtctaattcatcttttaaaattaccaaaaccacaccatcattttcaaatacgtcttttattataaattcagagtccaaatcacaaccatgcctatcttgtagagatacgatttcaatggattctttgaaatttggataaagtctatcaaatttagttaaaatttcattagatagttgtaaaagggtattgtcaccgtccgtaaaatgtaaaaactttttacaattcgggaggtagttaatgaaatcactactacgattcgactgaatagaattttgcgaagacgggctcgtaggagaggggtcgctacagttattgatactgttgttgtgcgtaattatatcttcattatactggaccataggagacactgattgtggagtattcaagcgtgcttcgagaaatgtgataatatcttgagcacttggcggcaccagtacaatctgtaacctccacatttttatcatttacttatttgaaccaaacaccaaggagggcaaaggatattataagaaatgtggcaaaagattggcgtatttattgaatgcttgtataattgggtagctaaccaaaaatgacttgttttccttcttcagcgaaactaataaataaacaaacaaacaaattaggaccatcttgcatttgagatctgaagaatatgaaaaaaattatataacagtatcgtataatgcgactttttttcgtgatgcctatgtaacaatagtagagaaaaaacaggtcacatttctataaatgattgaataattggttctatatacgtacatacttttggagttttacttttattctcttgatttaatggatgtagatgctataaaaagacatgttttcccggaaatagttaaaatgatattttgccatttttatgcggatgatggctattaggagggtttttagtgattttttttttttccacaagctgaaattttcgaggtctttgtctcgaccaggctctcaagtcaaaagtttcatagtcttcggccatcaatttaaaatagctttcaaaatttgacttgatcagatcgtttgtagcacttgaatgcatgaaattcacgtttggtttagactcaggacctttatagatgtagtctgtcgagacagcctcatcatcggtactcaaagatgaaggagacagcgaatttaccggagaaaaatgtcttgattcgctttccagagatgcggaaggctcattgtttgagcacgatgccaaactattttccttaagattttgttcctggatgttatactttttcttcatcgagttatgataattttttaaagttgttgtcaaaagtcgcttattcgataaaactttggtctttatgatagcaatagaaacaatatttttgaagttatcgaaaacctccatgttgaactgttcctgttttttcttttgtttggcaatgctttgacatattttatcatattgagaccaaaattgttcaacgtttagttttgagagatctctattcattttttctagacaattttgtaaccaggcccgtttatcataatttttaaatcgttgatcattctggaaaacctccttccaggaagtgttcttaaccacgttagcgtcgttatccacgtacaacaaggcagacaacttatttaattgccaacgaccatcagatttccaaatgaaaaaggtgtcacttatttcttcatattcgagaatgtagaaatggggaatacaattcggcttcaaatatgcgggtgcacaatctatcttcaaattttctgttatggtctcagaagtttgcaactcaatcccgtacaattcttgaatagaatgcacgaacttgataacctgagttaaagtgagaccttccttaatacaggtcaatttaacacgtggttgttcttcaccagcgtataagtaaacggtttctaacttggacatggtttcctttctttgtacttggtatttcttcttctttttctagctgtctgtatgagtacttaactgtaacagaatagtaatgggttcaggctaaatctctttaattatggcacctttatgctgatataaatccctatacatttcttaggggtgtgttttggtttttggtctcatagttttgacagcacgttggaacgccactcatgccttaaaaggccgggtaatgatttatagtccaattatatcacagcactacaagacgtcaaaaattcacggcggcaaaaggtctgtaactacctaaacattaaaagcctttgagctataaatcattatgtacactgagaatgccacatgctaaaacaaggaagttttcagcgaagtagcacattaactgaccactcaatagaaagaaaacagaaagtggaatggatggccactttcatgttatcagtggtgattacttgatgacaaaataacgctattcgagagcgagctataattcttgaccaactggctcgaccttcttcgtcatactgtagatcaaaattctaccattactggattcttttttttttttttttttttttgggctagctatgaacgtttcctagtcccgctcacgcattctagttctgcattgggtaaaagaaagcatatcattaagcggcagtttcgggtcgttctagcctcgagcaaaacgaagctcagctcgcctctttcactatcatcctgtgctcacgtccatgcgcattcttggcaattctgcagagatctctcatctgggtcttagcggttctccgcaccctggcgatgtgcttcgagaacgtctttgttcatcacatagactgcactgcactgcgccatcatctcgatcgatcgcgagactttcgcggcgacattcgcgaaatgccaaatgaaatcgagccggcctcgtgaaaaggtgtaaaaaaagaaaacgcatcactgaaatggaccccgttatgaaacgaatgagagatctgcccatagatcatctttcctatagcgggaataaacatgtgtgctatttacagtacatttcgtgtatctcacgcacttctctatatgtaatgttttggaaacatagacgtcgttcaaaggcaatgctttggatctttgtatatatatatgcttgtcgcagagtgttacatattgctgtgatggatctgttggctcttggtatcatcgttcctcgaaacagcccatcataaaacaataccattcctttaataaaacttacaaagatgaaattttctaaagtctcactactggccgcatctgcatctgtcgctttatctgccccagttgctgtgactgtcacgcaacatgtccaccaagctgccactgtagtggtacaaggtatagttcgtgtagaaaatggccagactctaacgacgttcattaccaagggcactcaaacggcttctgctagtcccgttgccacaacatcagctcctattgtggttgctaatgctcaagtggacagcatagctacttccgttatccaagaaagcgctgtcgtggctgaatctgcaacatttgaagaatcctctacagaaacatctgaagcattttctacagcaactgcaaccatacaagcggtgcaaacctccgcaagtgccacacaggatgatgtaaccacaactttaacatcttcaacacaacctaccagcacaactactccaacaaccactaccactagcccaaccactaccactagcccaactactaccgctagtccaactactactgctagcccaaccaccgctaccaccactcaatctaccgcctcaagcactcaatcctcaagctccgatttctcaacgtcaatggttaacgaacacaacactaaaagggcgttgcacaaggataccggttctttgacatggtctgacacactagcaacatatgcacaaaactacgctgactcctacgattgttcaggcaacctagtccactccggcggtccatacggtgaaaacttggcacttggttacggtacgaccggctctgttgatgcctggtataacgaaattaccagctacgactattccaaccctggttttagtgaaagcgcaggtcacttcacccaagtcgtatggaagggaacttctgaagttggttgcggtttgaaatcttgcggtggcgaatggggcgattacatcatttgttcctacaaagccgctggtaatgtcattggtgagtttgctgacaacgttatgccattagcttaatcactgaatttagcgaatacatgggtatggacatgaacagcaatgggcactgttccttctcttacatttctcttttatagtttcaatttttattatacactaaggattcttcttttctagggtacgcaaattaaatgcaagcaagatcatataacattgtcatagtctcatgcatggtaaatagggtgaacgaaaaaaattgggagatcttgccgacggctacgtatatatatatatatatataaatatatatatatatattcatgtatactgtatatgtacaatcatatataaagttactcttcccttttctttttttttttacattattacgtatatactgctttattatcggaaagtagcagtttaattaaagcaacttctgttgtttttcctctaaaacacaaatcataggatatcaactgcaacaagatgttggatcatttgtggatggcctttgcaaattaatgtctacttgtccgttattgcctccaccgatttgtctattttgcttagagagaatttcgtctttctttaaatcgtataatttttcaccaatatcttgaaaaatttccttaaccccttcacctgtcttagcactaacttctcggaacagcaacccttgttcttgtgcgtactgtttcgcttcttcagtgctaattgctcttactttttgttcttcatctccaccttcgtttgaatctgggcttgtctcagtgctaggcgtttcttgacataaatccactttgtttcccagtaaataaataaccaagtcgtcgtcgcctaccttatttttcagctcatcaacccagttccttgccttttgtagtgaatcttcctgcgtaatgtcataaacaactaatgctgcattagcgtttctataatacattggtgccaatgacttgtatctttcttgaccagcagtatcccagatttcaaattttataacgacatcctttgtttcattaccatcgtttgggtgaatagtgattgattgagataaaaaagcagcaccaatcgtactttcacgtagttcatcgaatgtatccttaacaaaacgatgaacaatggaagatttacccacggatgagtcacccaataaaactagtttaaattgcaacatctgttaataatatatacgtttactccaaataagttaaaccttcttcctaccctcgcactataaaaaaaaatttagatatgtccagagctcgatatcgaagcgacttaacaaataattaatactgacagttggtaaacgggcctgttcccttcactcccgtatgttaacattgtaacttcatatcgcaggggcagagctttataaacctgaattgtccggccagaatagtagtcgctgtccacgaaagcaagacactatgaagttgccgtttggtctcaatgatacacatagtgttaagaacattgagtaatttggagtcagattgatttcattcctttacaatcgtgatgtgcctatttaattcaaggtcatgtggatttcaaaatttaacataatgattttacctacctttcacacatttgaacatgggaacgcttaaatattaattactgtgcttcactacaattacaagagagtacgtattgacgttattaccagtttactttccatcatacttatcgcagaaaacaaaatatctaaaaaaagtatagtaaacggttgatgtcatcaagaagcataccttactccttatatagaaagctaagagacacctagaaacattgatttgccaaaaatccacattcctcgaaatggggcctaaaatgtgcgctaatgcgctaataaaggtgatataaagttcaaatcttgagtatacatatgacatacaaccataaggcctgattattgtctatttactgcaattttcatcttcagttccaatccacggtataatgaaatgtaatgcatcctatcttatttttgaatgtattatgttaatcgtcacgttttggtaatgatttctagatgcgactatagcatttttggcaaatcaagcgtttattttgacttttctaaatttggctttaaaatccctaaatttcacagttacgacatccttaaagtggatatctgttaaaatagttgacccaagtacttcactctccccaggcattttgttgatgttgttactgctcgcattgtatttcattatacattttctcttgtcctttgttcgctgattcctttctccatgaggtgatatgttgagtttaatcttaaggtattctctcactagaccgtgcgcttcctctttatggcaatttttgcatgatttactatttttattattactattatcatttttactggcggaagatgctattttggtcctaggtctaactacctgattttttgtatgtctctccgagtgcttaccaggttcttcgacctgattttcgtccataaccatctgatctttacaatattttttctcaaatgtctgagccttctccaatcctagcatttgttgctcctttctccaaactctagcacatctttcactcatgtaaattggatcaatatctttcatagtggtattccaagatatgttgttttggtcattatcttggggttcaggttgaaagtacgcgttttccatcggtgttcctgcattatcttcactttcgcttctagacttttgagctattccgtcgttcgcaattttaggtctgtcgttatttttctcttcattgtcatcctttactttatccacttctgttacatagcctattaccacagcagcgcagttattaaaagtattgacaaccctattagcgagaggtgtttttatgatatttttcaatcctgatgacgcttcaacttcaatactatccattttttttctctctatcataatgttctcctgttcctcaccttgcatcctcaccttggcttcttcttctctccgttttttcctttcctcgtgttccttgtaaggtctcatgtcaacatagaatttttctggttctaaagtccaaataagattaggaaggtctttatctttaagctctttgatactcaagttttttttgttcaagttctgcggatcacacgctgctgtagcgttgaatctgtaaactctgacgttggaaattttggtaagttgggaaaaatttgagatagtagtgattttattgcttttcattaatggttgtggaatgtaaatatcaccgaggtatttcttctttttatatcgtctttcgacaaaaccttctgaataaacaaccttgtgaaggatgctccaatcatcttcctttaccggggccatatcaagaatcaccttttttaccttttcaactatataatattgatgataataggtccattgtttatgaataaatataaaggccctgttcaatggatgcaacggatccagttcatctaggcaatcctctaccggacaatcgaattccacaactaaaacagcagggctacgcctgactaagggcccaatttccataatctgtcttaaagaaataaccatagtataaaatctgtgaatcatatttttagattctctgaaatcttccacattcaagttctcgaatatcataaattccctccccagatccttaagcatttgaagccgatctttcaaacttcgacagccttcaaattgttgcaatagaagaacatactttccaaaggaagagttgatttcagtaagagcctcatatccagaatagtccagaaacatagctaaaaaaaaatctcgtcaattttttttttaactattcgagaccttaccgagtaatcactttaaaacaaaaaataaataaatttatggactattttcagtgactgatatgccaaattcctttgccctgtatggccatattttcttaccatttctgtggtgacaaaggtgatgcaattactgacacaacaaggtaaaaaagagaggcgggtaacaaattacacacgtccatcatccgctaagcgctttaagcttatagagaggcaagtaacgtcattgatcctggatgacaaacgtcttttactctttttttgggtccttctcatggtttcagtgtctgacgaaaacaaagaaatatcatacatttcaatagagatcgaaatacatatccgcacagcatccaatataaccaatacatttctttttatcaactacttgatatgattccgtttactataaggccaggcaaatcaaaatacgctcaagatctcttatcagtttccggaggtaattttcttgcatttccatcttcacgcaatcgtccgggcacataatacaatatatgctatacatcaaacacggagcgtggaacatgttccagctcaaaaacagttagcaagtctattttcgtacgttccgtaaccattcttatgacaatagcatacaacaaagttttcataatattttgtaagattcatatacttcttacagaaaaaagagaaataaatattgcaaaaaactaacaacagaagaaactacttgcaaaatagtgattcatcaaatggcttcttatagtacgtagtcggcaaagaaccaatgcatcatagcagtggacaagcagaattgaatcactttagacgtgtagcagactcattgaaccaataaaattctaagacggatttctgtgcggaatcggaattaagggttgtcaaaaaagtgaaaaataatctgaaattaaaaactgttcttattctcgaggaagctattcacagtaaaggaacacaaaaggcataagaacgcattgaaaagtctaaaaaactaatattcgtatgatgctaagaactactgcctcacgaaaaattgtgctaaggaggggtctagccagcataaacacagggactaccgttgcatcaaaaaaggcttcgcacaaatttcgcaataccctttggactattgctttgtcagcgacagctttctacgctggaggtatcatatattcgcaaaaaaatgacaaatttggtgactttttctctaataacgttccttttgccgaggatttactagaaacatatgaacactatcacgataggccaacattgtttttagaagattcttgggacggcttgaaggcaaagagcaatgatttattatctggattaactggtagttcacaaacgcgcagatctaatagggaaaatattgaagtaaaaaaaatcttatcattagaaccactaaatattgaaacagaaaattctgatccgcaactgaaagaaatcattggctctttgaatgatctcatcaacagtctaaatgactcaaacctctccatccccgaatcagaattcaattcaatcaaaaaatctaaccagaatatgcttacgaatctatcccaattaaatgaaacgttaaaagaggctttatccaattacatgatacaaagaacatcagaagtaatcacggaattgaacacacaatatgaaaactcgaaaagggagtttgaaaagaatcttcaaaaaaacctattacaagaagtagacgaattcaaagaaaacttgaccaagcaaaaggacaaagaactagaagaaaaattaaaggcgaacgaagaattgttacaagccaaacatgcaaatgaagtgggcttactatccatcactcaagtcaaagaatttaataaaattatcaaagacaaaattgagaaggaaagaaatggcagattagcccatttagaggaaataaattctgaagttaacgacctcagcaaatccatcgacagatcgagcaaaatcttaagtaaaaacgaggctctagtgcaattaactttccaagtagatgagatcaaatctaggattaacaacaataacttacccgatgtgaatatcgacaaggaactatccagattgaaacttctttccaatcttctctctaccttcaacaaaaaatcttgttgcgacgatggcgactgctgctcctgcaaaaagggtaataagaatgaaggcaaggaagggaagatatcatgcaaatgcaaaccaaagacaaaccctccatcgctattaagcgtagctttagatgaattagaatccacatgtagcggtaaaaaaatcttatcgaatgagcagatctataacaggtggaacttactggcagatgactttaagacagcctctttattgccaccaaattccggtattttggggcaattaaccgccaaagttttttcccttttcttattcacaaagacaggtaatccttcaaatgccacggatttcgattctgtttatgcaagagtcggcgataacttgagggtatccaacctcaacgatgctgtagaagaggttgtctccctaaagggttggcctcataaagtttgcgaaagctggatcgaagatgctagaagaaaattagaagtccagcgcctggtagagattcttgactgtgaaataaggacgttgtgaaagaataatacaaagagaaaagagatgtacgtcattacacctcaatttccactttgtttaggaggctttaataaagaagaactaaatacctaaaatgtaagttagctgttactcgtcatttccgattcaaagaattttgaaatctttttaaaacaatataactttgtaggaattggaacaacaatgtgtatataaatagtatttcaacgacaaatacaggttcaaataaataaaaaaatacgaaaatatacaaaaatgcaacaacgtttaaactccaaaataaccaaacatcccgcagtacaaaaaacatgaataaaacaacagaataaccaaaacaatactaaaacaaaacattcattctgcagctttgcaaattcccttacatagcagttctctaccgcattccattaatgcagtggttctattttccacatatccggccttattataaaactctggtcttcgtttcatgatcacttcgggggtttttatttgcaatagctccgatagcgattccactgcgttggctaagagcatttggttatcaacgaaaatcttcgtcaaattatgagatgcatccgagtaatatgccacggcaaatgaccattttaatacggttcgtccctcattcaacacttttaaactttctgataggaactgtccatcaatccatgagatacctattctttcttgtagtgcatgaactttcgtgcccaaagtttgccccaggttccaatcaagcttggctgaaacttcatgttcgttaaacaatctatagtagaaagtgtatttcttcaaggttttattagcgtcttgagggttcttacttttattatcctcattattcttatacattgtacattgaaaaaagttcttaccgtggggcgcccaggggccctcacaaatccaacagaattcgtatttacaacttgagcaaaccatgtggttgcagccaccatttttttcaatattaacagaacattttggacattctttagtgtgggacaagacccaattcaaaatttctgattcttttctggcttttttaacccaagcagtggttattttacaatctgctggggaatgaacttcgaatccgcaattgaaacagaatctatgaaatgaattacacttaacgaaaggtgaataatgcaaacgggtatattctggtaatgatgacgtatctcgcaagtgcacgatggatttacagtcagcaaacgggcaccatttatagttacgattatgtttttgaacaaaacttttgattgaagaatccatcaacttactactcgaaggatgtcccatcactttatctatatcttcatttttcaatgccagggaacagtccatgcatgtaatgatgttcccctcatgcaacttatccttgatgtaatgacggtagcaattgatacaatattcatggccacattccaacgcaaatgtttccgtatcctttttatcacaacaaataatacatgtaaagtcatttttgaattcaacttctctgaaatgtgaattataatcattatctttcttgatatttgctgtggtacttaagccaagctccacaagcaattcgtccattttttcggtccaaacttctagcaaacgttcctcgttccaatcataatgctgtagtaatatcaatatatccgcagatggaattgcaaaaataggttgtaaatggtcaaccctttgaagcattctttcaaatatacccttggtggttaagcattcataactgagattcggtacactcccttcacacagtattcttttgttgtttttcgtaagaggagcatctagcatcccctcatatatggtatcgactccatcttcatcttcattgatgtcaaattctgaatcttggcttgttacactaattaacttcgggaaaactagtccatgtatagtaaattcagatgtattgtgagattcataaagttcaatagagctggaatcactttcatcaaaactataaaattgatcattttcggtaccactactcattgttaaaagcctctaacaagtacacccaaattcgctaaagacaaattaaatatacttaaagaatggctataattcctgtatagtagctgggatagtaacaaatcaatacaaatgtagctaccttaaaactaaggcagtactcacagcattcttcaccttcctctcctcttttctaaagcgggttcctattttttgcgcaaggaggaaggacgatggcactgagaaagcatcaaatcgtatgtaattaaactacgcaaggtatgtacggtcaataagtatagcttagcgctttaaaattaggtgggacattaggaaaactaataggggaaaatatttcttaaaaaaaagggcatgagggctgatcaaaacttgattacaatgaatggtcaacgcggtcaatggcagccttaattttcatacctactctcgtactcaattcataatcatctgcgtagccctgagccctcagtaaccattctttactctctggaaggccatccatgccctccaacttccatgtaaatagagcacgttcataaagtgcagtcggataggcccatggatcttcagttttctttatatatttgaccttgccattttgaatggagaaaaacttaggtagaaccttttcatccaatatatcacaaccttcttggatatgacctaatcttcttaatgtcaaagagaccaagagatctttgattaactcctgatctgagtctaaagcttcaatggcgggatttctatactcagttagcattttctttgttagctccaaatgctcttcagacattctattataaccattgtagaagtacgcaatttcgtgtactggtgaagtagcgataccatccagaggattttccaccccaagttcctcctttttcgctttaaattgctcaacttttctcagaataaacctatctaatggcaggttcttcgatttgaaggttttcttacctagcaaattcacagaggtgaagataagttcttcggccttcttttggtattcatcctttttgtctgacttcattaatcccatttcgcacattctccaattttctaaataacagcagccagcaaaatatgtgtaaaaagcgtgtgaccaatcactgatgtctaatagcgataaaatatcttctgcagctctatcgtattgatgcaaatggatcaatgttatagcacggtcaaaaatcatcaaggatttgacctgtctcatccgtatcttgctaacatcaatcgaatccatcaatgcgactgcttcctctaaacgccctttaccagatagcatccttgcctcattcaataaccatagcgcactattgggaaatagcgctcttgattgcagcaacgcatcttccagtattttcccaggatgcaacaacgtagggccatccatctcttcatcttcagaatcttcactgttactggaatccttaactgctgcaggaatatcaaaatcatcgtcagtgaattggaaaggtccatcatagtaaaacatcagggctaacaaaccaatacaaccatgcacgtttctttgctttgtggctttccaaacaagtctcaaaccttcttctctggaacccctgaatccaaccacagataggaccgcgccaatagcgggtggtaatagtgatatcacaacctgtaaaataccaaagcataaattgacaccagaatggacaaactcatcaattgttgcttgacttaaatctatatcatccgaaagaactttatgatctgttatttcctcttctggcaagtcttccattgcttgtagtcctagctcacctctcaacctgttaattgcaggagagttgccaatgtgggcgccagataatctttcagtcctcatgctatgaatttgttcagcaaattgtaaaagatccttatccttttgttcttcaggagtcagttcataaggtatatcaacggaattgaacgcatcgccaccagttatgaaagtcgctggggtggactccttatcttcactgcctgacgtaattttcaatttcttggctttgttagcagctttaatagtttccaagatttcttgtaacatatagtacgactttctgagctttaaaatggccttggccgcctccatcatactttcactgaaaatcatcaatagggcatgtagaaggcatgattctgtataagtcacggcataaactgttcctggaggatataaagaactgctcttcaatccaattttttgagccctctctctacttttcaaagataaagcttctgccttggccaaagtcgcagaagcttttttcatctcttcagcttcaaaacctaaagtggcctccaaaaattcaatgacaccacgagctaacgcatttatagtttggtcggaagcttctttagcatcactctcatccagcaaagccaaaccctcgtcagcattatcatctaagacatagtccatcgcacgcagtgcctgttcgaaatcatgagcttgttttagaatggctttagttttttcttcctgtgaaagctcaggaatctcttccttcgcaccaaaaccaaacactttaaacattttggttgttctgtgatccactagtcacaattagcctgtggatcgtctcagtggtggcatccgaataaacgatgcctcttttttagttgatcgaatttgcccccttccttggaaaaaaggaaagaaagcaaaaagccgggaataataataacagagaagactaatagacatttttttagtaagattggccttatctcgaacaagatttctgagatgacaattcgattagcttaacagtaacaagtgggggaattacgcattatatatatatacttctgtatatgtctacctacgaagtggtgcgagtcacactcgtcacgacgagctattgtggtctacaagaactacacggttttccttcttgatattcttgatttcttctttcatctgttttctcttttgtttggccatcgcctttagcgtactcactggcacaaccgtggtggaagcatatctatctacgctatcccaaacgcattgctcgacaacattgggaagttttctgccatacaggcactgatcgaccagccacatacccacaataaaagatttcctatctaaagtaccatcttttcttgtgtctaccttcgtgtaaatttctgccaatagactattgggcaagttagaccgcttccagatatcacggactatgatacccaatatcaatccatcttcgggtaaagtattaattgctccggaatcacccgttatagagggccaccagctcaacaggttcaaatgacggtgtctgttgcttacccacatgctttcgtaacgcttcctttcgttgtctgttacgaaagttatatctgtatgtgatttccagggtttatcctcattgaatttccgatctctcgtgcggtggataggcctatgatgtgcagttttattggcagaattcctgatctttctcttaattctatctcttttgcgtggcttggtcaaggcgtcctggttctgatcagattcagaatcagaatcagtatcgtcatacacatcatacgtgtcgttggacggattgtacttatacctcagatttccctcatgtagagaggatgcatgatcattttctgcgtttgtacttacagaggttttacgtaatgttgttttaaatctcatactcggttgttgttcatgttgtcccagttcttcgctgcttgcatccatttcatattgtgaagataagtgcttgggcttactaccaaatactttccttttgaacttgttaacaagcttcttcttcctcatatcggatgaatagttcggaaccaagttgggcaaaccacttccctggttgctcgttgtagtagtagtgtttgagcttgcaatagatggctctgattcacataacgagagttgattaattgtttgagatagacttgtttgtgacctattagaaataacgtctgaagtgtccggattgagactatgtctggaatcgatgctaattgatgataggttttcattttcatgaagctgaccactgccgacaagtgatgattgcaagggaggagacggcctgcgtttgggcagagctttgttgctgtctttattagttgcaggctccatagagctcgaggatagccttctaccgctactaaaggaagtaagtaaattctcttgagatctattgtcgggagttctttggccaggcgtcagtgattcattggagccgtttcttgagcttgagcgtgaatgaatgcccagcaagccattcaagttcggagtttctagaacttttagtgtatccaatgccgaagaatgggaggagttattgtcagaactaagtttcgattgtgaatgcgctaaagcagctgccatttgagcagtactactaacattatctttacctgcagggcttgacctgtgtttcttagacaactcaacatcattaggcgccgttgttttaatcttaggtacctgttttgttcgtatgcgtgccttcttttgttcttgtttccgccctgacttttgtagcgatggctctgataacctagtttgaggattcctgctcaccgttactggagggcatggactgctgacctcattggaatggttctggaagatagcttgcgcagcgcgaagggaatctgaagctccttgttcagtcaaagttactgttgtaccgccatgataacgctgtttaccaaacgaaagtctcatactcctctgctaatcttttcctatgtcaaaaaaatgaatctacccaggccttaaaagtatgttctacctgtgcaacgagagtgttgttgtggcaagggtccattacacaatgggcctttttgtgatgattcaacttcgatatgctttatacgagaaatcatcgaattttcgctgcgtggaaacaagaggcagtaagttgtacgtataggtgaggctctgcatagaagaggcgtatttgcggtgagacggaatctgacgaggatattaagtacagatggcagaacaaattagtcacaaaaagtccctgagggtgagcagtctgaacaaagatagaagattgctcttaagagaattctacaacttggaaaatgaaccgaataaaggtcgtcaagaagcacgtataggggaaaaagccagcgaggctcattctggggaggagcaagtcacagatgtgaatatagataccgaagcaaacactgagaaaccagtgaaagatgacgaattgagtgcaactgaagaggatctcaaggaggggtcagaagatgcagaagaagagataaagaacctgccctttaagaggctagtacaaattcacaataagctcttgggcaaagaaaccgagactaacaattctatcaagaataccatttacgaaaactattatgacctaataaaagtcaacgaccttctcaaagaaattacaaacgccaatgaagaccaaattaacaagttgaagcaaacagtagaatctttaatcaaggaactgtaatttccagcggcatatcgtggctttcaccgaacacttccttcgagagagtgcattttactatgtgaaccaatttttcctctttttcggtttgcaagttcacctgaaaaactgcttaacactactagcaattgccctattgtcgtacgaggactttgccaaatgtattcccggctgtttgtagtatatatacgcagatatataatagcgccgtctttttacctctttgagcgaattgccaaatattgactcttttgtcttatttcgctatccccatcttatcaaaaatgggaacaactcgttgaaataagagacaagcaacaagaaagacaaccaacagaaagttccattccgcacaaatacgctggaatcccatagaatattgcttgttcctctatgactacatgctccaattcaatacagaaaatgatactgtagctccagtgtttcccatggagcaagatataaatgcagcacctgatgccgtcccactggtgcagacaacaacactacaagtctttgtaaagcttgccgaacccatagtgtttttaaaaggatttgaaactaacggactgtctgaaatagcccccagtatcttacgaggatctcttatcgtcagggtgttgaaaccgaataaattaaaaagtatatcgataaccttcaaaggaatatccagaacagagtggccggaaggtataccaccgaagagagaagaattttcagatgttgaaactgttgtcaatcacacatggccattttatcaggcggatgacggcatgaattctttcaccttagaacatcacagctcaaataattcgtccaatcgcccatctatgagcgatgaagattatctacttgaaaaaagcggtgcttcagtatatatcccaccaaccgctgaaccccctaaagataatagcaatctaagtctggatgcctatgagcgcaactcattgtcatccgataatttgagtaacaagccagtatcaagtgatgtttcccatgacgacagtaaactgttggctattcaaaagacaccattaccatcatctagtcgaagaggatcggtaccggcaaattttcacggtaactctttgtcacctcataccttcatatctgatttgttcacaaaaacattcagtaatagtggcgctactccaagtcctgagcaagaggataactatcttacaccatccaaagattctaaagaagtttttatttttcgaccgggcgattatatttacacttttgaacagccaatatcgcaatcttatccagaaagtataaaagccaattttggttccgtggagtataaactgtcaatagacatagagaggtttggcgcattcaaatcaactatacatactcaattacccatcaaagtcgtaaggcttccttctgatggatccgtagaagagactgaagctattgcaatttccaaggactggaaagatcttcttcattatgacgtggtaattttctcgaaagagatcgttttgaatgcatttttacccatcgatttccatttcgctcctctagataaagttactctgcatcgtattagaatttatctaacagagtctatggaatacacttgtaatagtaatggaaatcacgagaaggctcgtagattagagccaactaaaaagtttctgttggctgaacataacggtcctaaactgcctcatataccagctggttcgaatcctttgaaggctaaaaatagagggaacatcctcttggatgaaaaatccggcgatctagttaacaaagattttcagttcgaggtgtttgtcccaagcaagtttacaaacagtatacggttacaccctgatacaaattatgataaaatcaaagcccaccattggataaaaatttgccttcgtctttccaagaagtacggggacaatagaaaacatttcgaaataagtattgattctccaatccatattttaaatcaactatgctcacacgcgaatactttgctaccgagctacgagagtcatttccagtattgtgatgaagatggtaatttcgcaccagcagcagatcaacaaaattacgcaagtcatcatgattccaatattttcttcccaaaagaagttctttcgtctcccgttctttcacctaacgtgcagaagatgaacattagaataccgtctgatcttccagtagtgcgtaatagagctgaaagcgtaaagaaaagcaagtcagataatacctccaagaagaatgatcaaagtagcaatgtcttcgcatccaaacagctggtcgcaaacatttataagcccaatcagattccaagagaattaacttctcctcaggcgttaccattatcgcccatcacctcaccaattctcaattaccaaccattatcaaactccccgcctccagattttgattttgatctagctaagcgcggcgcagccgattctcatgctattcctgtggatcctccatcatattttgatgtattaaaggccgatgggattgaattgccatactacgatacaagttcatctaaaattcctgaactaaaactaaacaaatctagagagacattggccagcattgaggaggactcattcaatggttggtctcaaattgatgacttatccgacgaagatgacaatgatggcgatatagcatctggtttcaacttcaagctgtcaaccagtgctccgagtgagaacgttaattcacacactcctattttgcagtctttaaacatgagtcttgatgggagaaaaaaaaatcgtgccagtctacacgcaacatcagtgttacctagtacaataagacagaacaatcagcatttcaatgacataaaccagatgctaggcagtagtgacgaagatgcctttcccaaaagccaatcattaaatttcaataagaaactaccaatacttaaaattaatgataacgtcatacaatcaaacagcaatagtaataacagagttgataatccagaagatacagtggattcttcagtcgatattacagcattttatgatccaagaatgtcatcagattccaaatttgattgggaggtaagcaagaaccatgttgacccagcagcctactcggttaacgttgctagtgaaaaccgtgtactggacgactttaagaaagcatttcgcgaaaagagaaaataagtacattattttcattctccgacagaattgctaccattttactttgtgtcctgtgattcaatagtgtacaatatattggacattttatagtatacaaatatacaccatcaatctatacatccatatcacttgtcgtaaagatatccctttttaatagtacagcgattaaaaaaataacatgattaacgttcagttaccaatgagcttatttattaggcttgctttagatttttccaagtcaatttttgttttttctaacgcttgcaacctcatctcaaccttcttcctttgcaagcagatcttcgaaaccatctcgtttattctctcaatgctgttcccactttcatcatcgtctgggaaaagtaccggtaagggcgtgatgattttctcattcgatttgtttatatttcctttgcttaaaagctgggtttcccattcttcattagttctgtagggcacttcatttatggccttctctataatctttcttttagaatccttttgaatagcaatttgattatccgtgagggctagcatttcgtcttgaaagccttgcatttcatcgtcactgaagttcgtaatctccttttcattgttacgtttcagaccaccatttaatcttattgtctccataatttcgcgtttatcctcactgtccaacaattttacataatctctttctgttgtaacatcactctcactaattttccttctagataatgacttctgtgctttcagttttgcaatttctcctcgggttggtatactactaatgtgctcaccttcggagctactgccagcctctgaagaatcacttaatagatgatgattcccctccatcaagtcctccatattgagaattagcaaatcatctttgtttcgcgtcgatgcattggtatttttctttgaatggtaaagatcttcataatgcgaattatcctcctttattgcttgttcgccatcaaaggtaatgtcgcgcttaggaacttttttaaactttattggttgtaatacacaaatgtcgttgtcatcatcttcagaatcgttcgacactaggggcttaatttgctgcattggcttatgcgcagaaccatcaattccaacctcctcaggagaaccacttggtaacctaattttatttcttttcttgatcgccataatgtgttcaaatgctataacattgctaggcagaacttgacgtaactcgaccagttatattgcttcttcaaagcacaaatttatgatgattgctttcagttatgaggttcatttcgatattctttatgatcttcgcttgccgggtatcggacaaatattgaaatattatacagcaagaaagaggcataaagagcctggcagcagcaaataatggcaaagtgaacgtagtccgagaaacagtggcttaattatttaaccttgggtttgcagtaattaataatgacaagaaagcaggctattgactatgcaatcaaacaagttccgcaaatattgcctttggaagagtctgatgtaaaagcgctgtgcgaacaagtactgagtacatcatctgatgatccagaacaaattgcttcaaaatttttggagttcctaggtcatgaagatctatcgtttgaatttgtaatgaagttcaatgaattattgaatcagaatgataaaaaagaggaaaaaaaaacgaaaaatgtgcatcttgaacatactgcccccacttcatggaaaaatgaatcaaaacagcccactaataactatatcaataagaagggagatgaaaaaccaaaaaaattaaaggatgagaagaaaagctcgacaacgaggcctaccgttcaaccatcaaatcaatctacgcaatcaaaccccataaaggagaaaaaagagcacagatcaaaggggaaattacaatcgttacaagaaatagacgaagcaatcaagatgctagagcttcgagatagcggttcttctaaaaattgtaattgtcaaggtacaaggcatccagttttcgacatcgcgccaaactgtcttcactgtggtaaagtggtttgtgttatagagggattgaataaaggtaaatgcggtcattgccatgaacagttgatttctgataacgaaagaacccaaatggtagaaattttaaatcaggaaaaaaacgaactaaacggttcatcatcgtccttatccaatgcgtcaaatggagctaatgtcccaaagaagaagactaaaacctacaaaataacttccggtatgggtaaaaatttatttgctgaacaggacaaattatttgatttcatcgaaaggaaaagagaaagagaaagaaagcgtaatgaagtgttgaaattgcaggaggaaaaagaagagagcgaagcaaaggaaagacaagcgagcgagcatgaccataaagctgaggaaaacccggagttgttagcagcacaagaacgattagatagacttttatatttccaagacacttcggcagaaagaacaaaaattattgataatgccagcgattttgacatgaatcaggaggtgggtttatggggcagcgcaagagaaagagctcttgcgttgaagaagcaacaacgtaatttgagaaagtgggaaaaagtagaaaaggaacggaatggcaggcgcgagaagtacgttgttagcatgaatataggttcaaacggtaaagttactatgacagaagtccctaaggatacagagaacgtaattgcaggttcagatgatgacatcagtgatataagtgacgaagaagatatcagcgaccttaaacatatacacgctctgaaaagtgaaataaatacaacgaaatccttggagaatttgcatttacagtccaaagcatgggattacgaacgtgataaaaaacaattcgataggcctacgtatgtgaaaaaaaattcagatactgcacaacagaatagaaaaacggaagaaaaggctcacgacatgcaagcttatgatttaaagtcaagagtacaagtggaccaaaatgcagacgcatcagtagaacagaatattcttgctgtactttgatgaatggtaaaagtttatattatatatgatagaggatataaccgttattcattttctgtagattttatcattttctttgtcttcatagtatacaatttttttttatatgaattaatgcttgttcttgtctatttagtagttaaactcacttgctatttgcttctctgccatacgagccatacgaaacattttatttttagagttttccttagttggcttcttttcactattaccatccttactactttgcaatcccatagcctttggcctttcacgtaacccaaaacttttagctaaatggcctagatgtaagaacttcacgttgaaaaacttcttttcttgagagatatgcgttgcgtaagccctcacatgactaatgaaacctttaacggccaaatttttgaatgcggaatctcccactactcgtctttctatattcaaatgccatgtcgtagcattggtatcccactcatattctttatcgcccacgtctttatttttggacgatttctcatcttttctaatgaatttatcatttctgttgacattcacatctttgaaagccggcattagtatttctttatcgaatttcagtaattcccaacccatcggatgatacggctggatatagtccatatatttttcttcttcgccaggaagtaaaaataacaaactttcacccttctcaccggcccttgctgtacgaccaactctatgtaaatggtcttcaacagcaaatggtggatccaactcaataacagatccaacgtggggaaggtctaggcctctacttgcgacatctgtacagaacataataagatgttttcccttggtggcttcattatcacgagcaaaatgctgcaatgtagaggttctcatttgttgggataaagaaccgtgcaatttataaatcactacatctgggtccctagaatctgaaaaacaaggaaacatagtgtttccttttgtcaatagtcttacagaatcacccgttagatttttatggtgcccgtcacttcctgaaaatgcgtcataatgaaactccacgctgtctgaacatgatacgaatacgattgtacgcagcgttttggactgttgaccggaagcgatgaaatctttggtaatgttgttcaaagtagcagctaatgttacaagacgcaactttggtgggacaatagtaatcctctgcaatagttgatcgggcgcaaccgttactatatcagaatctttcttggtaccgttgctaatcaatttgtaatctttcaacgccacgtttcttaacctattaacaccatcagtaagtgtagcactacataacatgtgcactaacttatgcggtagcttgggaaatttttcggagttgatgggaatatcgtgaacaattttaataatttcactgatcgtctcatcaaaacccaattccattaacttatctccttcatccaatacgatataccttagagattgactcaattgctccttgataacttttgtattttgtaaatgatccaaaacacgacctggtgtaccgattatgaaattgcaacccttacgcaatctagctttttctgatttcttacgttctccaccaatcaataaacatgggaccaagtagtgacaacatgacacaagcgtggaacaaacatgatatatttgtgatgctagttctcgtgtaggagcaataaccaatgcaaatgcaccagaagtacgatcaacatgagtatccatgttcaaaatagtagatattataggtaaaagatacgataaagtcttacctgagcctgtttgggcgtgaatgaaaaaatcgttcttccccgcgttacctattatttgaggtatggcctgcttctggatgctcgtaggctttttaatacgcattttttgctccagatgagaaacaagaagactagagacacctaaagacgcaaactgatcacctttcaagggcgcgttagacggattgatggcaacgttttcatcatgaatattagtgtttaccgcagttgtaatctctctgttagatgtaaacagggatgaaacaaactgagaatcggctggtagagttctcccttgagtgttatgagcatttctacccttatatttttcctgctcttcagaactataggaactctccttatgcaattttttaatagaattctcgcctctacccggaattatcccttcgtcccctgtagtgttcgcctttcttttcctcgagactgtcttgccctcaagcttcattttcattcttcttctatccttccatctaccgcctgtcaccttggcagcttgcttataggaacttcctgcagtgtcctcattggtagtgaagtttaacagcatagaatcttcatcgctcatcttggtgttaaattgctgaataagtatgcttatttggaatatgaataatcccaaaggaaaaagaatataaacaatcgtactttcttaaattagaaatatcacatacaagtactcaatcttttattttcctaagctcatcgcaaatttttcaagtaaaatggaaacctaatatgtcagggtttttaatccatattgttagggcaacattcaattttaaactgaaattttataaaaactctgttcatttttcaggccttagggttagtattctgacaaaattattcaagaaaaaaagaaatgttacaatgaatgcaaaagatggataaaagcgagagatgagcttaaatgatctggctcaagcagtgcaaggtgaaagtggaataggctagtgttatagatgagtattgacaacaagttgtttgttactgaagaggatgaggaagacaggacgcaggaccgtgctgatgttgaggatgaatctaacgacattgatatgatagcggatgagaacggaacaaacagcgctatagctaatgagcaagaggaaaaatccgaagaagtaaaagctgaagatgatactggtgaagaagaagaggatgacccagtgatcgaagagtttccattgaagatctccggagaagaggagtcactgcacgtgtttcagtatgctaatagaccaaggctagtaggacgcaaacctgctgagcatccgtttatctctgcagcaagatataaacccaagtcgcacctatgggaaatagatattcctttggatgagcaggccttctataacaaggataaggctgagagcgaatggaatggggttaatgtccaaacattaaaaggcgtgggtgtggaaaacaatggccaatatgcagcatttgtcaaagatatgcaggtttatttggtacctattgagagggtagcacaattgaagccatttttcaaatatatcgacgacgcaaatgtaacaagaaagcaagaggacgccagaaggaaccctaatccttcatcacaacgcgctcaagtggttaccatgtctgtaaagagcgtcaacgacccttcgcaaaacagactcactggctccctgctggcacataaagtcgccgatgaagaggctaatattgaattgacctgggcagaaggcacgtttgaacagttcaaagatactatcgtgaaagaagctgaagataaaactttagtagccttagagaaacaagaagactatatagataatctagtttgaagtacataatgcatcatgaagaaagaacagcatcagacatcagtttcacataaaggatgctcttgcgctttttctccttttctattaagtcattgcgtgcatatattatgtgattttttttaatcataccacatcttgattaactcttctgaaacggcacttggagtgaggacccctaaatctgtaatcaatgcagtaatgtattcttgggcggtatagtcgatcgtgggcccacgcaatgcatcttctagatcgtccgtacgacgtgtgaaatccaaaggagggccggccataggtagatcatctgaagacaatggaaacatacgaacaaatttgtgactttcagtgaccacatagaatggttttcttgcattatgtgctaaaacacccactgaataggtacccacgagatttataataccacctgattcagcaacaccctcagcaccaacgaacactttgtcaaccttatcgattaccgctccaaccgcgctatcgacaataagagtcacgggtatgcccttttgttcaagtaaagtatatagctggttcccttgtttgctaggtcttgattctgtcaccacacatctgaacctaataaacttatttgctgcatgatttaataaagaaaatactgctctcgaataaccatgtaccaagatgatatcatcatcagctatgaaatccacccctatttctgcaatcttgttacgcgattttttggctctcgatacaaaaagctggccattttcaatcaaatgttgtttacagttttcccaatcaccgtataaatgaagatttcttaagacaaatctcatgaaaatatcacaaccggctctcagggaaactgagttcggaatggatttaataagttcttccgtggagctttttattgtattaatcatttctgccgctgtttctggtgtttttattcttaatagcgtgaccaatgcttcaatggcagcaatcggcattgtcatctcagtatcttcttctaaaaaccttagataagtttctgtaatattaaactccgacatccttcctctcgatttctggtatacgtaggacttttaaaattctttctatcaattactatgaagaaatctatgattaatgatggctttgtcactatttgagcagtatgattctcattttacaccataaacttcaccaattttttcatttttttttcatttttcttccggatgaaatttatctattgtaaaaaaaaaaaaacattatgctatgtagaaagctttaaatatggcgacaatgttgctgtgttgtatcaaattccctggatagagtcgtgcactcttaatgtggcgaaaatgatggcattgcctccttattctttctcataaaaggtattactaatcgttatctattaccaacataagatatagctagcaattcttgtaagcacaattacatatgtttagttttattttgaaaagcaatacaagcgcaaattgtttggtctgttttggagagatcaccatgtagctggcactgctgcagattgtcatgtagtaaacatactagtaaaatattcttaaaataatttgatcagatcagttttgttcttctatctcctatgtcataacataccgctcatttttactatcgttatgtttttcattcagaaattttatttttctttaggtcttgagtatcgacttccacaacattggatgactgtacctcacgatttgtgtattctatttatgcagtatgtaataacatattagtgtcacgaccgctagccaatatacgatagtggatctttattccaaaaaatacttatctaacatgtttaacaacagatcagatactaaaactttttgtctgaataagaattaactaccatctatgcactagcacacaaattagcagtatgttctcatacacagtgtaagaagatgacattaagaatgagaaacggttattaaatataatagaagctgaaatgcaagcattgataacgtaacaagataaagaataagcatataaagtaaaaaaacgagacaataacattactattcatgaataccgattccttcttccgcatttctaatatcctcgaagagaacttttagtatattgtgtatcatagccttcaacaataatggaacaccagtaattatcatattattcaaacatttctcaatgatagcttttattcacaatggaacccaacaattatttcaaaattcacacatttcttacttcttagagcaggattagttgggtctggtaatttgaactactatattaggtaaaaaatcatgcaataaatagtgctgatacttagggttctcaatttttaatgtctcttaataattcttgttcctcgtggcccaatggtcacggcgtctggctacgaaccagaagattccaggttcaagtcctggcggggaagaatttttttacttttataattttcttattatcttttcagttattgagtaaaaatattataatattggaaatgctacgttgccagtcctggtgccgtacaatgccgtattattttagcaattcgtcatcaggtttccgaggcattgttacaccgtttgggaaaaataagatgtatgcacaatggtgtatctaaattcaacataaaaataaaaaaaacaaaatgacaaacggcaataaagagacattgtgtgcaaagaaagggcatatatatcaagtagtataagtagtaaagtacagttaacagatcaattggcctcgaggaatatgagttttttatgggggtctacaaagtccaagaaaggcaagaataaaaaggctgcaggttctcttccgtcaggtgttgttccacagcaacgtgtgaaaccaacacgtaaaaacgttcctatagattatccaagaactttggaaaaagtacatggtgaaagtttaatctttaggacgtcccttttaagtgaattggtgagcactggtaaatctggtattggtcctccagacttgattcattgtacagagttagataaatttcacgatgagaaaataggtgaattcttttacatcacggggatcgacgcctcgagcgtctctatgccaattgcatttttgaagctgataaaatggaatgatggtaagaaactaaaatcagcatctttgaagaacgacgacatcacaacctactgcactttcaatatctttcaaaaattggacattagattaagatatgaatctgaagatgtttatcaagttaatatcgttgactgtttaaatggcaacaatgaaataccgttgagtgatcttatttgggaagaaactttcgttagctgttgcataagaagcgtaattattaattcagattttgaaagaaaaatacctgggctagtggaattaccatttgtttttgagaacagatgcgcgagtgattataaaagggtgatagattcgttatgcaaatttttgccaagatttttagaatgtggttgggattctacaaagagcgtctatgcaacgatactgaataactacctaactgaatcattattagtatttctgtctataactccagaattcataacagactatgcgatccaggttttagacaacttgatgacgaatgacccgtcaaattctagatattacgctattgtaattatttctatcatggagcgaagtaatgaccgcgatgtagaaatgatcaaacggatacacgagatattagacctattactacccgtactgtatggattgccatccgatgaaccttacatttctgatttgatcaattgcatcaccgatgtattaagcatccaagcaaggtttctattgaacaataacgactatgaactttctttatccatttccacattggccacgaatttatcttctgataattttgaatcttggtatctgttatctaaaggctatattttttcacaacagtatgataaggcactgctctcaatcaattcgatgccctgtttagcggaatatgatatcgttaaacaagcccagattaacgcttttaagttttatatgaactactacaaggcaccactatgtcatagcagagaacactgtaccatgacatcacacgagttaaatcacctcatgaatattatgcattatgaaaatgagttggagttgaagacaataatatttggacgcactgtaatgcccaatgaatctaagtatggatgtattgaagagatatggaataaatcctgtcttgaattaggacctatttgtggaccacagagtgacaatctcataaactttgtatctcagcaggaggtaaatacagtaggagatatgctgttactaaaacgaagcaaagaaaccagacaagagagttggtttataaagcaagtacgtcttctgttgatggaattagtcgctagaatcggctggaacgccttacttcagctaagatctgacgttttcgttatggagagtaaattcaaaatgatagaatcttcggacaagctgtccacagaattacgccagaagaggctctgtcagagatggtttgatgctatgtttctggacgtttacgaagatttaagtattagcacttcatctcaagaaaataaggctacggcgaaatacagcgggttggaatgggaactacttggcttaactctgcttcgagtgagtgacttacccgatgcagtagcgtgtctacgaactagtattttggcaaggtttgaccctattagttgtcaccatctgttgaacttttatttaaccatggattttaatgatgagtttatgagaaggtttgacgtcgatatcattttagatctattagtgaaattgatctcctttcggatacgattctatgatagatttcagatattttcccttcaagtactaaggaaactagagggacagctgggctccgaaattattaagaataaaataattaattctccttacgggcaagctggcatcacttcggtgatagattatatgcttgaatgcctctctaaaaataggaatgaagcctgcctagcctatgaacgccctcttccagatcttccttccactatcaaacctctggcagactaactgatcaaattgatttaatgaatctatatatatatactgtgtgtgtgtgtctgtattcttaatggacaaatttacggcgataatgctaatactttagcgcgggtaatatcctaatagtaatttttcaacgatttgacagagtaaaaaatgaccagcgtaaaaataacatcaatacgtcaagggtatactagacccttttcagctctttccttgtccattcgaagacatatcaaagataagaaaggtgttggatatttactattgtaatttcaccttttatttctttttttttgacgggcaattgtttgttcgtaatagattttctatcaagtcaagaattttttattcttgcaaaggccggctcacgaataaagagttgcatttgccttgcaattcgtacggttaattgtcattttttctatttgtattataagatacgaagggtacctcattgaagtattttcacctttagcattttctttatcatcttttgttttgtttgttcatttactttagcgtttagttgataagtcctgttatcctcttcttttatttcatttcttcatttacttaactgcgagaagattataatagcatgtcaggttctttctggaagtttggtcaggattactcgatagagtcaccggtttctaagattctaaatagtgcctttattaaaatcaataaggaccaagatgacgacgtacctaccggcacatgtgaagaaaatattgctgatgacgaagataactcttcacatgactacgctgcttctgaagataatgtagttaacgagaacgaagagaaggaagaagaaaatactctgcccactacagaatcggaatatgaaaattatagacctaatttggacgtcttagacgatttgctggatgatgacgaactgtatacggaattaatgtgttcaaatttcaagctactaatattcttgaagtatcctgatgttttatcaaaattgatagaatatgttaccaacgagaagattctcgacgaagaaacagatagcgctaaaaagccagagattattgaaggtgtaaacgatcatcctattttgatagaaagagacagaaaggataaaaaggaggacgctgaagaaggaggcgactcagaagaaactacaaatgatagcgatcatgactctggggacgaaagaagtgttgattctgaagagacaagcattactttgccaccggaatctgaggaacaagtggagactagaagggcaaggatagctgctgaaattttatcggctgatgtatggcctatatccgcagcaataatgcaaaataaggatcttcttggtagattgtggtcgatactagatcacccagctcccttaccgataccagcttccacctacttcatgaaaataaatgaaagacttctcgatatggatataacggggatgttagagtttatattaagccgagacagcttggttgcaaggttcttgacacatgttgacaatccgtctttgatggacttccttttgaaagttatctcgacggataaacctgactctcccacgggtgtcataaagatactaaaatcacaggaattaatacctaaacttttagatcatcttaatccagaatacggtatttccactcagtctgcggcaggcgattttattaaggcattcgtcacgttaagcactaactcaagcaatgaacttgcttcgggaataggtcctaatgaattgacaaggcaattagtatcagaagaaatgatagaaaagttgattaagataatgctaaagggcggtacatccttaagtaatggtgttggaattatcatagagttgatcaggaagaataactcagattatgatttcatccaactagtctacactaccctagaaagtcaccctcccactgatcgagatccaattcacttgatacatttagtcaaactttttgctaagcatatgcctgattttgctgatatgctggataaaaccaagttgccactaatggaaatgccattcggtaatattgaacctctgggatttgagaggtttaaaatctgtgaacttattgcagaactattgcactgttctaatatgacgctgctaaatgagcccaatggtgagatgattgcccaagaacgtgatatagaaagggccaaagaattagaaacttcaaccgaaaaggaaaatataacagctattgtggacaataaatcatcatattatgataaggattgcgtagagaaggatatcacagaaaatttaggcgctcttcaaataaataatcaaggaagtgaagaagatgaattaaatgatactggggtatcaagtgtaaaactagatgtgaaatcagacgcaaaggtagttgaggggctagaaaatgatgcttctggagtagagttgtatgatgaaaccttgtctgacacagaatccgtgagagaatgcctaagggaaaaaccgctagttggagacaggctgaagattgctctagaagacactaagatactgattagtatccttgatatgttcactgagttcccttggaataattttttgcataatgtaatttttgatattgcccagcaaatattcaatggtcccctcaaaactggttataataggttcctcttgaaagattatttggttgatgcatacctaactaaaaagatagtagatgcggataaggcatgtcaagactatgaaaaaaagaccggtttacgttatggttatatgggtcatttgacattagttgccgaagaaatatcgaagttcaaagagtatattgatgaaatgaagctaactttttgcaataccgctgtttcagatcgacttgaggaaccattttggaaagaatatagtgaaacgatcttggctgatacaagagagaagtataacaccgttttgggagattttggcaatgaccaagaaagcgatgacgatgttattaggaattctgattctgaggatataattggtgatacagagggcaacgaaaactacggaaatggagaaaacgatgaacttcttagtaacgggcatgattctgggaacatggatttatattataacttcaataataacgagaatgaagaaaatgaagaagattacgcagagtatagtgatgtggataataaaaattactataataacgtcgagactaacgacgatgattatgatagtgatgatggtaaatccaaaagtgccgaatcagagtttaccgataaaatatctgaacatagggatggcaatagtctctataatgaggacaatgatgaaaacgggagtgacaaatggacatcgggtacttcattgttccctccagaccattttcctagtaggtcacaaccttcagatcctaaactgcaagaccagaatatttttcaccatcagtttgactttgaaggtgttggcgatgacgatgactatatggatcctaatgatgatggccagtcatatgccagacctggtaatccattgtatactaccccgaaaacaccaccaagaccgaagactattcttttcaattctttatccgcattggataataatggcgaagacgaagaagtggcactaggcaccagtgttgatgatcgaatggataacgagatatcaagcgatgaagaagactccgaaatgaagatgaagagaatgatatgggcaatgaggagggctactcattatataggtcaagaagtaaagaagctttctgaactaaaacattcacattgtcacattttcaccctttattcatcaattttttattgctccacttttttcgcatataggtcatttataattcatcaaatatatacttttttaattgaggcttgtaatttaatattaaccgaatataatcttataaagaataatgaatattcacttttgaatatacttaagtttatataggtgtaagaaggaaatgtccatgtttatttcagtagtttttttctgtaatccgcaaagcttaatttctttttcgaatgcagttgtgaggacgaaaaatctgataagtgcattatactttctggagtggattctcgccttgaattaaccgaagcttctgtcatgatttcttttgtttttgcttgactgtgttgtgcttcctttgacagttctttattgaaatttgaaagagaaggggttctacttaatttatgttcattctttgattgactctcttcgacatcgtttgcagtttgccttgacgtcttgtttattggtaaaagaactggaattggtaattcttcaatattggtaatgtgtgattcgtcataatctgtgctcttcgtaattattaaaggtttttctgaagtttcattttttttgggaacagaaatattagaagaatgttgtgcaaataaggcgaatttgaagggttttgcaatatcatcaggattatttgtactatcaatagtattcttttgaggaatttttggaccattatttcgattaaggaatttttgtcgataaaaattattcaaaagtattggagctctttctatagtattttgagccttttcttctagcctatgcaaaattggtggctcacgtctctttttgcaattatattggttgagaatttcatttaatttatatctgttgttcatttttcctctggatttcacagatttataaagactttgcgcgtatctcttcactttcaataaataacaatctttagaattatttccacagccgcattcgccgttactcaaaattgtttctaccgaatttatcagcccatacctttcaaggtcatctaaagagtctattgtcatgccctttattaattttaatataggatgttttgaatcccactgccatttgatgtataactcctcatcctctgaaatatctctcaaagctcttaaaacaaattttattctacttgattttcttccactgcttttgtcattcctattgtctgtatcttgcagttttatagttactaattcaacattcggctggcaacttcttctcaaatacctagttgaattgcctgataagcgtgcatctatatatatcggccaatgggaatggaaaatgacccttcttttagctgtaccccatatcctgtaatggtttcgtgggtcagtgagataatttttatagaagtccaattcgcctaaaatttcttgaatgaaatcaccttttatgcagtcctttttgagataaactcctaatttcgtgaagcctgggtaagtcctggaatatgcaatgtcagcatacggtttgacttcaattgacacagatttaaaggtcttatgaggatattgtatgacccaattatcatccatatgtttatttaagaacggttcgatcagatcacttttaaacacattgtctttcaagggcaagtatattgcaccatatgcgtcttttgcactcaggaaatgctcttttttcttgggcatagaagtcaatccatcggaagaattgacagaagcgctttcgtttttggagtctatactattatttgatgggtttcttttccttcttttgtccctgtggttagtattgtcctgatccgttgaaaagctatcgccaacgtcactaatagttgtactcgatgctctgtcccgaccgttattcttattactagcactattgtttgatgaagaaggttctactgtttttacgtttatgcgttcctgctgtattttcctagccaagttaatgtctacctctcttggatcacatgagttgcaaaggtaatcatcaggtgccatcccaatatctttgatgccatagcaaatagcatgctgccatctgttgcagtggtcacattggatagtgaatccatcatcatcatttaaatcacatatacatgtaattatacccgcgtcaggatcgactatatacgaatcaggtaccggccattgaggttgcttttgaggttgattttcggtctcttcttttgctgccgtggatgttgctgcttctgccgccgattgctcagtagctttctttaaaggtaaagaaactgtggatgctgtagccagtgctgctgctgccatttctattgctccttttttttctctctcatgagactcatcatgctcaatagtatctgttttagagcctatttttgaagcttcttcagctctttttttcccttttgaaaacaataacaatgtggatgcatcatctaggagcgactgctctttggaattaggtactgacatgattcagttctcgtattttgtgaagtacgatctaaaactgttgtatatacgctttaaatcatgtttactagaaaggtcctttattactactttctgtatatagcatgtcgttgataatgatatgcatctatcatgacatagtaagatgaatgagttggttgaacaatttccagggaaacaaaggactagtttcatgtctttaatgtttttttacgaataatataccatgctataaaagtattataataaaaggtatcgactacctgtaatctagaatgataatttcatacaacgatcacttccaacggttaaataattaccaatagaccttactagaatattaaacttaacaggtttaaattttgttgaaataactgcaaaaagccagaaagaaacagatttgcactataatttttcgattgccactacttagtcaacggatttatcaatgtcatatttgccgacttattccaacgacttgccagcaggcccgcaaggccagaggaggcgtaataatggtaatgaaaacgatgcaagacaaggctacggtcagcaatctgtgccgatggtaatcaggaggcttttcaaaacgccaaagaatttagatctcgagacagccagctgggaaatgttccatttgattttccatccaagaaaagcttatagatcaatatattatcagcgacagacgaaaaatcagtgggcgagagatgatccttcctttttcatcttccaaatagccttaatttcactcagttctattatttggtcgatttataattcaggtttcaacaacgacagtgatatgggggccttgagcattataggtcattttttcaaaagtttggtaatgatggtgattttagattttttcatatttggatttattatggcaactattttttaccttttgttgaataggtcacattttaaattcaaatcgagccaaaatagtgtggtagagtgggcttattgtttcgacgttcattgtaattcatttttaatcatcctactgtgcctatacttcattcagtttttactactgcccataattaatttacaaaactggatttccttactcattggtaattcgttatattgttttgctattggccattactttattttaaccttttatggatacaaccagttgccattcttgaaaaatttgaactttatacttttaccaacattaggattatcgataatctatttaatcagtttatttggcatcgacttatccaagaaattaagcttttacaattattaagcaattgaacacggaaatagaaaaaatttggttctttaagataaagcacataaattacataatgatattattattatatatatttgaagtataaaaatgcaatgagtaataagagcaataatgacactatggaccaaaagaatgcataatgaaaactgtttatgtatcagcgtcgaatgcttataacagataaaaggaaaatacaggtaatggtgtgttcctggtcgtttttatattcccttaattgtagatttccattggagaaagtctatccgagttaaaaatccaatttctactctcaacttctttagctaaccattcggttgggaaaatgaccaaatgaccgtggatcctttccaagattctctgcgccgtatgtttgtcaaaaaccttttgattgaatccataaagcaaactaccggataacttcattctcaattcagcggcttttctcattttttccttttccctatccttatctacaacatttgtagtagtagaattaatattttcagcctctaagtcaatcaacttttcctggtttatttgaaattcttgttctaattcagtaaattctccatattctttccaattttgtacagcattatcgggttgacaatgaaacactaatttatagagtaatgtatttctcaaggctatagtgaaccatagcccttcagaaaacgaagaaataagaggatcctcgaaggaatacgggtcaatgaagttgagtttcaataactcttctttttttgcgtcatcaatttcaccactgttaaagttagtgatcttaggaattatctgagaaagtagatcgtccagtgaaccatcatctagttcttgatttttcaaaatatcttcgtgcaatctatgatattcatcgccttcgatatcttggtcgacattagtgctttctccttcattgctcttttcgtttaatggcagactattagacccatttctggtactttctgtgcttgaacttaaatgtcttctcatatctttgattttcttcaatctctgtgtttttctttcgtcgagtttatgagataaatattgcaagtagcatatccttttgagcatactccatttgtttctattggtaacagttttatccgtgagatacatttctagatctttctcattgggcaaataatttgaaaatccttctggaatttctgattttatcatttctttatcgtcaagaactttcgaggccaatgagttcaatgcccactcctttagctgttcagttgcatcggccttgaattttttgttggattcctttttccaacaatcgggaccgtagccatcaacctcttttttatgttcatcattctttcttaatcttggatcagtacttaagactttgtggtctcgtataccgacattttcaattcctgccctgtggttgaatgttagccctaaagatgcaaaattatgtttgggcagaggcgttctcttacgtgatgatttaccgtagtccacagaattgaagaatttttcataaacgttttcatcttctcttcccacttctttttcatttatgccacactgagtgcttccatcatcaacactgtttccatgaccactcttccattgagggctaaatttacaaccaaatatttcacgataacctagctcaatcatagcggaatcgatcatttctcgatcgctccaattgttaccactatctccctccttacttagggtatgaagtttttcataattctttgcagcaaacttttcaaacctttcaaatttcttttcaacaaactcaacaagatctacatcacaacctaaatgttccctcattaatcgctgccttaattcccaaggaaattttcccgcgtagtaatcgtcaccattcattttggtctttatcaagtcggtgtctctaataagaattgccacctcactatctctattacccagttgtgatctttcgttaatattagcagaccctataatacatcttctgtcatcagcaatcagaattttagcatgaacgtagagctgctcggtgattaatctttcattaggcgcaaaagtcgaccattttcttagtgaaaagaactgaatatattgagctgggtcaatatttagtttcttcagtttactaaatgtagaatgttcacctcttgaaattgattgatattggaattgcataattaaacgaagacttgaggcttctgcagtatctactggagaatcgaatcctggcattagtgggataagaataaaggctttccaaggttttttctcctgattagctttgactatcctatcaacgagagcatcaccaattttattcaaaacgcaagtcccgttccagacagttgatgtaatgaagaattgattctcaatataaataaagtgttcactttgttcaattaacttcaggtaagcattttgaattgagcattccgtttcctttagcccaagagaccagttcccagcacttctaagtatttgagtttcacaagtcgatttttcgcgtagaatttcgaacatcggcaaactcttcaattcttcagcagttaaatctgaaggcggggttagtaatggagttaacctactaggtctcttagctctcaataagtaattccatctttgaacaaaatgtcgggctaagtctcttgctggctcacccaaagtcatcatttgcacatcatgccatggcatcctcggaatgacttttctatcatacattgattcgaatggtttatctaaatcatgaaaatcagcaattctggcatttgaataatccttaccaggaaaattttgatctaataaagattctgcatcatctcgtagaacgtgttcaaaagtatcatatctaccataacataaatctgtaccaccaataaatgcaaatgtttcatcaataacgacaaacttctcgtggtgtgcccaaaaatatgtattttgtagccattgattgggagaccttatgatatgtatatttggatgtaaatttagcatagaatgcttggtccaaagactatctgtcccaacaatattccccacattcctataaatcacaataaaaattttgatacctttttctgcacaacttttcagcatacgatcaattctaaatccctggttgcctttcaccggacgtcgcaagtataattcaggggatagccaccaatcatggatatatatgacatcctttgccattaagagggcctcgcttaacgaccaaaaataatcacgcccatctaccaaaaatttgcaaaacgaatttgttcttacaggtgcgaaactaccaaatctatttggtttcgaccaaggtgttgaggtagacattttgataattgaactcatccattgctttaacgaactctctgatttgcaaataattttcagtttcctttcactgttttctagggtcaataataatagttttgaagatatattggacttcttttggtgtgttttcgattttccattcttgtctaggatattattggcatcattttcaataccgaactcttctagttcgtcatttatttctaaattgggatcatgaatgatccagttgatctcgttttcgttatcaagtatgttattcttgttcccagaaaatctaaccttaaatttccaatctattaagaatacgtctaaaggagttgtcgaagaaagatccgacacgtaagttaggtaagaatttcttaccaggaaccatttggtagtatgtctgtcgatcatgtctttaaacgcatgtttaccaaaatgagaaactctccaaccttgggccttggcagtagatctaattactaaatacccctgtttgccctggaacccactttcacgacttaataaattgcctaagggagataattcgtaaaattcaaacaatctatttgcatgaggtctcaaacataatgcaatgttcagtagtctcaaatacctttctagcctcaaatgtatcggttgggagaaatcgtcaggttcgtcaattaagtcttgtaaatgtttcattttgacgttatctatattaaactcagatatttcagaagatgataaagtttctaacgatgtaatgttgctgccattatcgttattgttattttccgatgtatgaggagctgaggctgcagaggatggtttattttctgcttttttctccattacatttctttctttaaccatttctttataatgggggaaatgcggaagttgtaacgaatgatatctgttgttatcactataaagcttgcttatagtgagttgttggaacgcgacgattttcaatttgtgatgtagtgatttgatatctttataacttcttataatagaccatttgagcctgtcttcatcaatcccatattccaagtgtattctaaataaagagttttcgttcctgctatacataaattccgccacattcgaagaaatgcttataatgctggagctccttggaatagagggtctcctatcagaattctcgccagtattgttgttgttgttaccacgatggttatggttgctattggtaatatccaaaatgttgttgtcatttttcaagggagacactcttacatctagtttagctaatagcagaggagcccttctcttcccatgttcgtctctcagaaattgcgtgcttgcgaacaatgaggccgggcatcctgccaataacgaatctaataaatcagaggctagtctttgtgtgtacaaatcttcttcgtttacttgttgatgctggtgctggttatgacgatggccgcttccagccggtgtaggagaatttacgctggatttcagtctaccaatagcagagattttcttaaaagcgtggccaaactctttcttccagccattgaactgctgttgggtgtaagctacagaagaagaacgcctttgaggggctctttcttcctctcttttagaattccgcttagaatgaacattattgttactgctatggagattgttgtagagccggtgcatattttcctcatcagaacctcgacgaggatcatgttcattagagtgcataatatggtctaatgagtggttcggtgacacatcactcaggtttctatctacaaaggatttgggcaatgcatgcttcctctccgcctccttgccgttgggagttcttcgtttttctctttgtaaactgctagtcagattgccattctcaggtaattgccgcaatacttcttggttttctaactcatctggtctcgaatttactctatctacttcttcagtcaccgatctatctgcctgaggtggagcgaagtgagttccagacgctgttgacacgttagacatcacccttgtttatctatcctaccttttcttcttgcgtacgtgcctctcaatgcgtcgtgtgaattatcagtgaccggtcgtgcctataatgtcctgctaatttcccactaaatctttccccatggcgtattcatcgttatgtttgtgtcttttgttcaacccaaagggctgtagcaatcttcacccgtttgtcgttgataacgagtttccaccttatcacttatcactagtgctaatcaaacagcaaagaatgcttgatagaaaccgatcctgggcttatctcgctgcattgtggcggcatccctggactgtaatcagcaagtgttgcttagtatatatatacatccagcgtcagcttgaatttggatacagttactgttttttcgattttctcttggttattctttctgagacagtagtaattttgtattactgagcgggatattgtttatctgccgtcatactatattacattatattatatcatattatatataagagaatggtgcttagtgattcgttgaagctgccctcgcctacactttcagctgctgctggagtggatgattgtgacggagaggaccaccccacgtgccagaattgtttcactgtcaaaacgcccctatggagaagagatgaacacggtactgttctctgtaatgcatgtggcctcttcctgaagttgcacggggaaccaaggcctatcagcttgaagacggacaccattaagtcaagaaataggaaaaagctgaataacaacaatgtgaacactaatgccaatacccattctaacgacccaaataaaatattcaagagaaagaagagactgcttacaactggtggtggttcattacctacgaataatccgaaggtttctattctggaaaagtttatggtgagcgggtccattaagccactgttaaaaccaaaggaaaccgttcccaacacaaaggagtgctccacgcagcggggaaaattttctttggacccctgcgaacctagtgggaaaaactacctctatcagatcaacggttcagatatatacacgtcaaatatagagctgacaaggctgcctaatttgtcaacattattagaaccctcacctttttcagattccgctgtaccagaaatagaactaacttggaagctacataatgaggaggaggtaatcaaattgaagaccaagataagcgaattggagttggtgacagacctatacaaaaagcacatattccaactgaacgaaaaatgcaagcaactggaagtggaactacactccagagcttcagtacaatctcacccacaacattaagaaaggatgtagcgttcatgacagtataaatataacaggatatagtatataaaatttaatatgatttagtgacacttatttttacgcgaacgggtaacacactgccatttatctggtgctggaaaattgcccctaaagaaatgataagaatgaaaacgaatcaatgtgaaagcagtttgatgagatgtgagctactttgaaagtataggaagtcagacatcgcactgagaaatgtcacgtaattctgcagcaggtttggaaaacactcttttccaactaaagtttacatcaaaacaattacaaaagcaagccaataaagcctcaaaggaagaaaaacaggaaactaataagctcaaacgtgctcttaatgaaaatgaagatatatctcgtatatatgcatccaatgctataagaaagaaaaatgaaagattacaactgttgaagttggcatcacgggtggattcggtcgcatcaagggtacaaaccgccgtcacgatgaggcaggtgtcagcatcaatggggcaagtttgcaaaggcatggataaggcgttacagaatatgaacctccaacagataaccatgataatggacaagttcgaacagcaattcgaagatttggacaccagtgttaacgtatatgaagatatgggtgtgaattcggatgccatgctggtggacaacgataaggtggatgaactaatgagcaaagttgctgacgaaaatggcatggaattgaagcaaagtgcaaaactggacaatgttccggagataaaggcgaaagaggttaatgttgacgacgaaaaggaagacaaacttgcacaaagactaagagcattgaggggctgaaaaaacatgctaacaggtcatgcatttttagttcatcattacgtttccagctatgttatgtatgtatgaccacatatgctgtacataaattgtatactaaaatcaataaaaaaagtataactctttttatatataatctttttccttcctaaagtgtccatacattgatgtctccatcgttgtgcccattgatcagaaatccgtctttatacttgacaatagcaattcttctgctcagctcatccccatctagtgaatgcggtggttcaggagtcatccaatgctcatcgcgctccatgttaaagacattaacccctccctcgtttgcgccaacagtgattaatttaccatcgaaatctaaggacgatactggtaaatcgtaagcaatcacgtcaagaattgagcttgtcctcaaatcccaaatccttacgctattgtccatcgagcctgttaccaatttttcggaatcaaacttcaaacttgtaattccatcggtatggccttctagtaatctcaccggtttgccaactcttagatcccatagtcgcacaatgccatcttttgttcctgttgctaatgcagagttgtaacattggagggctcctatcattggtgcttctgtgccaagtaaacatgcaccattgtttaatgaacgtgcaggcattttaatgtcgctatgtgtaggtgtgaagataaggtcaagttgctgaatacatttgcccgtcgttaaatcccagtggaatatttttttgtccctagatccgctaaccaaagcttcagaatcaaaagacagggctgtgatttcgtctttatgtaactcaaaattatggatacatggtgtaacaatttcttctgtcttctccttcaatggactatggtccaaatatatttctctactcagatttaagtcccataacttcagagtggcatccttacttccagtaatcaacatattgtaatttttcttatctatttgcatgcaattaacagtagcaaggtgaccaggcagctctccaacttgtatcccatggttcaaatcccacacttttactatacgatcttggtagcttgatgagcacaaggttccccatggtgtatcaaagtctaatgcggttatgctgtttccatgttcgccatggggtattgtcattctgaaagccgtggtatttcggctatatgtttctgagataatttgcctgtttttatcgtggcttttttcatggggcatcttgtaaaaatcttttaatctcgtatccttactttcaacatcacataacgacgatatggcttcttcattttgcgtgaaggacgacgcttcagatgatctttcttcttccatttgcttccgtaagctctgttcacgatcagcttccaaattgtattcctcgataaaatttattctatcctttatcagtgttacatcattctcaagattggtagacttactatcaatgtgcttaaccctttccaggatttttaatttcctggattctagttcgttgatcatggaatctaatctggtcaactcatccatctctaacgttttattgattgacagattttccacgttagtttctacatcctcaagtaaatgtgttaggtcaattctagagtacgttttattcacaaaaccagtattaatatccggcaattgaacgtatttttccttatcactattcgtggccccgtctacattgtctaacaacagtctctgttgaatgatggaaacggtagctttgaatccttcaaataaagaaggtaaattcttttcagcggcaccgttgggtagcgggtatccgtgctcatctaaatgagcaagtattctgaaagttgttgcagagtctgcataattgttttgaaaggaaaatatccctacttgtcctttctgggtatcttttgtactttcgggccaagccacctctctgaacagtagaagtttggaaagatatctgtagatggggctcgttatatatttttgaaattgttgttgcgctagtatggcatgtggtagcttattaagtataatttcgattggtttagctaccagagagctttctcctctagtatcgcccgaacccatatagagatactcttttttactctcgctcgtggtaatcttatatgtcattcatggttagttttttttttatgactattttttttttccattacgatgaggaaagtttatgtgagaaacatgaagctacatgctttaacaggagacagacccatggtggatccgctcagttggttttatacatttagatgtaaggtaatacataattatatgatttgcagtggcctatgtatgcaattaggacaaaggaaatatctattcttgaggagaagtgctcccctactcttgcaagttggctatctccatttctagccgcctaatttcatctttttcttttcgaataatcttagcaacgtcgtgagaagaagaaggatggtactgtgacatagtctttaagcgatcatcttgaagcaaaacttctttcttgatgaagcgcaatttggaagaaagttgttcataattatggtacaattggtcgtaatcctgcttgaactctgttagtggccataaatctgttacttcggccataactttaagaattaaatcagtagggaaatcctcgacaaagatggtttttcttctttggttattggattcttcttccatgagcacgcttccattttccaaggcatataggagcctttgaatttgcggatcatccttgaacacggctgataatgctttgaatgtacctgaacttgaatttgaaatgacagaggatcctataagatcggtatcaaaaataaaaccgttcaagccaccgccacttgtagtggcggttcttctccttttattgttcaaatcaagacgatctttgttcaaatatacttccttgggcacatggatgatcggtttttcccctggtctgcccagccttctatttcttttcatgtccgtatctcgtttaataacatagtcgaatactccctccttgccgtctctacgtgaaacggattgtttctcagggttgactttgaacagaagatacgcctcgtcgtggttacagtcctttattagtctagtaatgtcttttctaatgcttgccttgttgcttgctccctgtaggatggcattatgaaaaattcctggtggcttgaaatagagtgtggacatagagtccaccgccctattaatatcatctatacatctatccaagctttcccccattctgtaattgccacgtcttattttgttaggtgatgatctaatttttttgagctttgtttattgattattttcaaatgtctcttgcttattttcgcgcttccacaaggttatacactgagctgtaaatgtaaggtgtatggcatatataaatatatatatatattcgtagtgtgaacattaggctaactgtaacaaaaatcgttaatcacgccaggctgcgtatacttcatcggttctgaatttctgcgtaacaacagtttcagaaaagtccttcacgatcccacccattctatactctagtagtcctgcttgggcaatcataactccgttatcgatacaaaacctattatctgtagcatgtacttgcccattggccctgtctttacacatttgcgccatcatttcttgtaatcgcacgttacaaccaacaccgcctacgatcaaaacttgattggagttaacgtgagccatagctctttctgttatttcaactagcatggcgaataggttctcttgcagagagtagcaaagatcctctacagtgactttttgctcgcccgttgtcttgtcgaataggatcttatttttcttattgcccttaaatagatccttggcaagtaaatcgatggaagccaatataccactcatcgaaagatccatcccctttactgtatagggaagttctaccaagttttctttgtgaggggcttttttagctaactgctcgatgttgtagccaggcgagggctcattaggtatcttcagagttcttgcaaatctatcaagacaattaccgatagcaatatcaagcgtttcaccaaagatacggtaccttttttccgagtatgcaataacttgtgtatttccaccacttacatacagtaccacaggattttgagctttagtgatttctctccccatttcgatgtgaccaatgcagtggtttactcccaccagtggcacgtcccacagtaaggagcacgttctggcggcgatgacaactgaatgcagaggggcccccatgccgggacctttggtaaagcaaattacatcaatgtctagtgtcgggcttttgatgtcagcttcggccagtgcttgttttatgagtcttatgcaccaatttctgtgatgccttgccgtgtctcgaggcaaaaatccctccccaggaggtgtgacatatgtgtctctaatattagaaagcatctcagcttcgcaatcataagatagatcgctgttggcatgtttaggcagaagcggatgcttaactataccaacgcccagtttatttgcagaaccttcaagtccaagcgcaatgtagtagtccctgccatttttgggtgggatagtgttcaagttgaccattttgctcccgactgcattagggaacgcttgggaattcccttcacgtaaaagataaatatatgcatcgttgcacgaagtaaaaatggttactctcgaactcatcataatgaaagaattcagtttttccgtataaagcgatattacaggaggaataaaaagcaaaataaaaaatctccgcgacggggaattgaaccccgatctggcacgcgacaagcgcccattctgaccattaaactatcacggaacgttatttgttggattttttctcttagttttaaatatttatatttcgtcgaattggtacctctacagctcagaagcagatgtcttcaagtttttttattgtgtctaaataagaatcaaccattatcttgacaaatgggtgaattttaagataattgttgggatgccattgatgataaagactataatatacatacacagaatatactagaaattgtactcgagcacataggaatcctcaaaatggaatcgatatttctacataataatactacgattattttctgctttcgttttatatgtttcattatcctattatattatcaatccttgcatttcagctttcattagattgatgactatttttcaaccttatgtcctcttcttacaccgcatatgatagtatactagcaatatgaatattactaaacagatgatatttcaacatcatgttttgcttagtagactcttgcgggcgttccatccgtgtgaaatacatcatttacacctcgctctgggtcaagtaatcaaaaaatacctcgtcgaatatcttcgacaaatctgtcgcttggtttatgtttgacctgatgtatataaaatcatcactacccaatttagagaacacattgcgttgcccggccggcaaaaaatcctgggccaaaagttaaaagaaactttctcatactcactctgaagttgtactattacgaagcactaaagcattgatagataaatcaacacagaacatacatgattaaattagacacagctctctgtattttttactgtttgaactaaggttctaatacttacacattcttttcaacccatcagatggtgtcttgcccctgcttacgtaacctacaacaatagattagacacaccagtgccaaggacaatatgttgcgttctgactagtcgaagtatcattacgctgtgcagatcgacctgacaccagacacaaaggagaataggggcagcatgagttccgtcggcgactcattccgaccttccacaggtccgttgattactttttcactgatccggtggaatctatggttgtttttttcatcatgatatctgttttaggactttttttttcagccgatcgcttatctgctcactagaatcgtaatcagtgatatttttattaataattattatttatttttttttataccatttccttttgataaggggtcgttggtgccgtgccgctatcaggcagcctcactaatctacccattgacctcatgcagcaaagtcacatcgcccatatctctcgagtgcgataacggggaacttgatttggtaactgataagattgttaaatgtcagtttggatgctttttcttacgtccgattagcttatcttctggagcaaccggccatttacctcctcatagtaaattaaacatgataagcgcatagttggggcaacacacctttcttccggaattcgctctggatgagacatataaagatgaaggtgaagtccacttaaatgaatgtcaatgagacgatgttttttctcctagattgatttttgaattccttgtatacaaagtcttgttttcttattgtcctcaacaaaacaaaagtagaaaagaacagaccaaggacagcaacatttataagaaacaaaaaaaagaaataaaaaatgagtaatacttcttcgtacgagaagaataatccagataatctgaaacacaatggtattaccatagattctgagtttctaactcaggagccaataaccattccctcaaatggctccgctgtttctattgacgaaacaggttcagggtccaaatggcaagactttaaagattctttcaaaagggtaaaacctattgaagttgatcctaatctttcagaagctgaaaaagtggctatcatcactgcccaaactccattgaagcaccacttgaagaatagacatttgcaaatgattgccatcggtggtgccatcggtactggtctgctggttgggtcaggtactgcactaagaacaggtggtcccgcttcgctactgattggatgggggtctacaggtaccatgatttacgctatggttatggctctgggtgagttggctgttatcttccctatttcgggtgggttcaccacgtacgctaccagatttattgatgagtcctttggttacgctaataatttcaattatatgttacaatggttggttgtgctaccattggaaattgtctctgcatctattactgtaaatttctggggtacagatccaaagtatagagatgggtttgttgcgttgttttggcttgcaattgttatcatcaatatgtttggtgtcaaaggttatggtgaagcagaattcgtcttttcatttatcaaggtcatcactgttgttgggttcatcatcttaggtatcattctaaactgtggtggtggtccaacaggtggttacattgggggcaagtactggcatgatcctggtgcctttgctggtgacactccaggtgctaaattcaaaggtgtttgttctgtcttcgtcaccgctgccttttcttttgccggttcagaattggttggtcttgctgccagtgaatccgtagagcctagaaagtccgttcctaaggctgctaaacaagttttctggagaatcaccctattttatattctgtcgctattaatgattggtcttttagtcccatacaacgataaaagtttgattggtgcctcctctgtggatgctgctgcttcacccttcgtcattgccattaagactcacggtatcaagggtttgccaagtgttgtcaacgtcgttatcttgattgccgtgttatctgtcggtaactctgccatttatgcatgttccagaacaatggttgccctagctgaacagagatttctgccagaaatcttttcctacgttgaccgtaagggtagaccattggtgggaattgctgtcacatctgcattcggtcttattgcgtttgttgccgcctccaaaaaggaaggtgaagttttcaactggttactagccttgtctgggttgtcatctctattcacatggggtggtatctgtatttgtcacattcgtttcagaaaggcattggccgcccaaggaagaggcttggatgaattgtctttcaagtctcctaccggtgtttggggttcctactgggggttatttatggttattattatgttcattgcccaattctacgttgctgtattccccgtgggagattctccaagtgcggaaggtttcttcgaagcttatctatccttcccacttgttatggttatgtacatcggacacaagatctataagaggaattggaagcttttcatcccagcagaaaagatggacattgatacgggtagaagagaagtcgatttagatttgttgaaacaagaaattgcagaagaaaaggcaattatggccacaaagccaagatggtatagaatctggaatttctggtgttaatgaatcgaacaacgacaaaaaaagactttattttttagataatcataataaatatatttattttctcgtcattaatctaaagaaaaaagggaaatgtttatagtcaaaaattgtatatttccgtgcactaataagataaattatactatgaaagaaagtaaggtatttctatttttttactttttgttattttatttatgtttttctaggaaatgtaaaaataaatcttttagtagacagcgagatgaaaactaatctgtgtgagcttcaatcaatcaatatgatttccccgcattttgtttgatattttaattgattccgattaaatccgctggtagcagttttgtttcaaactaattcagcctccttactccccatttccttattgaactttggggattcggagttcctttttttttccgccactccgataactaaactttgcagtttcactgcttgttaaacattttcctactataaatgacatttaaaacgtaattgagacaaaaaaagttaaatcgttattaactttcactgcggctccgctcttttcctcataaggaaatcccctcttatgatcttgagaaatgggggaatgttgagataattgttgggattccattgttgataaaggctataatattaggtatacagaatatactagaagttctcctcaaggatataggaatcctcaaaatggaatctatatttctacatactaatattacgattattcctcattccgttttatatgtttcattatcctattacattatcaatccttgcacttcagcttcctctaacttcgatgacagcttctcataacttatgtcatcatcttaacaccgtatatgataatatattgataatataactattagttgatagacgatagtggatttttattccaacagatcttgatataagccctgtcattgattgcaaatgcacaaattccggagattgaacagccaacacaaagatagtatttgggacttagcgggttgagaacggtaattatatcatgaatactccactccaagcttgtttgatacatcacattcttgtaaaaatatatgatccaattcctaggacatcagaaaatatatctactatgggcgtgtggcgtagtcggtagcgcgctcccttagcatgggagaggtctccggttcgattccggactcgtccattttaaaatttctttttttttttttctctttccgtatgtaagcttttttccttttttttttttttttttttttttttttcttcactacttttcaatgaaactctcttcaaaagacagcatgcagtaaaagcgccgatatgagtgacgacgattatatgaacagcgatgacgacaacgacgccgaaaaaagatacgtaaggccaattttcgtcagaaagcgcaggagagaagaagactacgttgcaactagcaaagacaacatccaccaccacccatgcgattggtccgcgaaaccatcgcaacgtcaaaacgaaaatgagcaaaaaagcaccatacggcttgtaccagtggcgatgaatacgccgaagtgtcaagagaaaaaaaagaaaagaaagggcgttggtacaactagtcatgaggctacgcttttcgagtacggtgaaagcatagcaggctacaagtgtgttacaaccgagagcgaaagagaccgcttgaaacgaagtcatgaaagcgaaagcagcagtgaaagcgaggtagacgttttcgcctttgaccaggcaaaaggtatcagctctaaggttgaagccgaagaacgctacgcgcgggccgttcgacagtattggcgcatgaccaaagacgagccggctaccttaccactgccaggcacacctaccctagcggctgtgagtttagatatgattgatgacaaaagcgtagaacaattttacacaatgagcagtgccttgatggatgcaaacagactagacttgattcgccgcgatagaatccggtggcacccggacaaacatcgttatcataagtccaaagtcacaaaactgtttcaggccattaacggcctgtgggagcaagaaaagaccgagaaaaggtaatgaaaaagtggaactagaccccacgtcagcgggcctaggcccttcaatgtgttagaatacacagcgtgcctagttcctggtgcctggatctcgaggccgcggcactggaaaagccctttcttttccagatcgggaaacctaatgagtccataaaaagaaatgtagaggtggtgttgacgttttgccgcttttgggcaagtaggtctttctgcacggcccggcccgggtcgtgcggaaaaagaaaaaagcagacaaaacaaaatttttcctttttttcgcctttgtttctcctgattcgggtatataagtgaataccatctaatgtgtttccttctcgagacctcggcgtctcccagatcaaagctcagcaaagattttaaaccgcaatttacgctcctttcatcggtaactaagaagaaaaaaaaaaaagtacgaccacacaatttccagtgtattcattccttaaacttcgtttattttttattcattcattcatttttatttgaatataaccaactactagtccttcctttaaacaaaaatttaccctcccttaatttttcaagaaattccagtatgaaattatccgctctattagctttatcagcctccaccgccgtcttggccgctccagctgtccaccatagtgacaaccaccaccacaacgacaagcgtgccgttgtcaccgttactcagtacgtcaacgcagacggcgctgttgttattccagctgccaccaccgctacctcggcggctgctgatggaaaggtcgagtctgttgctgctgccaccactactttgtcctcgactgccgccgccgctactacctctgccgccgcctcttcttcctcctcttcctcttcctcctcttcctcttcttcctctgttggttctggagattttgaagatggtaccatttcctgttctgatttcccatccggacaaggtgctgtctccttggactggttaggtctaggcggctgggcttccatcatggacatgaacggtaacaccgccacctcttgtcaagacggatactactgttcttacgcttgttctccaggttacgctaagacccaatggccttctgaacaaccttccgatggtagatccgttggtggtttatactgtaagaacggtaaattataccgttccaacaccgacactaacagtttgtgtgtagaaggtcaaggctctgctcaagctgttaacaaggtctccggctccattgctatctgtggtaccgattatccaggttctgaaaacatggtcgttcctaccgtagttggcgctggttcctcccaaccaatcaacgtcatcaaggaggactcctactatcaatggcaaggtaagaagacctctgcccaatactacgttaacaacgctggtgtctctgtggaagatggttgtatctggggtactgagggttccggtgtcggtaactgggccccagttgtcttgggtgctggttacactgatggtatcacttacttgtccatcattccaaacccaaacaacaaagaagcaccaaactttaacatcaagatcgttgccaccgatggctctaccgtcaatggtgcttgctcttacgaaaatggtgtctactctggctctggctctgacggttgtactgtttcagttacttctggttctgctaactttgtcttctactaggccttttttccttgaatattgcaaataagcttttgctagtactttttttactccgttcattttatggtttatttttcaattagttcgtttttccacaatacaaaaaaacacagtcctttgtactatcccttttatttcattattttttcttttttaagataccactagatattatcatatatagcatattatataacataaaaagtcaagaaaaaaaatgtttttatcactttctataactgcatatctttttttgcatttcgaatgattgcttacacatcgccatgctgggattcctcctctggtggtgagacaaatggacctgctaattccaatgcaggttcgtcaatgttgtggtgagcgtatgacaaaacaccaatcccaccggcgtccagtaagaaacatggattgtctaccaaatgtctgtaagattccaatttcacatatggaactgtgtcgtcatcataagatttgacattttgaatttcttcaatcgtctcacacttcttttgcacacccagtccaaaccaaatagcagcaaaataacgcaatgcatgtccgtgcgcaaagaccatgatgtctgatgctctgccctcactctggtgcttgcggtgcaagttctggattctggcaatagcgcgggaaagtctcaacccaatttgctgagtagtctcaccgttctcacacccatctctccagatattccatggcctctccttgtccaaaccgcgtgactttctcaattcaatgatttctcgagtcagcattccctcgtagtcaccgtactcccactctcgcaagtcgtcgtctaccaccacacggatcttagctctttgctcgtcgcttaatggtttcaaaaccaaatccacagtttgcctggcacgcaaacgtggagaggtgaagatataagtgatgttgtctggattcaaaaactgattattgcggaaaacactctcaccggtcctcaacatttggccctcaccgtagggcgttaacggtagatctgtcaaaccagtatactggcctgacttggaccattcagtttgaccgtgtctgacaatgatacatctgggggttagcgaaggcattgttgcttgcaattaagtgtaggtgtttccctatccacttagctatgaacaaaatgtgcttatctgagctaatattttttcatttttgtcctataaataataatggaaaaaaaaaactcatcgcgtggttgaacagaaaaaaaacaataagagtgagtaagcagtgaaaaatgtaagatttacgctttatataagcagattttggtttcctttatatatttttgcatttgtctatccttaacattggatagcaatttggcggtgggtagtttataacgtgtgtgctctctctttaagtaacgatgtcaagagatgtaagggcagagaaactagccatatcactattgattttatcattgtttctaatattccaattagtggctgagatttatctcaataatggtgatcagtaccatacagagactagcccctttacaagaggaagatcacatgtaacgcgtgtgcccaaccatgatgctagtttatctataccgtttttggacaagatcaaccagttttggcatgtaggcggtgccacgcaaattaggaatattcagtcgatcaaattgactcaggaccgtgatcaagataaacatggattagtattgtccaatggaattggcgacaacaccatcaatgactttgagattgttttcactttcagaatttctcacgaccccactacacaactcactggtgatggaatgtgttttgccattacgcccgaaaatgggtttctcacacagaatttacagtcgtcgtatgcgaaaaagcaatacatgatgaattctcagggcgtcatagccgataatacagatctgatgggcttcccgaaaaatctgcctggcctatttattgtcttggatacgtatcgcaaccaaggccacgaccataaggaggtaccctttatggatgtgtttataaatgtggccccagaaagcgattggtacgatataaatagtgatggtgaactcagtacatcgctgcggcttaattcaagaggccacataaaactcaagaaaaatgccctgtggaatcgagtcacgaaactaagaataatatatttggaaagtataagcttcctgaagatcgacgtgcagtacgcaaaagagggaaactactggattgagttatttcaaacaaccgaaaatctgtacttgccgaaaaacatgcacacggggcaaagatacattggctgtagcgcattaaatggccaattaacggagacagtggagctgctggacgtatccactagcgaattccattggaacgacatggatgcgtccattgaggacacctatgattacgcaaaggaagctgagctattcctggagcaggaatttggcgaggtccttgacagggaacccgatgagttcaccaaatggaaaatgatcaaagctcaaccaaacatcaagactgggtcacagtcagctgaacagaaaacttcaaacaatcctcactctcggttgttcaaggtcgtgctgaccatatggcattatagcgagattttgctattgatcatgggcatttatcttttttctgcttgcataagagttttccaaagaaggttcaaaaaaattagatccagaagaaaaagggcaggctcgcattctgtggggctattgcccatgtagcattgcataggcacgcacatacatacatacacaaataatacaatataggacgttcatcttaggtagccaattcacggtcttcttgtggtagtgttacttgcgttcgacggcgggagggttcttgatcgatccaatatactctgtggtgggatggccagaacgctagaattcgtctcaaacgtcctgttagagaatattgtgggcctcgtagactgtattgaatgaatgtccgagaaagtagacgacttcactgacgaggaacaaaacgatactagcggaataacacttgcgttgtcgttttgttgttgctgctgttgctgctgctgctgtcttactttgcctgttggtggttcatcccatgccactcgacggtctccttcgtcatcggattcgctcgaatgcaacgaatttcgatcaaccaatggtcgcaacgacgaactgatggttgttccatccggatccaactcagcacgcttaactcttgtggggccagccctagtgccgcgtcttggtttactgctcgagaccgatgcgttagttgtggtagtggtgtttattatttttttaacccacactgaaagtttgtttcttcttccctgggatgtatgatgactgtttgacatgctaggactttcccttggcaccatgtatattcacttttattgtctcttgatcgagctataaccaaatttttttttttttttttttttttcgtttttataattttttctttggtattcaattgtatatagtgctcaaacagcaacgtacataatagctagcaaacaatagatgaaataatagaataataacaaataactatataagagtggcaggaaaaaaaatcaggcgcacgattagcgcaaaaccaaattactaattggtcgacacagccgcgggcttagaattggtttggtcttctcttgaggcctttagcttctcaatggtggcattgcccaagtccaacccggtggatacaatggctttagggacgctttcagatttacttagattgttttcatagacagtggtgaagcgttggtaggtttcgttaagcttagtctttgttgggtcgatgtacacagactgcaacttgtcagttgtgggcttcactatggcgtcgtacttttctttagccaggtccttggttgggtcgatatagttcgacttgaccttggactggatctcctgcgacatacctctggtcgttgaagacaactctgccacgtggggcaaagaagaagcatcagtgaccttgttctcctcaccggaagagccgatctccttcgatgcggtagaaccttgcaagtgcaatggcttgatcaggaactccctcaacagagtattagaaatgttggcgacgtagtcgacgaagaaccacaccagccagatccctggcgtgttggaatgtgatttccaattgtacagcaagccgtcgacaccctccttgaacaccaagaggttaactaactcgtccaacttgaaggccccttccttcccagcagcaacaacttgcttcaccagacgaggagagctggacgattcggaaacccactggttcacagatcccaaaacaacgaggttgaaggaaatcaatctctccacaggtggcagagattccgcatatttaataaacttggataaagctgggtatctttgcagatgcgaccaggttgcttgtggcaattccacagatggtttagaagaagaaatagatgattcagacataattacgctacggttctggagagtgagtgatggttaatgattaccgatacattccgttatctttccttttataacccttgctgctatattattaaatccgaaagaatacgatcatcccccacggcggagaaaatctaggctattattatcattattattattattattgtcgtcttagttacatgcgctttaacatatatttcagcttacacacttacatgtatatacatatatatatctatatatgtatgtatacatatgtatataaatatatgaatacggttatgaccactcttgcgaagtgcgttgggattatgactgcttgcattcaggagcctgttccggcctgccagcaaaatcgtcttgctcttcggcagattccccgtcgtcatcctccaagccgtgatcatcatcttcttcttcgtcttcgtcctcgtccgcttcttcttcgtcctcctcgaactcgaattccaaggctgcgccggtaaaccagtccacggctctaggaattagcttgtccttaagttgttccccgatggagtagtctaaagctagacgttcctcgaggtcttcctccaactcctcgtcttggtcttcgttttggatcttgggagggtcgaagaagttgaaaaaggattctatgggagtgatcttctcgatggtcctcacctgcttggtggtcttgtttctctgcttgcgcatttctaggtccacagtgacgttgtgggcgttgtccttccaactgatctcgcagccttctgcgtggtcgtagataaagtccccggagtaaccgagctccttctggtagaagtaggtcttgcacagaatgtcgttggtgaagaatgggttggcggaagaatcaaatctgaacaacagcttgaaaccgggtctaccatccgtcaagtattccagaccaatatcttgcaggtactccagaacttccgcatcgcggtcagtgatcgtgtcgcaaacgatgggcaagttctctaatgcggttagccagaatgagggaattcccttcacctgttcctcctcggaatcattttgggccttctcttcttcgtccaccaacaactccgtctcattgagtgactccacaatctcttggccctttgcgatctgttccggcttgggttgctcttgtcctgaaatgatcctggaccgctgctcccaaatgggcttgtacttctgcagaaacttgttctctagctcaaacatctccacctgaaattccttttcaacttcgaatagctcgctttgtaaagtcttcaagctcagcagcttttccttaacgttcttgggaagaccccccacatacccgctgtcctggcccaccagcgagccaagtctgtcctggatggactgtaacaacaggggttggttagccaagatgtcctcctcgttgatggtgccgatcttgtcatcctgctcctgtgcctgggccctaactgggttgccgtttttcaaatagctcggattcagaaccgatgctggggtattgtgaggcgtaggggcgttgtcgatttgcatcgacgacttgggtttcgttctgatagggtctgacatgatcttgcgctttgctcttggtcccactgggctcactaaatcctcctaatctaccatcaaactgccatttttgatcccaaacgctgctatttaaaaggaaaaattttcccaattacgcgggtaatacaaaaaagatatagcccattgttataaaaatatgtatgtgttcaatatagtggtatataggtgttatttgcgctgaatgatgtacttgtcaatgtctgcgggctcatttcccaccaacttgttttcccagtcgacccaaagcgcctcctttggattccaaagtcccctctggacacacttctgcaggtccatcccgaacgtcgggtctgtgtgcttgtatttgagcactgaatccagctttggaatctgcctttgcaacgaaactgggccttgcgggcacgaagttctcatgtattgcagctggtcccacgtgggaaagcggttggcgatttccacgtcgaatcgatgagagacgtctcccttcagcaactgcaggcatttctgcgacttgatattggacgcgatgtcattggtaaacaacgagatggtacgtggctgtctctgcaatgttttccaaaacgacatttattgcgtttgcgtttgcgatctcccggtctgttattttcatttgcacttttcttaacgttctcttttggttttatatgcccctttccaagctgggtggataccccgtccattgagtgcccgtgcccaatcaagctaaagccagactaaaaagaggaagagttcaagaaccatcaatgcctccagcacaatttcacaacagcttgacactttggcaacggttatatcagagcatagcgacgggattagagagatgcaagacgacggaagaaagaagggagtgcccggcatgcgctgaaagcgccctgtagtacaagcgtaccgccgttgaataggccatggtacatcacacgatgattgataatttgatgcaagctgccatgctcagatggttgtttcccgtttctctctttcacttttgatctcctgcgaagaataggatgagatgtgaattttcgtttctaatcccctcggccgtgcggctgaaaaagagaaatgatattggaataactaggtttcagatgatgagaaaagaggctattttgtactattcaccgacgataagaggctgtaagaaccactcatgccaacagctaagaggacgtcatccagggcttcgttggcactgcccttccagttacggttggtgcacaagaaatcatggggccatcggctaagagacttcatttccgggttcttaaaatcatgcagacccattgctaaatacgttttccccaacttcatcgtggtgcactatatctacctgatcacgctgtcgattatcgggtccattctgttatatccgtgcaagaacacggcgttcatcgatgtgctatttctggctgctggagcgtctacacagggcgggctggccaccaagagcactaacgatttcaacctgtaccagcagatagtggtgtacgtcattacattgctgtccacgcctatacttattcatgggtttttggcctttgtcaggctgtattggtttgaaaggtacttcgacaacattagggatatctccaaacagaattttaaactaagaaggaccatgacgttgcaacaaagggaactatcgggcagcagtggcaatgccgctcgaagtaggagtttcaaggacaacctgttccgtgggaagtttgtttccagagaagacccacgacaatccgcttcagatgtgccgatggactctcctgacacgtccgcattgtcctcaatctcaccgttgaatgtttcctcctctaaggaggaatccagtgacacgcaaagctcgcctccaaacttctcaagtaagcgccaaccctcagacgttgacccaagagacatttacaaatcgataatgatgctacaaaaacaacaagagaagagcaacgcaaactccacggattctttttcgagcgagaccaatggacccgctttcattgtgcaggaacgtcatgagagaagagccccccactgctcactgaaacgccattctgtcctgccatcttctcaggaattgaacaagctagcccagacgaaaagtttccagaaattgcttggcttgcggagagatgaaggtgaccatgactactttgacggtgctcctcacaaatatatggtcaccaagaagaaaaaaatatctagaacgcaatcatgtaacatcccaacgtatactgcttcaccgagtcctaaaacctcaggccaagtagttgaaaatcatagaaacttggccaagtcggcgccttcatcttttgttgatgaggagatgagcttttcaccgcaagagtctttgaatttacagttccaagcgcacccgcccaaaccaaaacgacgtgaaggtgatataggccaccccttcaccagaacaatgagcaccaactatctatcgtggcagccaacctttggcagaaactccgtcttcattggactcacaaagcaacaaaaggaggaactcggcggtgtcgaatatcgtgctttgagattgctgtgctgcattctcatggtatactacatcggattcaacattttggcgtttgtgaccatcgttccatgggcctgtacgaggcaccactactcagagattattagacgaaatggagtttctccaacctggtgggggtttttcactgcaatgagtgcattcagcaacttgggtctgtctttgaccgctgattcaatggtttcctttgatactgcgccgtatccgctgattttcatgatgttcttcatcatcataggcaatacaggcttcccaattatgttacgatttatcatttggatcatgttcaagacctcgagagacctatctcagtttaaggaaagtcttgggtttctcttggatcatccgcgcaggtgttttacgttgctgttccccagcggccccacatggtggctgtttacaactttagtcgtcttaaacgctacggattggattcttttcataattctggatttcaactccgctgtagtaaggcaggttgctaaaggttatcgagctctcatgggcctcttccagtctgtatgcacaagaactgctggattcaacgttgttgacttaagtaaattacacccgtccattcaggtgtcttatatgctaatgatgtacgtttcggtcctgccgctggcgatttccattagaagaacgaatgtttatgaggagcaatcgttgggactatacgatagtggacaagatgacgaaaatatcacccacgaagacgatataaaggaaacagaccatgatggcgaatccgaagagcgagacactgtatctacaaagtccaagccgaagaaacagtccccaaaatcgtttgttggtgctcatttgaggaggcaactctcttttgatttatggtacctattccttggattatttataatatgcatatgcgagggcagaaaaatcgaagacgttaataaacctgatttcaatgtctttgctatattgtttgaagttgttagcgcttatggtacagtgggtttgtcattgggttacccaaacaccaacacatcactatctgcccagttcaccgtattatcgaagctagtcataattgccatgctaataagaggaagaaatagaggtttaccatacactttggatcgtgccatcatgctgccaagtgacaaactggaacaaattgatcgtttacaagatatgaaagctaagggtaagttgttagccaaagttggtgaggatccaatgactacttacgtcaaaaagagatcccacaaactgaaaaaaatagcaacaaagttttgggggaagcattaaaatcaagtttacccctctttacctacataagagccaacgtaattttctctcagtattatatgtattatctccgaagtttattattctttaacgaaatataaaagaaaaataagaaagattaagaccctaaaaggtgtaccactacgattcaacaagcacaacgaatcctatccgtaatatacttttgatttctgactattctagaaaaattttagttcattttttttccctctttttacttattgtatttttcacaattgaattgcattttgtcccctacgaaaaaaggcagaaaacgagatctaaaccactttcagatcagaataataataataataataaccaaccaaagccatcaacaggtccactagaagcatctgccaagttacgacctaagcaaaggtttgagtgaaaagtgaattgcgacagtacaatcacaaaagtatagaaacataattgttatggaaaacaaactactttgttggtggttgtactggccatgcgtgtattcatctattatagctaccataatatctttttacaccataactagacacttattaaattaccgtaaaccatatgaacaaagactatccatacggatactattgctcgtgcccatttttagtgtgtcatgcgcaagtggcataattaagcctgaagcagctcaattttatgtcgatcctatcagagaattttatgaagcattcgttatttacacttttttcacatttttaacactactactaggaggcgagaggaacatcattactgttttaagcttaaatcacgcccccacaagacatccgataccgctaataggtaaaatttgcaaaccgatagacttatctgatccttttgattttctttttgtcaaaaaaggcatattacagtatgtttggttcaaaccattttattgttttggtacattgatatgcagtgcatggaagctacccaaattcgaaatatttttgaacgttttttataatatttcagtgacttggtcactgtatagtttagcactattttggaagtgtctctatccggaattaactccttataaaccatggttgaaatttttatgtgtcaaattgattatttttgcctcttattggcagagcatcataatccagggtctagtggttactggaaagttgggtacgggaaaccaagatcgaacctctggatatgtgtacaagaatgggctcctgtgtatagagatggtgcctttcgccatcttgcatgcagtagctttcccttggaacaaatacacagcatttagcataccttatggggccaggatgaaattcatttacgctttgaaagattttcttggttgcggtgatctaatatgggattttaaacagactttgtttgctggtcccttgtactataattataggaacttcgatcctgaagccatggatctattaagcactagacaacaatccggtgcgactatggaaagactaaagcatgggctaagatttactgataatggaagaaatagttattgggtggcatatgggagtatagataacaaccttgttccggaatcaatagaggaatcatgggaagatgatattgctggtcagagaacttttcctgaggatccaaattatccggttgttcacgactacacgatgggccatcgatatagtagatcaatgaatgatttaagaagagatgttcaaagtaggtcatcaatggcttgttaaatgagtcgttaaatgtacgtatatacatagttactgcgctttcggttatatacaaaataaaacaacatctacaagcaatgcttttttttcaattattgtaacttggatgcttattctaataaaatgaaataaatgctactgtaattttttgccggaggattggctatatatgcagagtgggagttggacgatatcaccattattattatttttctattattaccattggacttgtcttttgcagcaacaaaagtggcagcagcagcaacagcaccaccaccaatgcattttggccttgccttttataagttgtcaaaaaaagttgacctcgaaaaggggaaaaaacatcaatttttcattaaaaaatgcttagcacattcatatgcagtccaagaaatggcagtggctggtatattagccactatccttggtttcaaacctcgccaaaaccccttccaaccatgaacctccagtatggctcttgaggctctaccaaaagtgttcgcatccttcattatttcgatggagacagtttcgctgcctctaacctgtaatacagtctttatgcaatccaacggtgtagttaacgcagcacatgttgcaccacttatcccaccgcaaagacaatgaatcaatggattgtaggaattttgtgggttgaagaatttgctggcagattcatatatcatgaaattgaacgctgcaaatgggatattcatggccaatgttgtgggataggagtagtaaaatgctgcaaagccttcattttgatatatttgcttagtaacattccaaactcttagattagtatccaattgtagtctttgtttaacggtgtcaaaggggttcatcaatgcatccgcagcaatggtagcaatggtaccactcagtgcggtcttcattggttgatgagtttgcatatcttcagggcttatcaggcgagctttgcaaaactcgtatgtaccaaaatatactgcatgcgcaggccctgcccccagtattaccgattgaacacccttccataaagccatcgaaccttccattgtagatattttggatatctgagatatcatccctgtagaggcagctttattcaatcctgcagcctgcactcgggttttcagagcatctattggaaacatcaaagaatgctccattatacctgcaaatgctcctgccagtaactgggaatgtagcggagcatgtgatggaagagcttcgtagtcgatttcctcagctattgacagttctgaagtattcataatattaactgatatttcggttgagttttttacttcttcactttgtacttctcacgaaagtcttcgtcaataaacctctgataaagtgaaaattctatgagattccaataaaacctccaaatatctttatatacagcttactacttagataagatgacgttcgccaatggtaggcaaaagatagcagggtgttcttgcctttcagtcttcgccatgctctcattcaagaaagggtgccaaaataccgaaaagagacacgatcgggggtgtcaaagtagcgattcctgtgggttaaaagagggtgaaccacggcaaacatgcatgtgtaaaacccaaaacgccgatctagggcctgcgacgcatggtacgaacatcctgaaggtatataaaagagctaaagtcttgactcatgcctgaaatcttgatttttcattgttatatcctctctatacattagtaagcaccatagatgggctggctatcaaaagcgagaaaaaaaaaatgctgaattccaaatatgtactcatcggggtgaatttcaatgatgtgttatgtagatacaatatatatgtataagtcactaaatgcatacatacgagagtctaccttaagtttgtccaagtgaaaaaaactgggcatagcaaaaagacggttgtaggtatacctgcgtatatgagaaaccttccgacgatttccactttggaaacaccgctgtacaataaacactcttcttcttcacttgtctcgttatggaaatgaaccttttcgcttctatcatcgtgaaatctgagtagtttaattaacagcgtgtagacagctgtcttgctaatgacgtctttccaaacaatcacagaagcgacacctaccagaggcctcaagaacaccttagaaccacatgatgcgtacctactacatacaaggttccatccgtatctttcggttaaccagtcgctgcaatccagcccactgactacgccaatgaacgctacgctatcttcgaaacaaggacattcatcaatgggcctgacgtggttaaacagaataaacaagccccatgctacactcaaaaggggaaaccagagatgttcaccaatctggaaatttcgtaaagcatgcaccacccagattcttataaaaaaacagatagctccaactgcggcgccgctaaataaatccagcataccatgcataccgcagtaaactctaccaaaaaccagggttaagtagtaaaatatcaccagactcagtaaaagaagctttgttggccataccagtgtgtcagataaacatattctccaaaagaataatagacttaccgcagtagcgttagcagaatgtgaactgggtgcaccatattctttcgtagtgtattcacttagtgtgattctgtcaactggcggtgattttggccttggtaggcaccaataatcctttaagtagccactcaaataaattgaataaccaagaacgtagatcatgtcccgtgttaaatcgcggtatccaagccacacaggcatgggaagcacgataacataaaacatgtgggaacccataagcgaagtgtatttgaaataaacgtctctaaaaggcgttctgtgctttttttgtaaagaatgtacgaaatctgattggttgtctgtgaatctagttagatactgccttgtttgaaaccttagccacgacatctggctctcaaaatgctccgctggatgattaccgggatctgccaataggtgtttgccgccggaaggagccatctgaaccttaatggtgtcctcggtaacacccaattcagtaaccgtctgaataatggtcataattaaattcttttacaggcttgctattttgtatatttttttgaagactaccactgcctaacttctttttgtcatgttatcaattcaactagatgttgagaaggaagccaaggcaaggctgataaaaactaagaaaataaggaaaaatcattatgttatataacatgaattctagacgtacgtgctcgtagttaggaagtatctaaataagagtccccacgttactttaattagaagcacgccatcttcctacaaccgatttttttggattgtagatatcagagtctcatcaaacaagaggaacccagaataggcacgtccactgagaaaaccgcggacaagcaagacacgcgtacctgaaaaggctacatttcttgaagaagttgttcagttgagctagccacctctttagcctgaagacgttcgtaattcaaaatagattcccttggcaattgaagccatgaactgagtgaatctgcaggctcaatcgtattagacagtatggcagtaagccttgcccgttcctcttcttcactttgttgaagaagaggctgtgggattcgtaccccaggaacgatctgcaaattgtccgagccgcagaatacgtgcgcacaaagtttagcgaccacttcaaggtctttctcttcatcgatctttcctccgtatacgatcgtagctatgtgatctcgcacttgtgcccaaggaatgttgttggtagaattggtggctaatacattctctaaatacactgaggcaaattgaaagtcgcaatcattaaagtaatacttcttggaaaacccatgaggaaccaatcgggtcctggcagtgatcaaggcatgaaaccatgacaataggaaggtacaatacacgctccatactcctgaaattttaccagtgaaaaattgagaaccccatagatctttgacggtatctagtatacctgggatatcctcatacacaaatctatcagttctttgtagcaatggggcaggtagtttatcaccagtcaaatggcatgtcatgaacattttgaatttctcatgttcttctgccgcctttgtctcctcaacatgcttgtgcagatacgttttcacccatgatagcgacatttgtatgttttgtaataatatccaaccaccttctatcttagattttgatatttcctcttgagcatagtttagattttctatagaccctagcgggatgatttttaacgattccttcgaggctttcgccaattcgattaatttgaatgtgccatcaacatctcgctcgcttgccattgtaaaatagttgttctcggaattggctaccacatccgcgatattccactcatcaacaaaaaactcatttttgaaccagttcaacgcagatatatacgatttggttgtaacatagtcccataagtaccgcaaatcattatttgtatctacggttagttttggtacgccatcgctactttcagagagaactccaatcatagttagaactgcctctttatattgttcactttcaatgtcgaatttatacaaacaaaacatcgtcatagccataatcattttaaattttttgtcaagagcggtggagaattgacaatatacttcttgatataatagccaaagaatttcatctacccgtgtcctagctgctcttgtttccctagatttcttaatgaagacacgtttgaaacatgatagaaattgtcctatagaaatgccgtaaaaccaatgaaactgaccaaacttctccaacatagagaatattttgacactatgcttaccgataatagaatactcttctaccagattatcaaactgtgggaaaaactcttcagattcacttagctttttttcaatgttcatggcctctttcttcaggttgttcaaagtcaccatcagttcatcattttccaacatattcccctgtgagttatttagttcctccaaaagtcgcttttctagattcttcagtttcaacttgtattcggtattcaattttatcaaatcttcccttttcctttgcatttctgcattctcttctgtcaaagtgatgtcaaaaattcgtgtctcaatactttccttattcgtgacaaaatgaactaaccttaccctagatctgaggaatattggaatatctccactgggatcgcaagagtgaatgaataatttaaaatcgcctgaaacatctacttcatgatcaccaatctccaccgtgactctgtttccggcatgattgaactctctggagattagtcttgatataattggatcaaagaattctccatcctgaattataactacacttccgaatctaattgcattttctaatcttttaacaaaaccttcttcaagaaaactgagaagtacagttttattaccataataattcgagataactgttatcatgtgggagcttggatccaaaagaaaaggaacagcgtcttgtgaattcatgactatgctcatattttccaaaaagtaatcgttcttatccaagccacattcaagccacttcattttttcatctagtgttaccaaataatcgatgaaacgataatttacatcatatttaacagcaaatttgcctagtaggcgctttaaaatgactaacatgtcagctctttccctttcattcaaatgaccaaagtatgtttcatatatggatgaaattatgcaatttccaatcagctcttggctcgtcttactaaattgctttgtagtgttcagccacctttctttttcgaaggttaaactcttaactaaagatatagacctatcaagattagcctgcacgttactcatttctgtcttgatggcctcaacatccctaatcaacaaactatattttcgctttgaaacttcaatacttgcttctaaatcctgtgtcatttcttcagcggcaagtaaattggccttcgtcttcaatgattcgaactctattcttttcatttcttgtctcagcggatctacgttttctaaaactttactgaagtttatttgggcattgacccactgatatagcggcccacacgctttgctggccctgttaattgtctcataagtaaaattaggatctgacaaaaattcttcctccatatattttcgaatttggggcttcatatgtaaggtggtatcataatgtactatattatgaataaagtcatcttttctaataaattgttggatatctctccagttggaaaattggtagcccaagatggcgcaaacagcctccataacaattttcacaccagagggggggttgaccattgatctgatttctgtcaactgttgcttttttatgttctttacaccccgttgtgcctctaaaatggtaggttcgatatcttgaatacttttcatgacgacctcctttctttttcttatatcttcttcttgtactttcaatatctttttgatttcctctgtagcctcctgctttctttccgactcgttttgctccataagcattttatccaatgtactccgggcttccttttctttctcagtaagttccgtactcttctttgacaaagttttgtttagttcgttaaccttcaagacagactcgtttagtttttcgagacctacattaacaaatctttgattttcctgtaaatcttgatatttcgccgtaacaagcttcactaaggcacgtaaaccatcaataaaatacccaggtgaccttggatttaccccaaccttcattttttggtaaaaatttctatcaaaatgtatcagaatattaaccacagcatctcttatagtttggattggctccgtaaataccaactctttattgacctctggaactataaaatcggtaaattccatagggatcacgtccaccatattgttggccacttgggacattgttttcgtatcccaatcacccatccaattaattatgcaacgattgaaaagggctggagaacttatcattgctgaggacttattgtttgtaggatcgcagatcgtgaagacaacatgaaggtttttggcaatttctccaacaaaccagtcatacagttcttgttctgtatccaataaaagacctaaagacctggttttatttcgcaagttattcaagagcttatcatactcctctccttgaaacaaatctggtatatcagcgttggcaagtaatgtattcattctctccaaaaaagccgtctctaaaatgttggattcatcaatgattaaacaagtacgagattctttaagtgaacagtctgaaatagcttttttcaaaatcatatcaaagtcgctaagattggaatgacggtggatcttgggttgaacaatcttcaaaccgttcaaccacgcgacaaacctagttaaaatagttttacctgttctgcttgcaccaattagcatcatgtgaccttgaacttgttttaacgcacgatcaatacgcaaaatatggtcaaccatagactcgtgtataaccattggcacttccagctcctcatcacagaatgttttaaatctttcctctataaagtttacaagatctgttttgttgacctctttgaaatcaaggctcaacaagcccgaaaagagaagtgaagttgagcttatattacccaaatcctgattaggtaaatatttatcgactgtctcataaagaagttgttcaaaactgtttttttcttttacaccaaccagcctatctgcaaatattctccaagcttcgtaagcccataaccgtattagtgatcttagtgtttgccttggaccagtgttaattgcagtgtagacacccctaaccaaacgtgttaattctcttggtgaaaaaagatagtgtgattgaagcccagtactgtatcttgctttacattcgttatataaatgaacggaagcgcgggcgaagggctctgtgtatgatctgaactcagggactagcttgaaaatggctttgtaataaatttcataaatttgagaaagagattttccgctgggataacctaggtaaagaatagcagcatgtcgtgtaaatctttctgacataggaattctacctgggtcggttggaggattgcaggcaccaacaatatgtatcctctctattgtcacccacttattttctggcgttttccaaaatccttgcttttccatcaactgccttaagaataagacgacattttgagaaccatacttgtcgagttttggtaaattaatctcgtcacaaaataataccaaattttttatatccgattttggtaacaaagtaaggccttttgatgtagttacgtagtttgtatgcctatgcaaggctgacaaaatatgttctgtggtcgtgtctttcgaaaaatttattccaacaacatcatagagcgaagagttccggagtgcattattcataatcattgttttaccagatccaggtggcccacaaaggataatacccctttttgaattgagcaagtcataaaaaattttctcatgcttaatcgtatcaattgtaggaataacaatgtcaggcctcatgacctcatgtgcttctaaagaaacagagggaatttcggaacaaaaggaactaaaactcaacttatcgttcgcaataactatggtagaataatctgatagttcttggctgtcatgtccaaaataagtgtttatagtttgtataaaagctctttgtgattcaccagttgaatcaccagctagtgcatatagtagggatctcttaatcaataaagtaatcacatctttcaaacttttatcgtccaagttttgaaaccactgcctataactcgatattaaatgaacagccaactgcaccgcggtttctaacttattaaaggttcgaaccccgagaatgtgaactaaatcatttgaacacgtaaaaatattggttaaagaggccatatcaaaagaatcagatataaggtccttcaacttatctaattcaaacatggatagtttattatcaagcgcttcataacttttattcagtaggtggtcaatcttggaggatattgaacacacatccgtagaaaaccacagcaaaccacatcttgttatagtagcaggtgtagtatggtcaaggttatccgtttcaaataaaatgcgaaagttcggcggaataggaagtctttcaccgtttggaagcgttaaaattttattatcatcaagaacagaattcatggcttccacatattctgggtctaaatcactatcaaatactacccaaattctcgaattcttaaaagttcctgtgatatcatcgttaacccttcttagaatcgaagtaaaaagcccatctctccactctagcgttgctttaagcatacttccatacaaggattcttttgtaagaacttttgtatcaataacatagacgacgttagcgtgaccatcaaaaatggccatggcatcaataacagttttccacgttgccgttttaccacagcctgccttacctaccagtatcaaagcctgttgtgttttttgcatgtaataaaactgcatacatttcttgagaaattcctcagacattgaaaagccactcctttgaccagcgtcctttaaacattgaacaatagccttcgaatttagcggcgttccagcagaatcaaatattttcgataattcgtctttgaataccaattcatcggtgtcaccgagcgatggtaaaatcactcttttcaaactttcgactaccgttttttccccttcaccaaattcactaatcaaagggctgcaatttcttaatacaccttttagcgttctcaaaccaaaatgataatggttcattgaactgcattttgaagacaacagttctaaaaaatgaacaattttcgaagctaaagacttagaatcttcgaaccccataatttgtaatatcatctctgcaatagtaccactttgcggagatttcatagagaattctcgaaaactcttcttcaaattttccggtaactctgaccttccattatacccaggattcaaagtaataaacactgcagtgtgagggctcaatggagtttcttcttctaaaagtgtaatatgggacttaccaacctggaggccattttgtatttgttggatattggcagacaccgcactcaaaactttctcatcgagcctattgaattcatcgaagcatccccatgcgccaatctgtgtgatacctactagaagcctggaaagaacctgataatcgaaggaatcatcacaattaaaaactacaaccacgcgaccgagattttgaccaaatgctttcacagtttctgttttacctgtgcccgcaggaccgaagaagcacccaccatatttttgatgcagagaatctgtgagtgtcgcaaacccaataagaagcaacggtgtatatattaatctttctgggatgccaatatactcaaatttatattgcaagaggtagccactctgagaaataaaaacggagttgagatcatctaaagtgtcattcttttgataaaacttttgaactttcgcccatagtagtcgagcttcttccttagtggaacaatttttaagctgtccaataacgttattaaaatgcaaatactcaaccagtagggcctctatttttttcttcacgttatcggaagatttattcaacttatccagcagtcccttaatcttcatatcaacttctttccagtactttgaaaattgattagtttgaaggcatttttcaacgagctccgtccacataacttgagctgagagaagaatggcttgaaagatatatttagatacaactacttcaatgtccgttccatctttcagttggcccaaacagtctctaaattgagtgaagacgcttagcttaatttctgtgtctaaaatgtttaaccactcttgagcttgaatcgagtccttcagctcgattttttcattcaaatttaggacttcaccttccactgaccgcacaccggttatgaaatcttcgaggaatattatagactcaatgcttccgaacattttcttcataaactttgaaacttggtcgtggtgttttccagatcctatgatttttaaaagatcatcgttgcctaaaaagtaaaaccttgggaattgtcttctttgtctctctaaaaatgtcgatagtgacgattttatcatctttaaagaatctatcgttaacttcagagttgtgtcgaaatttggaatatgtattacttcgattgttgtgtcgagttgaaacgctcttgtggttatcattttatactcactggttaagcttttaaatttcgaagtttcgagcggtaagaagttttgaatgtccaagttttcaccaaggattccatacaagtccaaccagtaaaactgtacttcaacccaatttacctgaatttcagataattttgtcagtttagattccaaatccaaacagtcttgttcaaaaatcttgtaataattcgaagctttcatagaaactagctcctctagatcctctttacaggcttgctccagtacatcccattccctcacaagcttgagtccactggagtgctctatgacttcatattgagcttccttccaaaattttttgattctgttcagagacttttctataacaaattccttttgggctctttctataatctttgtaagtagtatttcatttaaagttaaattgaggaccatgacatctttaagagaaaactccaatttatccagtagatttttttgtatctgtcttttaccaatatcgcggaatatcatgttccaatgtcgtggctttaaagcaccatcctttaactccaccaagattttatttacagaggtaagcatgttaacctgtgaaaatagcgatttatacatctcaaattgtttgacagctctcggcagttcatccgccctccgaagaaagtttgccaaatccgattgaagtagcaatacatctactctacaccacggcgtttcgaaagttctttgaacatcttcccaaaggtttttaatgctcctccaaactaggtcatacgttttgacctcttcaaccacgtgtgttagctggtcattcaaaacaacggggatcagtaacatttttgcagcggctgcgacagagtgcatctttttcttcaatttagtaattgattcattgaaaaactctaggattttaagtgcttcaggtggagttaatgttggagatattggttttctgactgaccaactttcgttcaaagattgtgagagattattgatattttcaacgccttcttctagactttttgctataacaacgcgatgtttttgcaactcttgttcaacatagctcaaactttgcctcaacgaactaaaatcgttatcgagctggtctatatagacaaaatgcgatggaaacctcaccttcagctttgtaagcgccctcataacagacccaagcagcttgatttggatatctcgttcagtgagatgccttttatttacattgacagcctcaatgatcactgttatattctttaaagaggtaaaatttatatccatatcctcgacagcttctctgtccctgttcatatcttcatgcaattttctagcatcgcgttcatatattgttaagagatgcttgctgacatataagatccaagaatccattttcgaacggatatgacgttgcgcatcttctgtatgaagcactaagttctttgaaaagttatttcggcttataattagatcgaattttgactgagaatcaagaaggccttttaaaattccaaagcatctttgtgtactgttatcgactacttctaaaaacgcttcctctgtaatttgccagagaaattccatcttttgccattctttgacgtaagaatttatcttacaatgtaaattttgaacctgttctatacaattttgtatatcatcttttagtttgatgactagcgaattaaaagtcagggtagtggaaagaggatgatcagggtcatgcaaaaaattaattaaaacaactttgtttaaaagagcctcaatatccttcagtaaagaacgtttcatagcagctaacgatggagatgatgttattctaccttcattgaaactgagtttcaatacatgctttgggaaatgcatttttttcaaatttaagcgtactttctccaagattatgctgataattaagttattaaacgtggaaatatggtcactaacattagtaagacccttggtaaaaagattttcaaaaatagcttgaatattgcttattatttcctccacttcgtgcagatcatcagcagtaccgtcaaaagatttcaggccagaaaattccttggcaaactgaggctcggagtttttcaatatttgataatcagaaagaattccatcaattgacttttccaatcttgctaggctgtgtaccgaacaggacatttcggaactttcctcttgtaaagattcccacggcgttatcagaatttgttgtaatagtagccatacagtttgcacgtttctcttcagaaagatgttcgtgtaaaatgtataggaaagtgatttactaagtgaaaaaaaagtttgaattagttcaaccaagtttattgccctcggatacaaatacatgtaagttctcgcaatacgtactatgtggctaggcacttgaaaagccatataggttaaactccttaattccgagtaagcagcagctaaggcaaaatcgaagttgacttttagttcataatcatcctcattatttcttataagctttaaaataggtgtcgtcaaaagatttgctgttgctttttcaggaaaattccccaaccagtgaaggaacacatcgtgaggatttgtttccttacgtagttgtactatcgaagttgatatcgaacgcccttcaagtgtgtcattccaattagaaccaaaaagtgcttcgagatactgcactatattgtcaatacgggattgtacattcagaaagtaggaaattcttgcagatatgggaggaatgttatttaaagcttccacgtgcagaattttaggcaagagctctaaaccagtctccagttgccgtatatctttttttatttcaagtagcagtatctgttgattctctagtacttttacttttatcctaggacaaagttccattaatggcttgaattttactagataacttaatttttcggttggacagtgatcagagtccataaaacttgccaacgtattttgtaacttcttttccaaatcgagcatgtttttactgaattcactttcggcttgctccaatttcaatcgaaaattcacggaaatatcatggatctgctcaaatggatgatacaatctctgtatttcttcgtgataagtagaaggggatatactcttaatggtttctgccaatgaaaaaaatcgcttgcgtgtgcttaaaatttcatccaaagtagcctttacggatgcacttgtaaatgttagcttttgtataagtagctcctgtggtgctcttttcctaagatcctctcttattaaaagattgacatcctggacaatatcatcccattcttctatcatgcctgctgatttttcatataaacccaaaaaagaaccatactctagctgaaataaatctgaaagattacttagaattgcatccatgacttcttgtgaaattttgtccatcagcacaacaaatctttgaactggataacctgaatatctgaacttcttcaaagaagatgctaaaacaggaaatagttcctgcaagtcctcaagattgcttgcctggcgaacctcatcgatagggattgacgatagaaattggttatatttatccgctagcttaaatttatctgaaagtgaaccttcattcaataaatttgttaaattatgaaatctctttgcgtttgttagaacggatagacacacctgaaattcttggctttgtgtttgttcaattaacgacttcagtacttcgtagaaattcgaccaaaactcaacttcgtctaaaaaagaaccattttttatatctctgtcaatggctaatgtttgtttaagaaccaaaaaccatttgtttgcaatgctttgtaaaatgttcaaaaatctcatactttccaaatcattactaggaaggtagtttgcataatcatgtgaagtagccccttttgatacagccaatttgataatgctagggaccatcgctaaaagatctggcgtttcaattgaggtatgtaactgttgaaattgtttagaaatgtcgtcaagtttcctcctcgttttatctatagtttcgacagaatatgtctttgtatctgattttatcaattggccaaacacagacgatacgccatgtgtgataattgaggccaggttccccgcatttactggaccaggtaagtatatggcacttatttgtgttgcaatcggttctgcatccacaataacacttctagatttaataattaatagagtagaatactttttattcgccaagttggcatcatatatagcctcttcaccaatgtctattgtaactattgttctatccagctcttcaaaaaggaagacaaacaacgtgtcgaactctctcccatccaataatcccaaaaaaaattgaaaccgttcaaggtattgacaatgtagataatcaatgaatgcttgctcattctctttgggagaattctttatacccgttacagtagctgcaacaaattctatcagctcattagcaagtcttgcctcattcttgcacattgcctaaaaaacgttttgacgtactttccaatttaagctctgaacgagtattattgcccttctatgttctatgctttctgttaatttttatatgtaatgtttgtttacctttcattagcttatttattagaatccgtacaatgcgaccttccgcgcatcaattcgggatgatctgattaagtagttatagccttacgttaagacgacaaaagacatgataagcatccctcaaaagttacagcaaacttaagtcaaataggtccaaaaatctccaatagtaacgctttttcatgaatacactattatttaagcgaaaaggtggcaattgtgggaacgaaagtaacatagtttcgcagggatcgccctcaagtagcaatcttcctgaatcacctggcactttagatgaaaagaatcttcccagattgcctactccattcgctagaagcctttctaccattcctagttatgagcagatgaaacgtacaaacaaactgccagattatcacctaaagattgttgttgtgggagatggcgctgtagggaagacgtgcctgctgatatcttatgtccaaggaacatttccgactgattatattcctactattttcgaaaattatgtcacaaacatagaaggacccaacggtcaaattatagaattggcattatgggacactgccggccaagaagagtatagtagacttagaccgctttcatatacgaatgcagatgtgctgatggtgtgctattctgttggtagtaagacatcgcttaaaaatgtggaagatctctggttcccagaggttaagcatttttgtccttccactccaatcatgctagtcggccttaaatcagatctatatgaagctgataacctttcagatctggtggaaccaagttcagcagaatccttggccaagcgtctgggggcatttgcacatattcaatgctcagcacgattgaaagaaaatatcgatgaagtatttgaaactgccatacacacgttactttccgattcattatatgctcccagagagcctacacatacaatcaaaaatccctttaaaagaaataccaccagatcagatatcgattcttctactggagataccagcgtctctatttccggaacgaaaagattaagaaaaaacaagtgtattataatgtaagaataatgatgaagattattctgttgcccattctgtacgcacttacaacatttgaaaagtggcaagaaaaaatacacacattttactatcttccgctatcttatttatcaagacgaaacaattagaacctgatttaatttaacttccatttttctgaatctggtgtgatataccgctccaatatattcgaatttatcccaattttatcataataattcattttaattcgatgtcataaagtactaattcgatattaatctagcctaattacattaaatacttaataaaagcttctgtgacataaaagtacaaatctgtcattttattttagaggaatagtttaggacaaagtcattatgtacgaacagtttgaattttctttttttttcttcgaaaattcagacaataaggttaaatataaagctcatctcatctcatcgataaaacgctggagtattatcacatgcatgcgttgcttttggaccgtacagaagtctatatttaaagctaggtttttcgcttgcagaaactttgtcaagaagcataattataaactaatcagcaccatgactggaagtactgaaatggtaccaccaacaatgaaacataccgttgacaacaaaaggctttcgtctcctttgacagattctggtaaccgccggactaagaagccaaagttgagaaagtacaaggccaaaaaggttgaaacaacttctccgatgggtgtcctagaatttgaagtgaacgatttgttaaaatctcaaaatttgtccagggagcaggttctgaacgatgttacttcaattctaaatgataagtcctcaacagatggacctatcgtcttacaatatcaccgagaggtaaaaaatgtcaaggtcttagaaattacttccaatggcaacgggttggctttgatcgataatcctgttgaaacagaaaagaagcaagttgttatcataccgtttggcctgcccggtgatgtagttaatatcaaagtctttaagacccacccttactatgtcgagagtgatttattagacgtagtggaaaaatctccaatgagaagagatgatttaattagggataaatatttcgggaaatcttcaggaagtcaattagagttcttaacttacgatgaccaactagaattgaaaagaaaaacaattatgaatgcctacaagttcttcgcaccaaggttagttgctgaaaaacttttacccccatttgacaccaccgtagcttcccctttacaatttggctacaggaccaaaattacgcctcatttcgatatgccaaaaagaaaacaaaaggaactatcagtaaggcctcctttaggatttggtcaaaagggtagacctcaatggagaaaagatactttggatatcggcggacatggttcgatattagatatcgatgaatgtgtgcttgcaactgaagttctcaacaaaggattgactaatgaaagaagaaagtttgagcaagagtttaaaaactacaaaaaaggcgcgactattttactgagagagaataccactattttagacccttccaaaccaactttagaacagttaaccgaagaagcctctagggatgaaaatggtgatataagttatgtcgaagtcgaagacaaaaagaacaatgtcaggctggctaaaacttgcgttaccaatcctagacaaattgtcactgaatatgttgatggatatacttttaattttagtgcgggtgagttttttcaaaataataactctatcctgccaatagtgaccaagtatgtccgtgataacttgcaagctcccgctaaaggtgatgataataaaacaaagtttctagtagatgcttattgtggatcaggtcttttcagtatatgcagctccaagggcgtagataaagtgattggtgtagaaatttccgctgacagtgtctcttttgcagaaaaaaatgcaaaggcaaatggtgttgaaaactgtagattcatcgttggaaaggctgagaaactctttgagtctattgatactccaagtgaaaacacttccgttatcttggatccaccacgcaagggctgtgacgaattattcctaaagcaattagccgcatatatccagccaagattatttacatatcgtgtaatgtccattcccaggcacgtgatgtcgagtacttcctcaaagaaacagaaaacggttccgcccaccagattgaaagcataagaggatttgatttctttccacaaacgcaccacgttgagagtgtgtgtataatgaagagaatctaattgcacatataaaatatctatcactatgtatatctttctagagtaaatgtcttcctgtacttttaaatccgtacattttgaaaattgaaaatgtatctcagattcatttttcaattcgaaatgaacgaaaattacactaaaaaggtaacgtgtagagtgatattatgcacaacgattttttgaaaatttcatatacgttattctaatgtttagtagagagtttagcggaagatataaggtgatcaggcgtaaattaaccacatacaaaccatagaaacatcataccaaaatggaaaacgataagggccaattagtatgttcgagaaatctataagattttttatattttaacggatgaatggaaagtgcatggctgtttaaataaatgtaagaaagatatcataatgcaaacaaaacgtaggcatccgcaatgtatggaaaacatacttatggttaccgataataagcaactccgaaggtgccatagaccagctctgaatgcagcctacaaaagttgagcaatttctgacaaaattcttcgattactttcttcacatgtattaaatcatcactcaccaccaccaacaatgtgttttttaaactagcataactaacaaagatttgttttacatcaggtcgaactttacgttccaagaaaatgttctgctaccaacagaatcatcaaggctgatgaccacgcatctgttcaaatcaacgtcgctaaggttgatgaagaaggacgtgctatcccaggtgagtacgttacctacgctttgtccggttacgttagatccagaggtgaatctgatgattctttgaaccgtttggctcaaaacgatggtttgttaaagaacgtctggtcttactcacgttaagagaaaagaaaaagaggattcgatttaagcttcatatcgttcagactaataggtaactgacgatttttctcttcattaccaacttttcaccatatgttctaattcgtcggattttcgatgaagcgttttaggtactctataggtatttaggttataataatatattgtatttttagacaaccggaacctgtttaatttgaagagtcattgtattcttggctattctgtttaaagttttgcagtgtggagtccctgagaaacccccgagcaaaaaaaagaccccaaaaccccgtaaatattactactctacttgtgtgttatacattttcaggagtcaaaacgtactaacaaccttaagcttgcttaaagaggtgctatatatgtcgataagaagcagagtataagggtgcctgaaaatgtttgttgcttgtaagctatgcctttactcttgacttacttcaatattgttggcaattcgtggtggagacttagtagggattctattttcgcgtactagtgtgatgggaatgtataagaagctgctattgccacattgctctattccgcagattatttaccaggtgtgtttgcccttggtcaccaagtgaataaattgttagaggaagcaggcaaaaaaaggcgacattgaaacatgccttattgtgacgacctctctatttaatggcactttaagcgagctagccaagaatattttacaatcaatatacaccaaaattgtgttggtagagcctttaaattgccaagaagaaagcatacagaagaatagtgagaatttagctcttttggaaagacctgaattatcctttgccttaatcaaagcaagactatgggaattaactcagttcgaacaagttctttacttggattccgacactttacctctgaataaagaatttttaaagttgtttgacattatgtctaaacaaaccacgtcacaagtgggtgctattgctgatatcggctggcctgatatgttcaatagcggtgtcatgatgctaataccggatgctgatactgcatccgttttacaaaattatatttttgaaaacacttcaattgatggttctgaccagggcattttaaaccagttcttcaatcaaaattgttgcactgatgagctagttaaagacagtttctctcgagaatgggtacagttatcatttacgtataacgtaactattcctaatttaggctaccaatcttcacctgctatgaattactttaaacctagcattaagttgattcatttcattgggaaacacaagccatggtcattgtggtcccaaaagaatttcattaaaaacgagtatcatgatcaatggaatgaggtatacgaggaatttaaggaagaacatcaattaaataacgaagtttcgaagccaaagattagtgattccgataaaactgagactcctgaaacgataaccccagtggatgcccctccatcgaacgaacccactacgaatcaagagatcgacacaattagtacagtggaagaaaacgtggacaaccagaacgccgagcctgttcctaactcggatcatagccctgctcctaaccctgtcccattggattttaccaagtggttaacaacctttattaacaaagatcacttgactaatcagccagtaaatgaaagcagagaatattcgaaagagaatgataacaatataatcaatagcagttcaaaccgcgaccaagaaagtcctccaaatagtactcaggaactaaacagctcttatagcgttgtgagtactcaagctgatagcgatgagcaccaaaatgcagaagaggaggatagtacgacagataacgcttcaaattctggagaagaaagccacctcgatgatataagcacggccgcttcttccaataacaatgtaagtaatcaaccagatggcaaaaattttagcaattctaaagaaaataatatcagtgtcgaatctagcccttcaaatccagaacagaaaaggtcaactgacaatatacaaaaaccaagtgtttctactaatgacttaccagacgacgtagaaccacatacctctgttgatgacaatatacagtacttagaaaaagacaaggaaggttatgaagaatttcttccggacgtgtacgagtcaaatgcaatcgataacgaagaagaattttttgatgacgatgcaagagatgctaccgaaggagaaacgaagacgagtgcagttgcagataaacaggaggatatgaaacttacagcagaggaaaccaaccaaccgcaacaagaaatgcccaacttcaaatttgactgggaggactctgattatctatccaaagtagagaggtgtttccctgatgatatttttgagtatgcagtagagtaaacttccacgcacatattaggaaaattaaaagacatatctatgtaaagaccttttcgactatacaaaaatgcataactattctatatacattcaaactcgaaatttactttaaaggtttatcagcaacaacatccgatgcttgctgtttatcttttctcacctcacaacgtttatagtgactgaaaaatttttgcattctcacctcgtctattgaatgatgtgctaagaacttgagctaacatcacagaacaaaggtatgaatatacgcagccctgacatttgtagattttttatttggtctctagtcttttcttttcttattttataacaaattcgttaaacggcctccttctaattatatacaagatgtctgaaggtattactgatattgaagaatcccaaattcaaaccaactatgacaaggttgtctacaagttcgatgatatggaattggacgaaaacttgttaagaggtgttttcggttacggtttcgaagaaccatctgccattcaacaacgtgccatcatgcctattattgaaggtcacgatgtcttggctcaagctcaatctggtactggtaagaccggtaccttttccattgctgctttgcaaagaattgacacctctgtcaaggctcctcaagctttgatgttggctccaactagagaattggctttgcaaatccaaaaggttgtcatggctttggctttccacatggacatcaaggtccacgcttgtatcggtggtacttcctttgttgaagacgctgaaggtttgagagatgctcaaatcgtcgttggtactccaggtcgtgtttttgacaacatccaaagacgtagattcagaactgacaagatcaagatgttcatcttagatgaagctgatgaaatgttgtcttctggtttcaaggaacaaatctaccaaattttcaccttacttccaccaaccactcaagttgttctattgtccgccaccatgccaaatgacgtcttggaagttaccaccaaatttatgagaaacccagttagaattttggttaagaaggatgaattgactttggaaggtatcaaacaattctacgttaatgttgaagaagaagaatacaaatacgagtgtttgaccgatttatacgactctatctccgttactcaagctgtcatcttctgtaacaccagaagaaaggtcgaagaattgaccactaagttaagaaacgacaaatttaccgtttctgccatctactctgatttaccacaacaagaaagagacaccatcatgaaggaattcagaagtggttcttccagaattttgatctccactgatttgttggctagaggtatcgatgtccaacaagtttctttggttattaactacgacttaccagctaacaaagaaaactatattcacagaatcggtagaggtggtcgtttcggtagaaagggtgttgccatcaactttgttactaacgaagacgttggcgctatgagagaactagaaaagttctactccactcaaattgaagaattgccatccgacatcgctactttgttgaactaagggagacaaaaacttcttaaaaaagtatcttgtgaggctatcttgataacgtaacatatatttctaaaaagttatatatgctttttgtatttaatttgtttttctttttacattcctattattcttcaaagtccaaaagactctcggcacgaaggttgaaataccctatactaattgtttgctttgtctttttgtatatatccgaacgtatctatctgaaatttttcaaatttataaaaaataatatatataaaaggaaaaaaaaaaaaatcgatgccctactaatagagattggagctgaaaagaaaaagtgtacatcaaacgctatatctcgaggtttgggatggttgagtcaaatgatattataaaaagtgggctggcagagaaagcactaaaggctctaattttacaatgtgaagagaacccatctttaaaaaatgataaggacatacacataatcatcaacacgggcaaaaaaatgggcataaacagggacaacatcccccgtattattccattaacaaagtacaagctatttaaaccaagggacctaaacatattactcattaccaaggatccctctgccttgtatagagaaactttgacgaaagacgagcatacgtcggaattattcaaggaaattataagtgtcaagaacttgagacgtagattcaaagggagtaaactgacccaactttataaagattttgacttggtcgttgccgattacagagttcaccacttacttccggaggttcttggtagcagattttatcacggtagtaaaaaattgccatacatgatccgcatgtcgaaagaagtaaaattgaagcgtcaacaaatggtcgaaaaatgtgaccccatttacgtgagagcacaattgagaagtatatgtaagaatacctcatacattcccaataatgacaactgcttaagcgtcagggtcggttatattcaaaaacactccataccagaaattttgcaaaacatccaagatacaataaactttctcactgataaaagtaagagaccgcaaggcggcgtcattaaaggaggaataatatctatatttgtcaagaccagtaacagtactagtttgcctatatatcagttttcagaggctagagaaaatcagaaaaatgaagatctgagtgatattaaattgtaaaattaaagcatcatcttttaaatacggtatttaaacactcccaatgaaaaagcgtgattttgtctaactaattatagcattaataaagtgttttaaactttaattcctttcaagaatttgcaagattatagaaatttagtaagcgaaaaaaaaaaagaaaaaaaaaagaacagacaccctataaaaatagaataaacataataagccaccatttgcctgtctgatgatattcttgattctttatatctcttcaggtatgtgacacctatacatgcaacgctttttttgcgttttttctatacaatagttgtttatttaaaagcgtaggagcttcatgcaaatctgcaaggtatttcttacacaggttaaaaaactactttttgttagtcttctattttgcttgatagctcaaacatgttggcttgcacttgtaccatatcagagacagctgagcctagattcgtatttttttagaagatctcgagaagtttcatcgagatatgattttacaaggaggcgacatatgaatcagacgctgaagctatctagcaacacttataatgatgaaccactaaacaagaccaagggaataaaaaatcaaagagaaaatgctacattgttaatgcttgtgcgtaattgggaactttcgggggcactccgttccatgagatcactagaagaccgtttcaataaaaactaccagtatgactggacatttcttaatgatgtcccatttgatcaagagttcatcgaagccaccacagccatggctagtggtagaacgcaatacgctttaatccctgcggaggactggaacaggccatcttggatcaacgaaactctatttgaagaggctttacaattaatggaggaaaaaaatatcttgtacggtgggtcaaagtcatatagaaatatgtgccgatttaattctggatttttctttagacaaaagatattagatccgtacgatttttatttcagagttgagccagatgtagagtatttttgcgattttccctacgatccattcaaggtgatgaggcagaacaataagaaatatggctttgtgataactatgtatgaatacgaagatacaattccgagcctatgggaagctgtagaagaatatctcgaagaaacagagtcagcagatattgacatggaaagcaacgctttcgggttcgtatcaaatttcgacttcatcggtaaatcttttggtgtcatcgatagtaacagcggctataatttatgtcatttttggacaaattttgaaattggcgatttgaactttttcagaagtgagaaatacattagatttttcgagtacttggattcaaagggcggtttttactatgaaaggtggggagatgcaccagttcattcgattgctgcctcacttcttttgaaaaaagacgaaatcatccattttgatgaattaggctataagcatatgccttttggcacgtgtccatctgcatactacctgagacttcaacaaagatgtctttgtgatagcaatcacccagacaatattgatctcaatgtcatcagctgcctgagaagatggtggaaggacggcagcggtaaatacttcctcaaacacgattcatagcgagaaaagcgtgtatccgcatactataaatacgtatatataacaaagtaaccatcaagaaagatgttccatacctcaggtcatcaccatttcatgggtcgcttaaccgaaaatatcagaagcaacctctaacggcgatggttttaaagatggattacctcagcaccaacagttacactattcggaaccgaagatttatctacgatactcattatcctttctctatctcaccctgaaataatttattaaaaataaactatgccaaagaagagaaaagagaaaaatttaaaaaaaacgagagccattgcaacagttttggaagtaagaataggttgaaaattagtcaaaaagacaaatccggctcctataaaccatcaaacaataggctccctaaagcatcacaaattgttatgctttcttttaagagaaatgttttttaaagcatcaaaggtccagggcaagaaaaattctttctggtagcaaatgctatagttcacggcttttatagtcaaaatgttatatgcgagaagaaaaagaaaagcgcgagcttacttcgggtaagaagttcacttacgaatcagggcaaaagagctaataagaagtgaactagttacataaccgtgtgctctgtagaacacgagaaagctgttacacagaactgttttataccaagtagttcgttcgatttggaaaagagagtagtcttttgcgatgagtaaaaacagggaccctctactggctaatttgaacgctttcaaaagcaaagtgaagtctgccccggtgatcgcacccgctaaagttggacagaagaagaccaatgacacagtgattactatagatggaaacactaggaagaggacggcctccgaacgtgcgcaagaaaacactttgaactctgcgaaaaatcctgtgttagtggatatcaagaaagaagctgggagcaatagctctaatgctatttcattagatgacgacgatgacgacgaagattttggtagctctccttcaaaaaaagtaaggcctggctctattgctgcagccgctttacaagcaaatcaaacagatatttccaagagtcacgattcttcaaagttgctttgggcgactgaatacattcaaaagaaaggtaagcccgttttggtgaatgagttattggactacttgtcaatgaaaaaagatgacaaggttattgagcttttaaaaaaattagatagaatagagtttgaccccaagaaggggactttcaaatacctttccacctacgatgtccattccccttcggaactgctgaagttgttacgttcacaagtaacattcaaaggtatttcctgcaaagacttgaaagacggttggccacaatgcgatgaaacgattaaccaactggaggaagacagcaaaattttggtgttaagaactaaaaaggataaaactccaagatacgtttggtataacagcggtggtaacttgaaatgtattgacgaggagtttgttaaaatgtgggaaaatgtgcaattaccgcaatttgcagaattgccaagaaagctgcaagatttaggtctaaagcctgctagtgtcgatcctgctactatcaaaagacaaacaaagagagttgaagttaaaaagaagagacaaagaaagggtaagattactaacactcatatgaccggtatcttgaaagattattcccatagagtatgaggttgttttgattaaatcattttcgtttgcatattaggttaaagagactgtgattatatatacatgcacgttagggtgcagcatacaactcagctttatagtctacaacgtatttataacgagcattggaaacaggttacaggacaccaaagggtttgggtttccaattttgaacccttgaccaattttttactggtgtagctctgttctcctcttgtttattttttttacctactgttccgaaactgctcattctctgtttcaaagacgccaaatcgcctagtatatcattggtatcagcctttaatgccggactcacttccttcttcaatggaacggaatctttttccgcaggaataaaatcatacagctttatttcaccttcattaaaccttaatgataaattgtctatgttttccttcagttttgcctcgatttccactgtgctatcaatttgttttctccgttttttgtttctccatgagttaccagtaattttttcagtctctagtttggccagcatagattggcaaaaatacaatatcaagtatgacgcattttcatcaataagtttctcccaattttgccatttatttttaaaatttttattgttaaggttatttataataacatctaacagccttttttgtagttctttccaggcattgaatttcctttttaaaattgtcgttatattactatcatcttgttgggttctgtaattcctagctacccactcaatgaccttccaatcaaaattgttcaaattaagcattaaaactttgagtaaaagtgggtcataattgttaaaaaatttctcaagaaccacattgtgataaatggataatttccaaagttcttgccattgacgcaaattttccctgatcatagtttctgatgaacttgcgtgtgaacttttcctcttttcggcatcatagttcaccaaattatccccagaaaagttactacttgtaattaaactatcgtttgcattctcccacacccatttgtattccagaaactcgtttctaagtcgcttccatttatcaagtgttttagttaatgactccatatatttctccagtttatcatttcttctgtatccgtaaccggtatcatcatcatcgtcatcatcatccctgtcatcttctaattcctcatcgttccagtagtgatcatatagccaagataacgcttcattggcggcccaacgaagcatttctaatccaggtaaatctctctcatgtgtaccccagtgtctcaaatcaacaaaccaggacggcagtccaattttagcagctaatgtgtgtaagggaatagcgaactgagattgttgcgttggatccaataagccattgacaaaccgaatcaaagccattacatacgataaccggataggaatagaatcctgatgtactcctaaacacgcttccttttcgtctagcaataccgcacatgttatttgtgctgtagagtccaccacgtgaggtaaatattgggaaccctttagtcggtagctctgtactctttgcactgcacgctgtcgcttatcttcaatggttcctttgcttttcgggtaaaaccaaagtttcagctcctctagttcagcaaaatccctccatggaacgattcgtggtggtatcattagattgcccttttttcattgctttctagaaatgacttttgtttaagctaatttaggcattcttaggtatttttttcactctttctgcgactgcgatgagcttattaatctttcacattcgggtaattttttgcataacaataagtcatgaatttattgttgcgattttgcagtgttatgagtctatgaagagaagaaagaaactagaaaccaattgataccagactttagttgacaactgatctcataatgggatatgactcccaagttaggacaaaaaaacgacatcgaattactgtagtatgcacaaattgcaaaaaaaggaaaagtaagtgcgatcgaacgaaaccatgtggaacatgtgtacgactgggagatgtggacagctgtgtctatctcaccgatagctctggacaacctgaaagcagtccttcattgaatgatgctgaccctctgaggaaacaatcaactcctgcggaacgaataagtccaggtttcattaagaaaagaagatcgtcacagacaagacaagacgaagatcactggcaaagagtacgagaacttgaaaatcaatcatcactttattatctaccaattcatgaagaaactccattttttattgacctcatccctaatgggttttatttagagaccaaaaggtctgctgataatttatttggtctgttcacggatagagcaattgaaaatcgcgacccctatctccaagcaatggtaacatttagaagtatcgcaatcaaaaaaatgatggataaattgggaagcaacggcaataatgtgaaaaatggaagcttgcctaaatctttcgaagctttatccactttcgatgctgatgacgaacgccacattagcgatgatgttgttggtaagggcaataacttccgcatgcatcagactattcacaaatcattgtttaacaaattcgctcaatacagagaaaataatgctaaaaaattcagctcagaaactatattagcaaaggattatttgcctcctttaaaaatacttgaaagtgaggttttagcactttttgaagaaaaaatttacaatatgataccgattttcgatatgaaagttttgcgtcatgaaataacgatattttatcaaaatatagtcgagaaagggaatccaatttctataaaacactacgatcatatggttttctgcataatcttgttgattattaaaatatgccgactttctgtccagttttcgaagctaactccatatatatacccggttcttcaagaaattgatacctctaagtttttggctcttgttaaacactatttgttcgagacgaaggtcctcagaaaatgtaatttattacagttgcaatgtctcatattactaaggttcttgcactggtgtgcccctgaagatggcgatggacccgaaactcaatattgtcaaatcttaatggggacaataatatcatcatgtaaagaaatgggcattaactggtattgcttctctcatccagaaaaatattcatttaaaataaaccgacatacgaggccttcatacgatataatgaaacctagcgattacatttcagttttcagaaagatatggagttatgttttattttgggacaggaagatgtgttttattagcggtgaagaatgtcaaattgggaaaaccttgcagtgccatttcaaagaagaagcagatacacccacatggtatatacgaatgttaaccctggataacttgatgaaaaagataaacgatacgttgaacgatgatccaggaaaggtagatttgaacttgttgcaccgactaataaatgatttaaaaagaaactttcatattttaaaaagcctgtcgaaaaacgaaaaagaaacaatgcgtcattttgatttcgaaatggaatggataatagatttattctcactaagtttgctgcacggagaaatgatcttttatgaatatgactgcaatattacaaaattttataagagtttccaagatttgtgggatatggtcattcatatctcagagaagtgctacaattacttttttaacagtgatgccttagaggtggattcattgacaaagttttataccaatagaatcgtggaaattgtcgcaaacaaagttttggtcattgttccggcattcattctcagaggagaccgcttcaaaacaattcagtacgccgacaagaagaaaatgatagaatttctttacggggtctcgtctgtgtattttaacgaatttggctttgagtactatcgttgttttagaaaaatgttcaccgctaaaattgcctacaagatcttgaatcgctcatgtgaaaaagatgcatggagaattattttaaaatttttgctgaatgaattgaaactagaagataacggtgatagttatatagattacaacgatatgagattaaatgacatctgtccaataatactagaatttcaggagacagtacaaaaatatgatgggtataggccagatattctaagtatatggaacaatgagttttatcccataggtaaatacaacgatgatatgacaggatttaagtttcaaatgcgcataaaggaaatgcaagaattcttggatatggagaaatattccgacaggtttaatattttttcatccttttatgatcacgccagttcacaattagctaaacatactgaagttgataccaacataagcattacgaatgaacaagtagctgaaattccgcaaaaagaactactacaacaacctttagcacccgctttgcctgttaatgatttaattgtctcagagtttgacgtgattgaagatatttttgatcctgtggatttcgtatcatttttttaaagtcagagataaaagagacgtataggacatatacaatattcatacctttcacttcctccctatttcattcgaattatttagtagcgttatatatcgcactactttattcatatatgtatatatacagagtctgagaagaaggaaaagatcacacgttcaatcacaaaaattctttggctttctttgcgtaagcgtgacaatctcttaaccattgcttatattcctttaaggaacctatcttttcaccgtaataatctggaacaggattactgaaactttgagaagaggcatcgaccctgttattgatgatatgttttagaaactctttatttttgttgttgaactgtgccaattgttggttatgggaaagtttgaaaacttgcgaaccaactatcggacccaacaagtagcctagtgcaccagaggctattatcccagctgaaattacagttaatgggtcgaatccgaatagcatttgagtcgggtctatttccattgtggaaaggtaagcccatgaaacgttacagcccaaaagagcagtaaacagcgaagaaccaacattgattctacgctgctgtttcctcaatttgaaaaaatcagaccatgtcaagatactggagtcttgaagggatgcgggctgagaatatgatcttaagggtaaggttgtagcagtcgagcgcaatgccgcagcggtgacagaaggttgactagcgaacagtctttgcgatgacaatctaatggcactggtaaacattttgaagaggcggacaatgttttctgaatgtttttaacacttctttgaacatagtttcccttatgatataccattgtatggctttccatttttcatagacgtaccgtacaaacgtattagatgatattcagaaaaaagcataagcctaaataataataaatataataaatagataaataatacgaaatataaccaataaataatatctttcctcagtgacctataaaccttgttcctctaaagtcttgaaaataaatggactgggcgcgtctttagggaaagtgataccgttctccaacagtttttcaaaagctttggaaaaatccttgaagaacttgtcctggtcattagcgtattctttcacaatgcttaagtacttgggatcctgaatcaaagaataatcagtgggcagcatcatgtagccgctcttagagtcccactgttcgttgttcgcgtcgttcttttccaatttccagtcttcattcagcaagttcaagtaaaactcattggtaaagacgttgttagcggctccccatggcccttcgtatccagagttcttcaagtgggtcttgcccagagcgtgagcccccataagagcaactacttctctgtcattcatattaagtctttgaaaaaatgttctgacatagtcagcgtctttatcagcgtcaggcagtctcccgttgtcaggggtagtatcctctggcgtgtcgactctaccacatctccatggaatcttgggaccctgcatttcctgcacggcagtgacaccccctagactgaacagatcacccgaggagatccagggaaactctttgtgaatgggctccaggaacttgaagccattctgcaagcccgcattggatggatcgttaaactcctttttgaatctgtatgtaccaccgtatgacccgcctgtattgtcgtgcttgtcccaggtccctgaagtgtgccaagcaagacggactaatacgggcccatagcctatatagttgtcatattcgtcatcttccctcagcttgagtgcaatcgcattgtacaccttttggaagtcctcgtatgacctccctttttcgacagaggcgacatgaacgagcggtgtagtggaagccaaagcagctgccttcccccagttgttccatccgtggttactaccacccccgggagaagacgatgatctcttttgggattgcgagtaagcaaaagttgcagcagcagcagcagcagcagcagcggagaacaggtagagagacctcttatgggcggttctgcccagtgaaggtaaaagcctaacagcagtagtcataattgtagatatacgtgtgtgtttgcgtctgcatgaatgcgaaattcatgttcttgagttagcgagcgtgtacaatagtctctgcttaagtacttttcgctccagggtcctttcctaaattggtaacagccggcttgggccggcccctggatgccaagagagtcatattactcagtactcaggaccaaataactcatcgctgtcgttggtaaagaaaactacaaatctgggcctgaccatggtttacgaaattcctgacaaagcaggatattctttggctttggaatttccattggcgagatctagctgcgggagaaatcatcccgacattatgtaagctacataggtcgctgaagtgtagtcgccacacggcagcgctaaatgataactagtaattggtgtggagcgaccacattttcgcatcgatccaagctcgtcttttggctttcttggctattcttactagttatattgaattattacagctcttgctggaacaccagtaacccgccgttgctccgcattttcgaagtaaatggctcactttgattgtaaggttgagaggagtaataaagaggggagagaaaagaggagagaccctgaagaagtggcagcttgagtataagatagtgtcttttcgtgcttcgtcgctagagcaaaattctactttcacatctaataaagccgattaatcgatcagttattgctccctttcctttatgtctgctcccgctgccgatcataacgctgccaaacctattcctcatgtacctcaagcgtcccgacggtacaaaaattcatacaatggattcgtatacaatatacatacatggctgtatgatgtgtctgtatttctgtttaatattttgttcactattttcttcagagaaattaaggtacgtggtgcatataacgttcccgaagttggggtgccaaccatccttgtgtgtgcccctcatgcaaatcagttcatcgacccggctttggtaatgtcgcaaacccgtttgctgaagacatcagcgggaaagtcccgatccagaatgccttgttttgttactgctgagtcgagttttaagaaaagatttatctctttctttggtcacgcaatgggcggtattcccgtgcctagaattcaggacaacttgaagccagtggatgagaatcttgagatttacgctccggacttgaagaaccacccggaaatcatcaagggccgctccaagaacccacagactacaccagtgaactttacgaaaaggttttctgccaagtccttgcttggattgcccgactacttaagtaatgctcaaatcaaggaaatcccggatgatgaaacgataatcttgtcctctccattcagaacatcgaaatcaaaagtggtggagctcttgactaatggtactaattttaaatatgcagagaaaatcgacaatacggaaactttccagagtgtttttgatcacttgcatacgaagggctgtgtaggtattttccccgagggtggttctcatgaccgtccttcgttactacccatcaaggcaggtgttgccattatggctctgggcgcagtagccgctgatcctaccatgaaagttgctgttgtaccctgtggtttgcattatttccacagaaataaattcagatctagagctgttttagaatacggcgaacctatagtggtggatgggaaatatggcgaaatgtataaggactccccacgtgagaccgtttccaaactactaaaaaagatcaccaattctttgttttctgttaccgaaaatgctccagattacgatactttgatggtcattcaggctgccagaagactatatcaaccggtaaaagtcaggctacctttgcctgccattgtagaaatcaacagaaggttacttttcggttattccaagtttaaagatgatccaagaattattcacttaaaaaaactggtatatgactacaacaggaaattagattcagtgggtttaaaagaccatcaggtgatgcaattaaaaactaccaaattagaagcattgaggtgctttgtaactttgatcgttcgattgattaaattttctgtctttgctatactatcgttaccgggttctattctcttcactccaattttcattatttgtcgcgtatactcagaaaagaaggccaaagagggtttaaagaaatcattggttaaaattaagggtaccgatttgttggccacatggaaacttatcgtggcgttaatattggcaccaattttatacgttacttactcgatcttgttgattattttggcaagaaaacaacactattgtcgcatctgggttccttccaataacgcattcatacaatttgtctatttttatgcgttattggttttcaccacgtattcctctttaaagaccggtgaaatcggtgttgaccttttcaaatctttaagaccactttttgtttctattgtttaccccggtaagaagatcgaagaaatccaaacaacaagaaagaatttaagtctagagttgactgctgtttgtaacgatttaggacctttggttttccctgattacgataaattagcgactgagatattctctaagagagacggttatgatgtctcttctgatgcagagtcttctataagtcgtatgagtgtacaatctagaagccgctcttcttctatacattctattggctcgctagcttctaacgccctatcaagagtgaattcaagaggctcgttgaccgatattccaattttttctgatgcaaagcaaggtcaatggaaaagtgaaggtgaaactagtgaggatgaggatgaatttgatgagaaaaatcctgccatagtacaaaccgcacgaagttctgatctaaataaggaaaacagtcgcaacacaaatatatcttcgaagattgcttcgctggtaagacagaaaagagaacacgaaaagaaagaatgatcaaaaaatagaaaaataaaaaaaaaagcatttgacaatgtttgtaaataatataatatgaaagtaactactgaacaaaaacattaaggataacatttctacgtaggaaaataatgtatacctaaataacgacaccaataataacaaaaatcacgaaaaaaaaaagcttacatgtccactaatcttcgccgatcggtatttcgtcttttaaaattctatttaacttaaccttgatctccgtctgagagtctcctctcaagatatccgacacaaaccagacatcacaatccagctgcaccatttcaagtgaccctttcaaaacaccacacaatatattggaataccagagcgatttcatagcgtccatgggtaactccacaaagtcagccaatgggttttcatccaaaatcaatgaaaaagtatccttgttatgcgaccagttcgttatgttgggtgtgatgtttaaaaatattttgaatgcacacttacttagtacttcgcttgtcttcactaaattctcacagcgtggcaatgccgttctagccaagaaatcctcaataagtctacacccaatattatatcccatgctatacaaatgatcattcactttgttaaagtcccgttcataatcttggcacaattgtgccactatggacccatatgttagcgtaaataattctgtattaattttttctgttttatttttccagatctcttctcccatggccttcaaagacctcgattgcgtggtagaaaccatttttgacccagttttggttatcaatgaacacttgaagctttactctgcattcccatctctatagctatgggtaatcacagctacgatcacttactctgttattattatattaagttcaatgttggccaaaccgggtaacatgtaacactttcaggttggccttacctttggcttggagtttcgcaagttttcaaatttttggctcctgctgtcaaggtgcatagaatagcgcttatttatctatttatatccaagatgtacaatcctcgttctctgagtccaacatatttgctcgcaactgtagaaatcacaactacagcaacagtaaagatatcattttctattttcgttattggtttctcgacctttttatatacgatacgtcaaacttgaatcattttatacgtttttctctttctagaaatgccattatgcacgtgacattacaaattgtggtgaaaaaaggctctcataataaactgtgaacggactcataatgaaatttgcttcactatgtgaatcatcgctaataaactcgctacaaaagtcgagtatgcttaagtcaaaaaaatgatatatatatataatttacttatgtgtttctgcaaagttgtaggcttcatttagaattgctcagatattccatcccaattaaaaaaagcacggatagagtgataaataaactaagaaaatttcaaaagaatggtacgagacttagtgacattgccttcatcactgcccttgattactgctggttttgctactgatcaggttcatttgcttattggtacagggtccacggactcagtaagcgtttgtaagaatagaatccactccattttgaatgctggtggtaatcccatagtagtgaatccctcgtcaccaagccatactaaacaattacaattggaatttggtaagtttgcaaagttcgaaatagtagaaagggagtttaggttatctgatttaactactttggggagagttctggtatgcaaggtagtggatagagtattcgtagatctacccataacacaaagtcgcctatgcgaggagatcttttggcaatgccaaaaactgagaattcccataaatacattccacaaaccagagttttctaccttcaatatgattcctacgtgggtcgacccaaaaggaagtggtttacaaatctcagttactacgaatgggaatggatacatcttggcaaacaggataaaaagagatataatatcacacttacctccaaacatatctgaggtggtgataaacatggggtatttgaaagaccgtattataaacgaagaccataaggccttgttagaggaaaagtactaccagactgacatgtcattacctggatttggctacggcttagatgaggacggttgggagagccataagtttaataagctaattcgtgaatttgaaatgaccagtagagaacagagacttaagagaaccagatggttatctcagataatggagtattacccgatgaacaagctgagtgacatcaagttggaagatttcgagacttcatcttctccaaataaaaagacaaagcaggaaactgtcacagagggtgtagtacctcctaccgatgaaaatattgaaaacggtacaaaacaactacaattatcggaagtgaaaaaagaggagggacctaaaaaactagggaagatttctttagtcggaagtggtccaggctcggtatctatgctaacgataggtgcattacaagaaataaagtctgcagatataatactggcagataaactggtaccgcaagccattttagatttaatacctccaaaaactgaaaccttcatagccaaaaaatttcccggtaatgcagaacgagcacaacaggaattactagctaaaggtttagaatcgttggataatggattgaaagtagtccgtttgaagcaaggtgatccgtatatttttggccgtggtggcgaggaatttaatttcttcaaagatcacggatatattcctgtggttttaccgggcataagctcatccctagcttgtactgtattggctcagatacccgctactcaacgtgatatagcagaccaagtgctcatatgtactgggactgggagaaagggcgctctgcctataattcctgaatttgttgaaagcagaaccaccgtctttctaatggcactgcatcgcgccaacgttctgatcacgggattattgaagcatggctgggatggtgatgtccccgctgcaattgtcgagagaggatcgtgccctgaccagcgtgttactagaactcttcttaaatgggtaccagaagtcgtggaggagattggttcaaggccccccggtgtcttggttgtaggcaaggctgtgaatgcattggttgaaaaagatctgataaattttgacgaatcaagaaaatttgtcattgatgaaggttttagagaatttgaggttgatgtagatagtctatttaagttatactaatatgtatataaagacaagatatcattcaaacgctgacgttaaagttttaaggttaatcgtgtatgcattatgttctagattcatcaacactggatattgagcaaaaaggacgtatccgaggcccgaaaaggtccttcaaccaagtcgtcaaaatattggcaagccaaaagagcagcgagaatgattggcaaacggtttttccaaacaacaagtaaaaagattgcttttgcattcgatattgatggtgtgttgttcaggggcaaaaagccaattgctggtgccagcgacgcattgaagctgttgaaccgaaataaaattccatatattttactcactaatggtggagggttctctgaaagggcacggacagagtttatctcgagtaaattggacgttgatgtatcacccttgcaaattattcaaagtcatactccttacaagtcccttgttaacaaatattcaaggatcttggccgttggtacaccttccgtgagaggcgttgcagaaggctacggatttcaagatgttgttcaccaaacggatattgtaagatacaatagggacattgcaccatttagtgggctatctgatgaacaagtgatggagtactcaagggatattccagatttaaccactaagaaattcgatgccgtcttggtatttaacgatcctcatgattgggctgccgatatacaaatcatctcagatgcaatcaacagcgaaaatgggatgttaaataccttgagaaacgaaaagagtggcaaaccttccatccccatttacttttcgaaccaggatttactgtgggccaatccttataaattgaatagatttggacaaggtgccttccgcttactagttagaaggctttatctcgagttaaatggtgaacccttgcaagattatactttgggtaagcctacaaagttgacttatgatttcgctcatcatgttctcattgattgggaaaaaagactaagcgggaaaataggccaatctgtgaagcaaaaactgccactcttaggcacgaaaccttcaacttctccattccatgcggtttttatggtaggtgataatcctgcaagtgacatcattggagctcaaaattacggttggaacagttgtttggtgaagacaggtgtgtataacgaaggtgatgacttaaaggaatgtaagcctaccttgatcgtgaatgatgtatttgatgcggttactaaaacgttagaaaagtacgcatgaaagactactatggaatatcttttcctgcctttgagctgtactgttatgatagatttattaatagcttaaacgcttttacaaaatatatgcaatatacataacgggttaaataatgggttgggaaattggtaatcacggtataatgagtacctgttttcttctatttaaaaaaataaaaactaccaactctttttggtaaaattagtaacctaccaaagtcaatcgatcaatgcatctaaaaaaattcaccttcaccaaagtagaccaattgacgtcatttactgaaacgaatgtgcagggtttacaagtcatctgaaatgctgtccaaattgataggttgaccaggcttgaaagcaggaagacccaagtagggacaaccactacatctaaaggcatcccctagagaacaagaaccacagccgccaactttcttcccatcgatagtgaaatcaatctcggtcaactcgtcttctgtaaatttgacaactttatcttgttgagatcttatatcgtttatttcattttcttcctgttctttcataccacaggtgcaatctttacaagccttcttcttcttagttttggatttaccgcatgtaatcatagtaatcattgacttaccagaaccatcctcgtcgattaattcttcttcttcaatggaatcatcgctggtatccacttgatcaaaatattgggctttggaagagtcactagagaaatcatcatcatcgctatcctcaatcaggtcgtctacgactcggtagacttttggttcagtggtcattttgaaactaggtggtttgaagctgtctgtttccttaactataggttgcctactgtgatctgcttttttgaatgagggtaaattagaggttgaagaactagcttttttaaaagttggtagcttactaccactctgtagcttagtattgttcgttttcttttttttcagtggtatagaaacagtttggtttagtttagaggaatccattttaatccagcaataatctggttcgttaattatttcaaacccattgattaatgcatctactttataaatatcacttaaaccaattagtgagccgtttggtttcaatgagtcagctaagacagaaattaactttttcggaaacttaatatcagtctgggcttctggcgtcaaatagtgtactgtttcatattttgcgttttccaaagttatggacccatcatttagtttattgattaaaaactggtccacgaacttgactttctttgatgcagcttgagccttagtgttctctactagctctggcgttgtagtcaccgccggatgtattaaaagtaaaccagttttgtattgtgacatcgataccttcacttacagtgtatatgcttagatcaaatgtgatgaaagacttctgcttagaatacctttttaatatgtcatgaaattaaatgattactaatcatttcttttttttattttttttttccagaagcttttgaatagtatcggacttattccggtaccgggatatgtcaaaaaaagaaaaatgagaaacgaatagatatttacccagaaagtaatgaatgtatttaatgaattactgaattattaaaattagtaataaatagcggtttatatgaagagctctatgtacgctagtatggcattacatacctactgcaagtaaaaaaggaaaaaaatttgtgacattttgtaaatatgctgcgtgaatttgcctaatgagtatttttccagaaattacaaaacacaaataagtagaatgtgtttagtgtatttgtaattcatagactatttattgatgcttatctattatacctggggtttctgcttcgtcctcgtcctcgtcatcatcgtcgtcgtcgtcgtcgtcgtcgtcgtcgtcgtcgtcgtcatcgtcgtcatcgtcatcatcatcgttgttgttttcgttcttatcttctgtatcttcttcttcgtcgtcgtcttcttcctcatcctcatcatcgtcctcttcctcgttattttttgggtacccacccaatttcataacgattttgttaacaatctcattccagtccatcatacccccgagaccaatatcaccatttatatccataactttctcagacggcttgaaaacagtgacccaggacatttcctcctttatcgtttgtagttgcttctttgtcatcatagaattaaaagtgctactcaccatagaaggtgccaaaagaatgggataactcggattccaagctctaatgacacttgtcagaagattgtcgcacaggcccaaagcaatttttgataatgtgtttgcagttaatggagctactaccagtatatccgcccagcgacgtagttctatatgaagtacaggatcagttcgttgtttccatgcgtcccattcatcttggtcggtccatagttgaatatgtgggggtaactcgactacttgagccatgttgcattgtcctggtgttggtgtcactggagttgccggagtggattcgtactgcgacattttatttagtttttctgaagatttgataattttcttggtatatctttgttcgaaaaactgtgttgctgattgagtgaggataacttgaatgcttattctatcacgtccatatatttcttctagttttttaatcattggcttgatcttaaataccgataacgaacctgtagcgccaaacaacacgtgcaattttccatcatcttgaggtagtctgggatccaaattcttggagttctctcttttggggatgatggaaggaatgacggactgcttcactggcgtttcttccggggtagaacgcacattaatttggcctgaaacattgttagcttgatcttgtgcatcttcctttcgaagtgtaatactggtgggggctttggcggttaccttattattttctctacttattggcgttgaagtggccatgattttgtcaggcttcatggtatcaactattttaagagcactgtcttttttcttaggatcataatctttcatttcgttgacgagtggagacccagataattgcgttgttcttgaagtgttggtgtggttcggtataactgcatgattgccaggaatggaatttgagacaggagcaggattactatttggagacttggtcctttctgagtcgttcttcagctgagtcagactatcctgcttttgctgttgctttagatcactgaaagtgacggcggggactctcttcaaaccaggctccggagtattacttactactgcgccggaggtgccggtggcattcataatagatttcgtagtcgtggtagtagcattcgacaaagtagggcttattgattgcctccctgacacgggggagttgattattgaatccttccccttcgcatcctcatggtccaacaaaatctctttctgtccacgcgaaaaccttggacactctatagactggttatggtcagcatcttgcttcccgctagtagaggcgacggcagtcattgctgtttgcttctagatctttcttccctattaattttttcctaactaatatttctttatattttatcccggaatataaagtagtatgacagcaaagaaggccaggctaaaaaaagatctctccaaatgtaactggacggcgctgataagtggacaagtacaagtgagggatcgtgatccaagagcactctgtgacttcttctcctctaatatcacctccccagaaaagcatcgatgccattttttgcaagagaaaaagttgcgtgcgtcactgcccacgagcacatggggtgagttatataacataagaatattgctttgactcatgttaaaagcaaaagaaaaaataataatgatcattagagatacatcaaagacgatcatggcattaacccagggtacgtgtgttagatatgatagggtaccccgcgcgtataagttacgccttgaatgatataacacgttaaagtttctagatcacgtgaatcattaccattttttaggtcatcctacggataatggcgaaaccacataattgctttgtagatctctttttatgctggatggatggccctctggaatgcatccttcacgaacacaatttatgaaacctcaggtttgatgctccggaaagcctatttctcacgttttccggcacttaatgcgcatataaaaacatagtctctacgttacgaggatttatcatagaacccaaatcagcagtaataaatttccacggtcaaattaaactcttgtcgttgatatgggtgtagtgtgatggtggtgaccactatttcgcctttattagttatttatatgagttagccctccgaagaactcatccttgttagctcagttggtagagcgttcggcttttaagcgcatttgcttaagcaaggataccgaaatgtcaggggttcgagccccctatgaggagttctttacttttttagattcggcgttcaatgctaaagaaaaaaaatgaaaataagtttcaattaatagtgaaagaaaaggaaggaagttagaactgaaatgcgtagactacctcccccaaattttttcttgtttggttgcattatttcatgaattcaactaaaaggctgaaaatgtcaacaacctttcatgattatgacttggaagagccattaacctcaaatgccagaccactaaagaactccgttattacaatccgagtaataaaatctttcccatatagaaacgtcaagaacatagtgctgcacgattacgatcttgctgataaaactgcaaaggacctgttcaatgacgttttgaacaaaattcaaaatgaaggttcattcagaccattccgtaatgttaagtttgatactttaaagatatacacgcacgcacatggttccaagacggttaatctcgtgatcaattttgaccacgatgacgactggactttagacatagagaatgacaaaaaaaagctgttcgagtatggcattgagaatgaaaccgaaatttcgcttttcaacaaagaggattacctaaggtttaaagaaaaccctgaagaaaaatggtgagatgttgtttggcttatggccttcattaataagtaagtgctatgaatatattacatatatatatatatatatgttgtgtacgagagtatactcgtatgtaaattaacatcaaatgtgtatgtggaaatgcagaagagagcaaactctcctttaaaaaacaacctggttcctataaaaaatgtcttcttccatagtgccaaatgtatagttgctgaactcataatgagcttcttttattgtttcatcagaatgagaactattttgatggtgatggtgatgatggcgacgatggtgacggcgatggtggcgggaatgttggatatcgtttatgttgatgagggattcgcggatagtcccctttgagtcgatctccctcttcatcacggcttggttaaacttcaacttcctggggaattgttccttcttttcgttcataaggtcttcagaatcttcatctatggaggaaattttagtgcatgtagaatgctggtcgaaaatggaagacgtgtgagaatcaacagacgatgggcatgaaatgtcttctaatttcaccaaagcgttgtcattgctctctatagaagcgttaatctcatccacctcctcggttacccagcattccgtatttttctttaaagcagattttagattttttgtttgtttctggtcaatttggttctggaccggcgatatttcgttttcattactatctatgttagtcaaatctggaccgtacaacaccgttacatcggtttctttgttccagttgatggacagtggattggatttggagttctgtaaaccatagtgatttatggaccaacgcctccagaggcaatgatgtagcctaacgaggtacatgttgtaatctagcacgtcctctgaagagcaacttggtaatcgaagtagtttatgtttgcgcatcttcaatagtagtgtccatgaagccgatatttccaagcttgcatcattaaattcatgatggaaatagtcaatcgcaggcttgttgtagttggtcatgttatccagtaacattatattctggtacgaaattattgtatcgtccaaactagtcattttctgtatatgtatctatttgtgtgtgtatgaacacttgtgtgtagtatctgaatgcgataagagaaagggccaaagttgaactgaatgcaaaaagtaaaacctataaaaccgtgttgaccatacgctttcatatatatatatatatatgtttgtttttgctaagacccggtaactgtactttttctgcagtcatccaagggaagacaaaagaagaaagaaaaaacaagattaatgtccccaggttttttcttttcctggcggaaaaagctcaaatctaacatttccccgcgggggtttctttgtaaagagtatcgagtcggaaacgaaaaaaaaaaaaagatgagaaaatgaatttttccggtcgcctaaagatagaggtaccagcggaaaaaatgcagcaaaagcaaaataccccattcaagttccccctgtctcgcccctctcacgcttcactgtcccccgctttcggtttttccggctacggcatttctgttgaaagttgccggaaaaaccccaaaaagcataaaaaaaaagagcggggggaagaaaaaaagattcctttctatcttttccttccccggcctattcgggtactcgcttccgggtccgctgtcgtttataatgattagtgcagagagctttcttctcttagtttttcatgtggtaaaggcaatgccatttagaaggatactacgtggggttcaaaaccgtgaatacgttgtctatcgtgttatgtatgttctgagtttctttttgtcattctactagtttatggactgggactatgtatcttgcagtatgatttcgtcaggaagcttgtcatagcaaggcctgaacaaatcgtacgttaaaataaaaatgagcaccaattcgagtcactgatgcctactgctcaatccaaccatctagttctgcaaagatacttactccgcataattaaaaaaataaggtattttaaagttgtgtagtgacgaatgtagtgacgcggaaacgttttactcgtcaatggacatttgcgaatgtgtccgataaatagttgaggcttttcctgcattctgtcaagaagggtatgtgtatgaacatgcaaatgacactgtaaaatgattcattaccctgattatggagtgattttctttcctttttttttttacatttagtttcattattatgcaaattagagggtatacagttgagattttaacactttgaattaaaaagtgttacagaggaaaccgacgcaaaaggcttggtgacgcaaacttttccatctttatttcacctcttcagacggtcctaagaccttttgaacgtatcaatatagttttatcatctgttctctgttgttctccgttactaagatattagtcagctcttgaaatttcacacccctatttatttgtcttagcgtccaacccctctcaacccttttccatttcttgtataaaggtagttaattaggtaacgctgctcttaccatcactacagtgcttacgagaatttacccaaaccctgcgcaagataaataagaaatgtcgaaacagtgggcgagtggtacaaacggagctttcaaaagacaggtttcgtccttcagagaaacaatctctaagcaacacccaatttataagccagcaaagggaagatattggttgtatgtttcacttgcatgcccatgggcccatagaacactaattacgagggctttgaagggattaacctctgttataggatgtagcgtagtccattggcaccttgacgagaaaggatggagatttttggacatggaaaagcaattggaggacagtgaagattttttggaacattggcacgatgttgcaggtggtattagaactgctaaagaggattccagcaagagcttcgccgagatcaagaatgacagtcaaagattcatggttgatgctaccaatgagcctcactatggatacaagagaatcagtgacttatattacaagagcgatcctcaatactcggcaaggttcaccgtcccagtcctgtgggacttagaaacccaaacaattgttaacaacgaaagtagcgaaattataaggattttgaactctagtgcgttcgatgaatttgtcgacgacgatcacaagaaaacggaccttgttcctgctcagttgaaaacacagatcgatgacttcaattcttgggtttacgacagcatcaacaatggtgtatacaagaccggattcgcagagaaagcagaagtttacgaaagtgaagtcaacaacgtatttgaacatttggacaaagtggagaaaatcctgagtgacaaatattccaaattgaaggccaaatacggtgaagaagatagacaaaaaatcttgggtgagttcttcactgtgggtgatcaattaacagaagctgacattagattgtatactaccgtcataagattcgatcctgtgtacgtccaacatttcaaatgcaattttacctctattagagccggatatccatttattcatttgtgggtaagaaatttatactggaattatgatgccttcaggtacacaacagattttgaccatatcaagttacactacacgcgttcccacacaaggatcaaccccttgggaattacgcccctgggacccaagccagatattcgtcctttataacaagctgtaattaaataatcaaatgtctataatctccctgagttgcctctttttctatactcaattgggtaattgacgcgaaacgcgttaaagtgcaaaaaaaggcctggaaattatatttaacgcaatgaaatattttcataatatgacattcatgcacagctgtattcattcttctactttgtagtttgttattcttctttatcggtttcgttttacaaaagattttagcaaggaagcagtttttaaaccaatcaatggtatacacaacaccgcaacaacagcagagattcagctccacaccgcaatctagccacactcttatcttctcgccaatcagagccccttcaatgcaaacgccctcctcattggattaccaatcaccttcaattgttgtgtcatcgtcttcaatgaaggttcacggccggtcttccagtttcggtaaattttcactgtctattgggcaaaatggtaaggctacaatactggggcctataaacgtccttcccactgatacatcgaaaatggagaaacctgtaccaaagaaaaagcctgttacttctgaccgtgtcgaaaagactcgtatattatctttgttgaaaaaaatgagaaacaagagcagtactgtcaacaaaaaatatagtaaagtaccattaaagtctacgacaagtttgcaaccagcagctactgcaccttcaccactagtgtccaacatcataaagccgtctcccaaaaagttagcttccccaagaactccgaatgcaaactccaatttaaatctaaactttacttcatttcagattaaaacaggtttcactcccaatctcgatggaattttacttgaaaacttcacgtctcctaacacaaccgctgattcacagggtaattccgccagtaacatcataaataataatcacggtagcgcaaataataccaaccaatttctttttaatctaccacttcaatcatcaccaaggcaattcaggtctcctgcaagattaatagatccccttcccatatcggactggaacaccagtctcttgatgtcacccccaagaacgacgaattttgaatctgcaaacaatcacttcaattcaaattttgctcaagcatcgatgttaagacgcccttcactaccgcacatagatgaggtgattccacaggactctaatccagccaattactcagatagatcggactatctatctgtggaccagaacgccaataatcataatggtgcactttcagaacagacctataataatataatgaaatcttctatgatttcgttacctatagaaaaagatgatgccacaatggcactacgaaaacttgtctccagagagtaggtccatttggttttcgtaaaatacactacgtaagatttcattatatattcaaaaccgaagaactttatttaattaattctattcaatattttttttttcccattaaattgtgtagtggaagcaaaatgcactgcgcttatgtgaaaaagttacacaatagggaatacatggaacagcagatcagaactgcaaccctacagattagatatggagaacgacaaggcgtcacatgcgagcccaagcattggagtgaacgaatttgtcgttcaaggggagatatccatagacgactccgaaaggtctgtcaagagtgttagcgttagcataagtgatgatgaggatagtaagacagatgtacaagataatatggccacaccgtccacaagatcgaaatttcaaacagatctggccattgataataggctattggaaaaagatccaaagtacaaaaaacttttcactgaaaaaagaagacgtcgaagaccagaaagctgtattaacctcatgactaaaggtaagggcactggacaaaaagataacattaatgatcaaattttcagcctaagaatattaccaggctccgatttaaactctttaaaggattctttatggataataaagatctctacccagccagatgttgaaaaaacaatcgcaagagctttttctgatttctattggttatatcatcaattacaaaataaccactggggaaaaacgattcctccgcctacaaggtccaacattcttgtagagaaggacgaatttgccataaatcatctttttatgatacgtaataatgagaagtatgatccaatttttaatttcaaaccggaatatatcatatcattgcaattgatggcaatgattaagcacatattcaatgacaaggttttacgtttggattcaaatttcatagattttattagttgggatgacgatcttcctgaaagtttgcaaatagtagtcgatgacagtaccttcacaggggataaaatactaatgacatcttctcaatttcgagaattaaaagagtttcataaacaatcaaaaaaagtggaatcaataacaaattcacatgcttcgttaatacccgtaacagaacttaccgaaatatatataagcccgaccaaattattctctagaaaagactaccaaaggctttttcaacctcaaagcacagacaacacctttaataacaatgacccgttgattcaagagtggataccaaaaagcaaaacattattcactagtttatcctttggttcaagtgcacctacttatcaagaagcgtcaactgagatacaggcatgccatgactgggtaagcatatccaaggagcaatggaaacagttactctaccatgtattacagtacattgtagacgaggcagtgaaggtgaattctgtgataaacgaatttactgagtgtcttaagcaaatttctttggacgaagtcattagagcaaactctgaactatttttgaaattttccaaactgaatgaatcctttctaaaaaaattcaaaggtgcatcgaggcaagacattctgaagctaatcatattatttgatgaaaatgtaagattttgcgaatcatttgaatccatcttaaatcaaagattgaagcttggtaaaattctaagcatcatagaagtggatctagacaagaagaaaaactttcttgacaaactatctccgggaaacaacaacagtaacaatgaagaccttaagatacgcacggcagaggatgaataccgcattgtattaaaaagatataaccgtgttaagcagagctgggagaaaattatggaagatatcttaaatgaacggaaagaatttgagaagagagaagccgccgaggttaatagttgtttaaaatcaataagagatttgaacatggatgaaaagaaacactatttacaattatggcaagactttgtaccagatgagcacataagccaatgaatatgtacataataacgtaattaaagaagataatttactactgaaaaagcaacaatataagaagttaagatgaattatactaatttttcttgtgtttcttaagtttgacttccaaatcttgtacgctttcaacgtcatcaacatcttcttcttcttccttttcttcaacaaatgccttattcagcagtggaaaaatacgctgctgttcaccaattttctcataatcaacgatcatactgtcgaaagcaaaacaaaattctctcgccatcacatcaatattattgtctaattggggcaatttgggatatctctgggaaaagtgtgttaagatcaacttcctagcattcattttgttcgaaacaccgattgcttcattaatagtgcagtgttttttcttcacggcatcctccagtagctgattttctagtgtagcttcgtgaattaatagatctgaattatagcctatttcgagggaaaatttctcgatgttaggtcttgtatcgcctgaatatgaaaccttgaatgtattatgctcattgttttcgtccattcggaaggtaattgagttcgaatatgcccagtcacaatgtatagctctgcaagtttgaaaatattctatcgataaatcctcatacatttgtctgatcaagtcaacatccctatatgaagaatctctatccagttccagttttctgtttgattcttgattgctattttctttcaatatttcattgaactctgccaaaggaacagattgtgtctgcattcttacaaacgaatcattgatgaaatgctcacaacttatgtatttgattctctttaaaatctctttattttctagaactaaccattcattaacaaatttgtgatattgccatggagtaaccacatatatataactcgtttcatcatccttgttatatttgtaccattcatttagcacgctgattattcccaaatggtggtctgcatgcaagtgactcagatatatcattttcaaatcctgaaatattgacttgactgctagctgagaaaacatcctgtgtatggtacctaaagtattttcaccagcatctagcataatgtttctatttatggtatttccatcggcgtcagtaaaaggaactttaacaagtgtggagacaacgtttctatatttagaaggcaatgcactaccggttcctaaggtgataatttcaacgtgtttcttcttttctgctgaattgttaaagttatccacgtgtagttgattattgataactgtatcgacatcagctaagggaaattctaatggttttacatgttcttcgaaaatttcttgccacgagaaatccgccacttcaccgttgatgttgcatttcatcggttcttcgttcatccgaaatggttcgaaagttactgtcttgttttgtgaaaaaatatgaatgttatccttctctattattgtattcaaaggctcttcctgggatttacacatagatgtacctctgctgagtggtgtatcgaatctgtcgtagaagtccttggaaaacacacgatctgtttttggtaaattgtaattatttacttgtagtgcctttaatttcaatgtggtcaatgcagaaccgaaaaatgatatcgtgtttggagaaattttattgtgggatatcatatgatttactttaccataattgtttttctcaaatatgtcaatgaacgcgaatagattatcattaatggtaacctcatcaccaagaaaataatacaccatgccaagctcagcacaatcataatccttgaatttttctacgaaagcgttcaaatataggtcatctgggatatccaggatcaatactttggcaaaatgacgttcattctccaatacctgttccggagttacaacaataccgttatccaaagtaattgtttggcccttggttaactttgcaaataagggacccttcggaacacctagtttaatagcttcctccactttaaatttacccctcactggactgaatgaaatctcgtaattcgtagaaacttccactttggcgtctaagtcaggcaactctacattcaagtgcggatcactagaaggatcgtacctatcggtgggtgcatgtttggggaacatttttgctactatggaacgtaatacacctttttgaaaactatcgaagacgcctaacctgtcttcccccccatttttcagaacattaaaggatttaacagctattatcttatctttatatacttccttgtctttcataatgtgatcgttcaagtctattccgaatctaaagacgaagtatctccaagtggaaactatgtaattcaaaatgtcattgccgtaatgcaaaacaagattacttttcccttgatcagcaatagtcaaaatcattccaggtaatccacctatatctgaccagtttaattcaccagtaaggaaaatatccttcaatttggatatcctgatcttattttcagtcagactcctttgggatccttcaccaattttaccgaagaaatacttttccccatgtgcagactggactagcagcaatgggtgctttgtatccgatgtaggatgggtgatgggtataaatgtgaacatcgttgaaaaccttccaggactcttttctttgcgggtggtcgttctattagtctgttgctttttaggtccctttctgtatgatttatacctcctgaccaaatgggaaaatgcagatgagaaggatttcaagtgtgaatgactatttagtagtatattcgacagtttgaattatgcttgaggaagattatttcactgccgctctatatcctttcgggtattttagagagagaaaaggaggcaaaaaacaaccacctagacagaatcattaaaaggtggtatgaactgccgaaaaagggcccaagacaaggtttaggatgctaattatgtcttccctttacgtcagttatagattatgcgatgcccaaaaatttttttcactgcgggtaagtgttctgaaataccgagcagttactatgtagaaacgctacgtcctcgtttgagatatcagtgggcgatattaatgcaaccaggaataccgcaaccccattacaatggcctagcaaacattctgtaacagcaattttgatttgttgagtgggttgctcttttttttatagcatgacaatgatatccgtaggaacagtgacatcgtatttcaaatatgcattcgaaaaaaaataacccaactgaggctgtagtatattgtttatgcaggctgtcacctccataaattgatattttatggcattattcgctactccaaggtaccctaagaggccctacttttttgcgaaaaaccccaagacaatttattcttttcctagtccaagtcctgacaaaaaatgaaagccctgcgactctttttggcggagtcagcccgaatcaacacaagccctaatattcccaatgaactggtaaatagatttctacaacgttgtaaagactaatattactgtctttactattatgatatattgactcagtagaaaaggaaaaaaagcaactacgcaaagtatttaagtgccttgcaaccagcttcttcttgggctgagatacaatacctccttgtctattcaagtgtacagtatcgcaaagcacagtaaaattaattcctatcaacacaacccatcaatataaatctatagagaaatgtcgaagcctggtcgtactattttagcaagcaaggtcgccgaaactttcaataccgaaataattaacaacgtagaggaatacaagaagacacataatggtcaaggtccccttcttgtgggattcctagctaataatgatcctgctgcaaagatgtatgctacatggactcaaaagactagcgagtcaatggggttccgctatgacttaagggtcattgaagataaggattttttggaagaagcgataatacaagctaacggcgatgactctgtgaacggtatcatggtatactttcctgttttcggtaatgctcaagatcagtatttgcaacaggttgtgtgcaaggaaaaagatgtagaagggttaaatcatgtttactaccaaaacctgtaccataatgtcagatacctggacaaagaaaaccgtttgaaatccattctaccttgcacaccactagctatcgttaagatattggaattcttgaaaatttacaacaatttgttaccagaaggaaacagactgtatgggaagaaatgcatagtaattaacaggtcagaaatcgtcggtagaccactggcggcgctattagccaatgacggtgccacagtatactctgtggacgttaacaacattcaaaaattcacccgtggtgaaagtttgaaattaaacaagcatcatgtggaagaccttggggagtactctgaagatctgttgaaaaagtgttctcttgattcagatgtggtcatcactggtgtccctagtgaaaattacaaattccccaccgaatacatcaaagaaggtgccgtctgcatcaattttgcatgcaccaaaaattttagcgatgatgtcaaggaaaaagcttctctttacgttccaatgactggtaaagttaccattgcaatgttgttgagaaacatgttacgtttagtaaggaacgtagaactgtctaaagaaaaatagaacatttgtggctgttcaaataagcataggtaaaacagaatacataaaaataagggaaaaaaagaaagatcatttgtaatgtacttactacatacatatagaattctcctctcttagattatcatataatatacaaagtttatgggtcttatttcttctgtcttttagcagagggctcaatatcagtggcactgacgaactcttcttcgtattcttgtccatcatccgaatacgacgcttcatcttcgtagtcttcatctacctctccatcaccttcttcagttccttggtcgaatttggatttcaaacccttcatctttcttgtttgtagtttacccaaatcttgtttgcccatatggattctacccaatttatcacccatgatatctaattctacattcttctttgtcttcatttctaattgttttggcttcttgtgagcttcagtgaccatatctggacttggagtatgaattctgccgattttgaaatctagacgtggcccaatctccaccaattcaatacgtggtaatctcttaccaccttggtcgcttttataactttttaatttgtaaacacggaatagaacgttcggcaatggctcaccatcttggaagtcaccttgaatggtcatggaaatgacatgttgtaatcccgcaacatcctgtaaatcagtagattcgcctctaaagaaatctaaaaacaaagatttaatttgcttgtatacgggatgtgtatcaaatgcagcaccttggaatgtaaacataggcttcaaccctacagtaaatgttaatttcttaaaatcagataacaacttgaaattatctgcaaccattagttcaatcatatcatatattttgtagccaaatgtacgtataaaggtcatgttgtttttacgctttttggaacttgtcatcagcaccatcaatgaacagtcattcttttcactaaagaactctagtggcgacatgtcttcgaaaggatgaatatcattcttacgattgaacctcttcatatctggcttcttcaaggcactcaaatctaccataatatcgtgcagattcttgttacagctttgccctggaatgaatagcgcttgcttgacattctctaccaacttagcttccctctttaccaaagctctcttggctcttgcattcttgggttttacggttctaatcattttttctgccagtgttctcctgcgcttttggatatgataacttcaatacaactcatcgatataccaaatcactttccaataatgcattacactataagaaaattcgatccttagctcatcgcaaaaaaatgaaaaattttcaaatcgtataaaacgatatatttgaggatttaggaatcaaaatagcagaataaaccaaaacatacaccatttaggaataaggtttagaggagctcgagcatactgttacatccaattcaagtgaagtacattaggatagccatatgagtgaaaaaaaagtacatcttcgtttgcggaaggaacttagcgtacccattgcggtggttgaaaacgaatccctggcgcagttgtcttatgaagaggaaagccaggcctctctaatggacatttccatggagcagcaacagttaaggttacattcgcactttgataattccaaggttttcacagaaaataacagatacatagtaaaaacccttcaaacagactacagtagcggattcagtaacgatgacgaattgaatggatatatcgatatgcaaattggatatggactagtcaatgaccacaagaaggtttacatctggaatattcactccactcaaaaggatacgccctatataactgtaccatttcgttctgatgataatgatgaaatagcagtcgcgcccaggtgcatactaactttccctgctacaatggatgagtctccattagcactgaatcctaatgatcaggacgaaaccggagggcttatcattatcaaaggtagcaaagcgatatattatgaggatatcaactccataaataatttgaactttaagttatctgaaaaattctctcacgagttagaattacccatcaactcttcgggcggagagaagtgtgacctaatgttaaactgcgaacctgctggtatagtgctttctacaaatatgggcagaatattttttataaccattagaaattccatgggtaaacctcaactgaagttaggcaaactattaaataaacctttcaaattgggtatctggtccaaaattttcaatacaaacagttcagttgtctcattacgaaatggacctatcctcggtaaggggacaaggttagtatatattactactaacaaaggaatttttcaaacatggcagttgtctgccacgaattcccatccaacaaaattgattgatgtaaacatttacgaagccattttagagtcgctccaggatttgtatccatttgctcatggtacgttgaagatttgggactctcatccattacaagatgaaagttcacaacttttcctgtcatctatttacgacagttcatgcaatgaaacatattatattctttccacgattatcttcgattcttcttctaatagttttactattttttccacttatagattgaacacttttatggagtcaataaccgacacaaagtttaagcctaagatatttatacctcagatggagaatgctaacgataccaatgaggtaacttccattttggtaatgttccccaatgctgttgtcattactcaggtgaactcaaaattggactctagctattcaatgagaagaaagtgggaagatattgttagccttagaaatgacattgatataattggttctggttacgactcaaaatctttgtatgttttaacgaaacaaatgggggtgctacagttttttgtgaaagagaatgaggaaacaaattctaaaccggaagttgggtttgtcaaatctcatgttgatcaagctgtttatttctccaaaataaatgcaaatcccatagatttcaatttacctccagaaatttcactagatcaagaatctatagagcatgatttaaaattaaccagcgaggagatttttcattccaacggcaagtacataccccctatgctaaatacgttggggcaacatctctctgtccgtaaagaattttttcaaaatttcctgacatttgttgctaagaacttcaactataaaatatcacccgaactgaaattggatctgatcgaaaaatttgagatcttgaattgctgtattaagttcaatagtatcatcagacaatctgatgtattgaacgatatatgggagaagactttatcaaactataatctgacacaaaatgaacacttaactactaaaacagttgtaatcaacagtcccgacgtatttccagtaatctttaaacaatttttaaaccatgttgtgtttgttttgttcccatcacaaaatcaaaatttcaaactaaatgttaccaatttaatcaacttatgcttttatgatggaattcttgaagaaggtgaaaaaactataaggtatgaacttttggagttagacccgatggaggttgatacatccaagctaccatggttcataaactttgattacttaaactgtatcaatcaatgtttttttgattttacatttgcgtgtgaggaggaaggaagtctggattcttataaagagggcttgttaaagattgtgaaaattttatattatcagttcaaccaatttaaaatatggatcaacacgcaacccgttaaatctgtgaacgccaatgataattttataaatatcaacaatctttatgatgataaccacctggattggaaccacgtcctttgtaaggtaaatctaaaagaacagtgtattcaaatagcagaattttacaaagatttatctggattggtgcaaacattacaaactttagatcaaaatgactcaacaaccgtatcgctatacgaaacattcttcaacgaattccctaaagagtttagctttacattatttgaatatttaatcaagcataaaaaattgaacgacctcatcttcaggttcccacaacaacacgatgttttaatacagtttttccaagagtccgctccaaagtacggtcatgtagcatggatccaacagattctggatgggtcgtacgcagatgccatgaatactttaaaaaacattactgttgatgattcaaagaagggcgaaagcttgagcgaatgtgaattgcacttgaatgttgcaaaattaagctcgttgctagttgaaaaggataatttggacattaatactttgagaaagatccaatataatttagatacaattgatgctgagaaaaatatttcaaacaaattgaaaaagggcgaagttcagatatgtaaacgcttcaagaatggctctatcagggaagttttcaacatattagtggaagagcttaaatcaacaacagtagtcaatctatcggatctcgttgagttgtattctatgctcgacgatgaagagagcttattcataccgctaaggcttctttctgttgatggaaacttactgaattttgaagttaaaaagttcttgaatgctttggtatggagaagaatcgttctactaaatgctagtaatgaaggagataaactgcttcagcatatagtcaaacgtgtttttgatgaagaactacccaaaaataatgatttccccttgcccagtgtggatcttttatgtgacaaatcgttactgacgccagaatacataagcgaaacatatggcaggtttcctattgatcagaatgccatacgtgaagagatatatgaagaaatatctcaagtggaaacgttgaactcagacaactcactcgagataaagttgcactcgactattggttctgtagcgaaagaaaaaaactataccatcaactatgaaaccaacactgtagaatactaatatctataatacaattttacatatatataataaactttactggggaatgataataataaatatgtatatgctattatcgcaactgccttcttccgatttatataagatccttttctttctgttcattcgttaccatctaccctaattctgaccattgtttccggcaagggtaccagatcttcatcctcatcattatcttcatcattcttatcattttcttgcgcttcaagacctgtttcatttgattgttcagattcctttttcttagaatctttccacggtcctatctcataatcaccctctgcatattgcaataatcccaaacttgcttgcgatatattgtttattatagaatcccaattgttcatcaattgggccactgaatccgcattcattcccatttctttgatctgctcattcaactctgttagctgaatttttaagccatccgttaaactggttatcttttgtaatgactgaagttcttttcgctttatagcaatttgttcatctattgaatccataataactgtctgaattatgagtttttcaaacctattcaatagttttttagatatattcagaggcaggtattcttttgtattgtcgccctctaaccttttgtaagtactttcatatttttattttcgcgttacactaaattcaaatattaaaaaaggatcgctattaatgtgtagaaattgaaaaaattacatacagaagcgtataaaattcttatcatctattttcacccttctactgagttatttcggatattttacctgccgcaatggttctaccgtcctttctaagaacaactcttcccaaacggtcattttcatgggcagttaataaaggaatccacctctttacttcaattagttctatttctacaaatgctcgttgtttagagcctagatgtctaatctttttcttgcttgcagtattgcccttgtctataaatgaaatcaatcttttgattcgagcaggttgctccttgactccgatgaaaagaataaacggtgttcctggcagcaaaggtcggttcatgtcaaaggtggtcaattccagaacaaaacactgtgctgaatgaatggacgaataatcaactgatgctgccaaatcaccattttgaatatcttctggataggctttgcgcaatttcaaagtgacaaaatcacccttaatggcaacatctgtctcttcgtgattcgttgattggccctgttgagaaccaacctgaattttatccacaatacaactctgttccgacggatatattgtcaaagattcaccaggttgaatagaacctgattccaattttcctgaaactagtgctaaatcgttacttgtttttttcgatgggatgatctccaacacagaaaacaaaaacggatcatctttgttaattccttcattctcctttgaaatcttgaacgccgcattttccaaagtagacattaagttaggaccattgtaccattgtctcacttcatctgtatattcaattttataaacaccttctccggaaaagccactgataggtacccaattaatattatcctcaaaaaacccaatatcaaccagatatggcaacaatttcgatttaatctcttcaaacctttgttgggaccagtcaacattatccatcttattcatagcaataatcagattgtgaattccaagactagatgccagtagcatatgctcctttgtttgcccatccaagtcaaatcctgattcgaaagcattggtgctacagtctacacaaagtatagccatatctgcttgtgatatccccattatagcgtttggaacaaaatctctatggcctggcgcatccacaatagtaaaatttgccctatgggtagagaaatgcgatgtacaaattgacactgttacaccacgttcgcgctcttcatttgtctgatccataatccatgcaaatttgaaggatgacttacccatagtttcactctctctttgtagctttctcagttgggattggttgacaatgttcagatcataaagtagtctgcccattagagttgattttcccgcatcaacatgaccaagaacaacaaaacttaagtgaggtaaggcagatttaacaaatgcagaaatatcatgaggtttctttggtttcgttggcaccgtagtcttatagtatctttgaactgtcttttcatcattggcttcctcaccattgcgttcaccctcactttcttcctcgtcaagccagtctggaagccgatcatttggcctttgttgcgaaattgagatgtttgccagtttttgagtaacattcgcactcccattagcagcagcaattggcttctttggtgtcttcttcttcttcaaagttttcttcaattccgccagcgtgctttccaaatcgaaattgttgtcaaacaaagctagcttaagtgaaagattatcccagccttggtaatcctgtaactgcgcctttagagtaggaaatacctcgttcattagatcatattcatcgtcattcaaataatcatcaaattcaccttcgtcgtgaaagtccggcatgtcgtctgctccatcgctgtagtcactgtaagccatctcgatagtcaatagttgtcgaagcagaagcctttgggtgtctccaagctgtacttaactctttttaaattgcttattggttagctttcatgtggtatattcaagtcacattaatgggcgtctccgtgcattgtgatcaatatatgaatacgaagtacttatagagtagtatttacacgattgttattatatttatatagcattcacgcctggtaccacaggagttttctacgcttacggtcctctctggctatacgcctcttctccttccagcgtgattggatttcttgcaatctactttccataatttgtacatgttgttcactaggtttcgagaccatggatacaaataatggcgaaatgccatattttgcagccaaaaatttgcgtgtatacttttgaggattgtcaagacgtaacttccggatctcatcaatttcttgaggtcccagatgataggttttgccgttcactgtgctcttacctacgagaacatttggacactgcttcgctttagtgctttgaacaggcatgtcaagccctctacgagggtcactggctgccataaagctacgtggaatggtctcactgttaacagatccggttgcgatggattctgatggttgatagtacattcctggagcatctctgtgctttaaataccctttatagttagatgcgctcttagtcttgttgtaaatcgttgtcacttgtgttttgggaaatccaaattgcttccaggcagatccagcagtgtggaacgatctgcagcacacacctctgccaatcattcttgtgctattttactttgtctttaattttccattttaacttgttgaaagtatctctttttgccctcttttctattttctcaaataataaaagcggtgaaagctgaaaaattcatgagatgactgcagatgataaaacacaagaaggcccaaagacaatacaaatacctctggtatgggtcattcggggcgtgaggaaaggataaaagacatatttaaggaacttacgtcaaaagaactaacgcctgggttgcttttgacactgcagaaactagcgcaaaagccgaatactaatctagaacagtttattgccagctgtaaagctttgacgaaactcagcagtaacaatccaatcatttttaatgaacttctggagctcctcaagaataaatctgaagaggactcgacaggcccaaagaaaatcgccccttctataaataagagaaagaaatttaagatccagttagaccttgacgataatgaagatgagctagattctccagttcaaaaaaaaccagcacctacacggacgttgttcaagagaatagataaactaaaggccaaacagttgaggcagtattcgcccaccgtgaaggatccttctccaaatagtgaacagcaaacacagaatggtcatgctgaaacgaaggactatgaaccgactcgaagcgaagtagttgaggaggacagagaatggtatgataatgatgatgattatggaaatttggtgcctgaacctctgtctgaattgcctgaggaagcgaaactactacctgtcattaggaatatcgacaacgatgatgccttacgaaataccgttcaattataccccataccactcaagcaaagaatggaatggatccctccttttttatcaaagtttgctcttgaaaacaaagtgcccacttccataattatcgggtccatctctgagacgtccagccaagtatccgctttatcaatggtgaatccatttaggaatcctgacagtgaattttctgcgaacgccaaacgaggtagtaagctggttgccttgagaaggataaacatggaacatattcaacaatctcgagacaacaccactgttttgaacactgccatgggggaagtactaggcttggagaataacaataaagcaaaagataagagcaaccaaaagatttgcgacgatacagctcttttcacgccatcaaaagatgacattaaacatactaaagagcaactgcctgttttccgctgcagatctcaattgttatcattgataagagaaaatcaagtagtggtgataattggtgaaacgggctcaggtaaaaccacgcaacttgcacagtatttatatgaagaaggatatgccaacgatagggggaaatctattgttgtcacacagccgagaagagtagcagccatatccgttgcaaaaagggttgcaatggaaatgcaagttccattgggtaaggaagtaggctattctataaggtttgaagatgtgacggattctgagtgtacaaaacttaagtttgtaacggatggtattctactcagagagaccttattggatgatacactcgataaatattcgtgtgttattattgatgaagctcatgaaaggtcattaaatacagacattttactaggttttttcaagattttattagcacgtagaagagatctaaaactcataatcacttcagcaacaatgaatgcgaagaagttctccgcattttttggtaatgctcctcagttcacaattcctggaagaactttccccgtacagaccatatatacttccaaccctgttcaagactacgtagaagctgcagtttctcaggctgtgaaaattcatttagcaaacgattgttcaagcggtgatattctcattttcatgacaggtcaagaagatattgaaacaacgttcgacactctgcaagaaaagtttttgcaagtatattctaaaaagtttggtaccgcaaactttgaagagatcaatgatattgaaattttaccaatctactcggctttacctgcagatttgcaattcaaaatttttcaggatctacatggcactaaaaggaaaattataattgcgacaaatattgcagagacttcattgaccattaaaggtattagatatgtcattgattgtggttactctaaactgaaagtttacaatccaaagattgggcttgatagtttagtaataacgcccatatcaaaagctaacgccgaccaaagatccggaagagcgggaagaactgcgccaggcactgcatatcgattatacacggaagatacattcaaagaagatatgtacttacagacaatacctgagatccaaagaacgaatttgtcaaacacccttttactgctaaaatctctggacgttactgacgaattgagtaagttcccgttcattgataaaccacccttacaaacatttttatcctcattgtatgagttatggttcataggggctatagacactagtggacaattgactccattgggattacagatggcaaaatttcccctgcaaccttccctttccaaaattttattaattgcagttagaaacggctgcagtgatgaaatgttaacaatagtttccatgctttctgttccacaagtcttttatagacccaaggaaagacagaaagaagcagatattgctagaaataaattttttatcgcgaaatcagatcacttaacgttacttaatgtttttgaacaatggagggcaaataattttagttcgcattggtgtaacaaacattttgttcaatacaaatcacttgtcagggcaagagacattcgagaccagttgctaacaatactaaaatctcaaaaaattccggtcatttcctccggtaaggactgggatattattaaaaaatgtatttgttcaggatttgctcatcaagcagccaaaataacaggactacgaaattacgttcatttaaaaactggcgtaagtgttcaactacaccctacaagtgcattacacggattgggggatttacccccttacgtggtatatcatgaattattaatgactagcaaagaatacatttgttgtgttacttctgtagatccattctggttaatggaatatggtgggttactctacgacatcaagcgtattaaaaatgatcaggaggccacaactacaggcctctttggtgaacactatgaacatactctggacaaggttgaagatgatattgatatcaatattaggagatgtaaggatatgagagacagtgtgatacaggagctcaaaatgaccgacaattcaaacaaagaagacaaaaagcaaaaaacgaaaaagcaaaatatactgaacggcaaagaaaattcaatgaaacctttcaaaagaaggaagccttttttttagtttatgggaagagcgtgctaataggcaaaatattcatatatgttattatatagttatatgcatgcataaaacaaagggttatttattgggtacaaaagaaaagagcataactcgtggagtgcttacattgagaaaaaacttttataatagttacccatactgctacaatcagattgttcataaatttcattagcttttggcaaccatttcgacatattctctattctacgagtgcttgctggatgtgtacttagaaactccatattcacaacaccccctctattcatttgcttttcaaaatttgccattctttcccacacttttattgactcctgtggttgaaaacatgcccttgacattatcatcaggccaatgtaatcagcttcggtttccatctgtcttgatgctggcattcgcaaaaacccatccaatagtatattgttgatagcatgagctccagtaacagtatataacaccaaacccaaaagagaatatataggagccttcgacaaattttcggctgtgtgtcttgctagctgatgagcaaattcgtgtgctaaaacagtggcaatcccatcatcattagcacaaataggtaaaatagagctgaatataaagaccttaccccctggtaaaacgaatgcatttggtgaagcagttggatcattgaccacatgaatttcccacttgattccgtccagtagtgagttgtctacactagggtccttataagcagcttcgacaattttcatgaaaatattctcaattttgatggacagcggatgctgtggaggtaatatttcctgctgcgtttgtctccaaattgatttgtatgtgtaatttccgatagttaactctaatggacgcgatacccagatgaacctggacctatcgcttaccggtgctttatccaaatgtgtataataaaagagagagcatccaccaaataataaagctaagtattttcttgatgacttatcgagaagaatgcttttaaacgatgatttttgggaatactctccattattaaatcgacgatatgaaggaccattgtcatagcggaacatcgcgttaactgaacacgaaatgatacaggttttaaaaatcctccactggtcccttttccaaatcctttgaacctgatgatgttgcgtaacatttcttgtattttatctttccataccttaacttagattggttgatgtcgcttcgaaaaactgctttttgtcttttaagttctttatatcggacgtagaaagaagtagaaatagtaatttgggttacccatataaaaccaacttatctaaacatatataaacgtatacggaggattagacctcaaaagacaattcaggtagttgatcagtggacacttgacggtcgcggttttgtagttctaaatatctcttcttagtcttgaagtataagagccatgctgtaagacttaggattaataatgtgataataatgcttaccaagtcaaataccctagatcctgtagattcagattctgcgagactctttacacgagaacctataaatagatagatgaacagctttggtgtggttattatgttggcaatggaaaagttgcgtaccgagataccgtaaacaccagctatggcaccattagtcaaagaatatgggaagggacataatctcagtagagctagaatccaatagctattgttttcttgtaaaattgaagccaatgcttcaaatcttctattcaaatgcacaagcttttctgctcttgaatgcaagatcgtcttgaacacaacgaaagaggcaatggaacctgttacagatcccaaagctagcgtaacccatccctcaaaactgacaccatagatcaacccagtagtggtggataataaggagtagccaatcataggaggaaatgcgacaaagaatatcagaaccattaatataaaatgtgttgacatcttttctctcaaatcgttcgaagtaacaacaactttatgtaaaatcgcattatggaagacgagcaacaatatacccattatcattagcattatgccgaggaggacaatgataatctgttgccataagcgtagtgaataaaaataaaactgtaatttttgaacattcttcctgatattatgcatcaatctctctctaggggacatattataaatgtctaaaaaatcatcatcattaacatttacttcgtcattgaatgacaatccagcattagtaccaaccctttgtccattattactatttggcatgatatcgttgtcaaagtcttcgaaatagccatcaaattcatcatcctccccttggcccatattggcatttcctgcttcgtaagactgactcatttgtgtaaccaatatctttcttccaccataataatattttcaaatatgttgaaggtattgttttagtaaagtggctttttttcttagtgcagctcgagagaaaacaatgatttcgatttccgctttgaaaatgatatgaatgagaaaggccattcgaataaatacatagatgaaaaagaatatctagaggatatataagcaagcccgtgttttcttattgagtaaaactggtggtgcttttgtgctgcgttgaagaagaaggcctcgatcgaaacggtgagctctttgtagcttgagaagggggtcttccatcaatgctatgacgcctgaaattgcccgctaaatcactatgaatcattgcgtctgaatcgaagttacttatcagtctcaatgtaggatggtcttctttatccgaatctgtgtataatatgttgctactgctgacccattttttgttcatatgcctcaagtatctactctttcggccaaaatgcaatttcttgtctaccatggcaggtgtttcaatgctggcagaatgtgggataagttcatggctttccgggtcataggtcttggcatccataggaaacattagccggcccatacttgtttttttctgcagaattggcggtgggtgtccattgattttgctggattgcctcaacatccttgatgtgggagaagcaactgaaaatgaaaaggatttggctggtcgccttgaagttgaaatagtatctgatttccttctttggtgacgcggattgagagaagcggacgtaatggaataccgcggtctaaacccggaaggtgaccgcccatatgtgcttgcattctcacgtaacaatagcaaagagtttgtcgattctgattctaataagttgtcatctaaaacattggaaatatgattgtcacccttggttggagtcctagttagcaatgttgaattttctgggtttttggactcatctgacgtttgctctggagctttaattaatccaatgactgaatcagcaaattggaagggggtttttaaagaggaggtgacaatcatcctacctttgatataagaaatcgccttatccagagcaaattcctggccacagtgattttgaataatggaaaccttgggccacgtagcttttgcaccattggtgatttcccttaataaaaattcttttgttgggtttgacaacagctcctttattctaaaaagcatacacatgtcgggcaaaatagtgatgtcaccagaatattgttgagataataccgatctcagttttgtaagcgcgtttttggcaattcccatctcacttccaatttctagaatatgaatagcttcattggccataaaattgtatatacttgataagttttgctttaatcttgcactaaattcgtcctcaatttccccgccaacacaggatagtgatagtttcaaaaagggaaatacgtgaatattcacctggcatgcgataatatggtctacattaaacatttcagaaagacgagaaatgggcaagtcattgtccacagaaccatcgacaaatttgaccgaactactaccagtccatggtttcctttctcccgtttttggatctttttcgtaaagtgggctcgaggggaaaattcccggtagtgaacatgatgcacatacggcggaccaaatcaggacgtttggtgcagtcaaattattcagcaagcgcggttgttcaaataaagatgccggcgaaacggttatattcaaaattttacccgttctattgtaagcttccctaaatgtcaaatctcccaaaaattctatcattgtatttaccagatgcttgttatcaaaccacgtaccgtttttgaagaacctagatatttttattaacaaattctcgctttcacttttctgtttatcgtctttgaaaatgttgaattctttatccaaaatatgatttagtaaaaccggaatttcttctttgtgatggacagataatatgcttgctacaattgcaccagcactgctaccactaatcactctgggtaataaatccaattcaaatagagtaccaaggacaccgatgtggaaaagaccaaaagttccacccccactgagaactaaagcggtacgaccaatatttcttctcgtttgttgcagtatacccaaaaggtaactatcatcaagatcagactccattaaagattctagcgctaacctagactccatcatatactcgtcaattaaatatttggtgcctacatgggagtgcctatataggtttacattccccatatttcccaggtttcgtacccaattcgtcctaatgatgtacaacaattgagcgtaattcctattcaagcgctcctcacgcattctagatgttaaatcttttattagcttgtaatcatacaagggactttccaatttctgcttccattctgttttcccagtgaggtcatccaatctggcgcccgcagaacaccattcttcaaatgacatcgcatgttgcttttgtgaacagactttgtcaataagaatgtctctttcatagtttcccacaaaaacgttgtaaagaaatgatttgcatttactggctaaagatgacccttgcctttcatcttcgccttcgtctgtctcaaccatctcgatatcattattttcattttctgttactgtctcttggtcatcgtcaagtttatcctcgtttccagtatccaggttgaaatttactttgttcgtagttttgttcttgccagtttgcagtcttttaccagcatcctcctccaccctttcaacatctgaattatccttactgggcctaataaacttgttcttcggatttaaaataggaattatgttctgggaagtgcccaggatctgttcgtaatatttttcgattagttgttgcgtaacaaggaggggcttattttgtgtagatgtaagatctgatattttgctgctcattcagacttttattacatatacctgtactcccttcaataattattacagcgctaatttttttgatcaaatacttgaatacaggcctcttttacgagtacaataatgacataatgacaatttgaatcaaccatactttataattgtggtttagcgtttcatagtcgcaattatcgtataagaggggtaatatgtcagccctagtttaccctactttttttaaaccccttaagatcttttttccttttttctaatatttaacctactaatattggtaagtaaacctaatgactttttgaagcgcctagccctatttctttcgaaattttcaattcgcgtcctttttcaattccatgaataataggaaacatgaaaaaataagtaaataataataatagaaaagctggagtgttgcaaatttaagaggtagccttaaaatatatttctgctgtgttgaatatttaatttatacagctagaataggatattatagccgaatttttttcaagcttcttcaaagcttatagtgaataacgtaaggggaaaaacaagaataaatttagcaaaagaaacgctcaagtcaatgtataactcaatctacgggtcccccttccctaaaataaatccgaaggtccgctacaaaactgctctagaaagagcagggtttgacactaagccgcgtaatccgttcagtagtcagaggaatgcttccactggaagtttacaagcttccgtgaagtcgccgccaataacccgtcaaagaaatgtatctgccgccccatctgttccggtcacgatgaagagtgcgtatacggcgtcttcaaagagtgcttattcatctgtaaagggcgagtctgacatttatccgcctcccgtattggagaatagcgagaggcggagtgtaactcctccaaagaatagcaattttacgtcttcgagacccagtgacatatctcgttctatttccaggcccagcgagcgtgcttcgcaagaggatcccttccgttttgaacgcgacttagaccgtcaggcggaacaatatgctgcctctaggcatacatgtaaatcacctgctaacaaggaattccaagccgcagataacttccccttcaacttcgaacaagaagatgctggtaatactgaaagggaacaagatttgagccctattgaaagaagtttcatgatgctgactcaaaatgacactgcaagcgttgtaaattctatgaaccaaaccgataacagaggtgtgctcgaccaaaaactcggaaaagaacagcaaaaagaggaaagttcaatcgaatatgaaagtgaaggacagcaggaggatgagaatgatattgaaagcctaaattttgaaccagatcctaaactacagatgaatcttgaaaatgaaccacttcaagatgattttccagaagcaaaacaagaggaaaagaatacagaacctaaaattccggaaattaatgttacgagggaaagtaatacaccatctttaaccatgaacgcactagactctaaaatatatcctgatgataacttttctggcctggaatcttcaaaggaacagaaatcacctggtgtgtcatcatcgtcaacaaaagttgaagatttaagtcttgatgggttaaatgagaaacgtctttcaataacttcttcagaaaacgtggaaacaccatacactgctacgaacctccaagtcgaacaattgattgctcaattagacgatgtttccctatctagaaatgcaaagctcgatatgaacggcaattgcctcaacgcagtggacagaaaggcttctagattcaaaaagtcaagcgcatatttatctgggtatcccagcatggatatacccgtaacgcagcaaacatcaattgtgcaaaacagcaatacgaacttatccagacaaactattctggtagataaaggcgatgtcgatgaagacgcgccatctgaatctacaactaatggtggcacacccattttttacaagtttaaacagtcgaacgtagaatactccaataatgaagggatgggttcgcaagaaactttcagaacgaaacttcccacaattgaagcactacaactgcagcataagcgcaacataacagatctgagagaagaaattgataattccaaatctaatgactctcatgtattacctaacggcggcactacgagatacagctctgatgcagattataaagaaacggagcccattgagtttaaatatccgcctggggagggaccttgcagagcatgcggcttggaagtcacagggaaaagaatgttttccaaaaaggaaaacgaactgtcgggtcaatggcatcgtgaatgttttaaatgcattgaatgtggtatcaaattcaataaacatgttccctgttatattctaggcgatgaaccatattgtcaaaagcactatcacgaggagaatcacagtatttgtaaggtttgttcaaatttcatagagggtgaatgtctggaaaatgataaggtggaacgattccacgtggattgtctaaactgtttcttatgcaagactgccattactaatgattattatatattcaatggggaaattccattgtgcggtaatcacgacatggaagctctcttgaaggaaggtatcgacaatgctacatcaaccaatgataagaacaatactctctctaaaaggagaacgaggctcatcaacttcaactagcatcactacccatttgtctttcctagcacacatgtttcataacattcttaataagattttgattttttatattattagccagccttgttcatttataaattgtatagcgcaggaaaaaggcatctgcctatctatggtatcaacaacattagtcgtcattagttagttagttataaagacatcattcactcatattcactacgttgtcttcttctcaacaactacctctaactgtttttttacgcgtcatttaattgtagcgaatttctatttttggacattctcgtaccggtgcattaaaggctaaaagctaaaaagggaacaggagcctaagaatagagaataaggaaatttatttaaggaaaggctaagcaatgaaatgtttcgttattttattgtattttcaagaggatggaagaagaacctgagcacaaacggataaataatagacgaatataatgtttcttaagacacctaattgggaaacggtaaatgagactcccaaatcgagagtcttaacgataaacgaattgatctctcccaacctggatactgaatctaacagccttctgcgacgccggcaaggaaatatttcaaaacttcaataagtgaagcgcaagattctcctacatctgccccttcgcccgatggcaatgaggatcccacatatcaatacaacgtacaatttcattttccaggaccaataacacctacaacacccaggtctaagaatgcagaaatgtttccatcccccacgcccccattggtttctcccacagcggttatcgaggaagagaatgacgattccgtacgggagttttcacgcacgctaaaatcaagactcaactgcgcaatggttaagctatcaaaggaacatgagcaagtagctttgattcctccacctccgacggaaaagatacgaaagggctcttatagtaataaatttgccgctaagcataggcgctgtcactcgttagatgaatccaaaaagtttctgagttctctggaagattcatccgctcatgcagcgttcttgaaggcaatttcgtccaaacatgccaaaagcaatagggtagacaacgttaacgtttcgccgttacgttggtcatctcatagaagaacgcaaagtacacaggagaattctttacaagaagttgttgctatcgatacattattgaagatgtcctcatcggactgaactaatgattcgggtttcgcatatatacatggctttggctacttttaggtttatagttcttgctgtttatatcactaatatttagtatatagctgcgaagaaagaaaaagaaaatattcacctctaggagccaaaaacataaaaaaaaaaataattaaaaaaaacttttattgaatgcttaattatttagtgacgcgattacctatataccaggttatttattttttcttttttcaaaggaaaacaatacaaaatattactgttaccatttttgttactattattattgtctttattactattatttttctatcgttgctataattacaatttgtttactctacaacttaaaaggagattactccagacaacgagttttgttttatgtttcctattcttttaatcttggaatttgtatgaaccactttctaatgtaatggatccacctctgtaagaacctctcttcattttatttttgttcttcgtgaaatctttacctcttactctacctaatttttcatttgccttttcaccccatgttccagccgcgcctttgtaggtgttgtctgtcaactcccaagcttcgaaattaatcttcgatctatctactctggaaaaatgctttctttggccctctttgatctcgtcggttccagcaggaatgttcaatttattggcgcttgatgaactggaagcagatggagttgattcgttagatgaggcaggcgtttcttcggccttggattcgtctgcagttgcttcttttgtttccaattcagagctagaaccagagtctgagtcggaatccgaatcggaggaatcagaagatgtagattcgtcggaacttgaatcagacgagcttgaagaatcggacgagcctgaagagtctgagtccgagcttgagtcggaatccgaatctgaatccgaggaagagctgctagagctggagctagagtcggagtcagatgaagagtcgctggagctggagtcggagtcagacgaagagtcgctagagctggagctagaacttgattgagaatctgattcagaatctgattcggaatcagaagaactacttgagctagaacttgagtcagaatcagattccgaacctgattctgattctgaagatgacgatgacccgctagagcttgactccgatgaggaagagctttctggttcagttttagcctttttagtctccttagcatcttcgttgtctgattctcttgctcttttcttggtttcatcttctgattcggattccgaagaagattcgtcagaactagagctagaggaagaagaagatccactggagctagagtcggattcactagaagattcagagtcactggaacttgagcttgagctagaagaagaagatgatgatgagctagattcagagtcactgctgtcactgctgtcactgctgctgctgctgctgctgctgctgctgctgcttgaagattcgccgctagaactggacgaggaagatgaagaagaagaggaggaggaggaggaggaggaggaggaagaagaagaagaagatttctcttcaatctccttctccttaacacttaattttggcacttcgtcaactttaattttcttggaagccattgctatgtattcttagtgtactgcgacttgggtttctttcttgctttgtataaaagtgcgatgagttcaatcatcaagtgaatttttttttttcagcctgcattgaaaaaaaaaaaattgtatgctcgagcgatgggaaggttttttcctcttcccgttcaaagcttcctcggaccaactccactttttctcggcccgttgtaaagaaatgggtaagagaactaaattgcaataagcttcgaattatcgttttgatccagacataaagagatgtacaaactacaaaacaagagtaaaataactcgaacgaagggtacaccttctgtaataaaacaaattcactataactgccttattggagtgaaaaaacaagattatgtagaccccctctcgcgataaagaacattaatgactgcaacacccgcacaccacaaggtgaagggcaaaggtgaattaaccaaagtgaagaggacgacgtagaatcaaccaggtatccttgataaggggaggagtaagaaaaaagtgtgtcgaacgtaaatttatgtgtctaatgaaagtatcttcacactaagattataattctccttggcaaaacaaaatgacacctttgtcctgttttcgttatctacttttttttgtgtcagatgtcattttggtctcctacgcatccactacatccttgtcacaatttgttatcagtaaccaacttagatgacttgcaccagcgccacatcttcgaaagcgttgaaacaaactacgtaaacaaacaaaaagtcaacatcctgtagatgtggctgcaaaaccacagaatcctcgtgtgggagaaaatattgataggaccagagcgaacttttttgatacagacgtaggaggtagccgttaccgcattagtatactatatgcgtacggccgccaagagcccaagaaagagacacaaaactacgtgggataagcttggggtaacgcaatcagtattgttcattttttttcccggaaaagctaagagttttctggcgagataagataacggcgccgaaggcagcggcgaactgacttacctccgtcggctccggcgtacggcaccaaaaaatcccgcaataacttgacaccaatgggctaacggcgtccgcagaaccgtgacgcaatctgcggtttgtgtcaagacagagaagtgggctgcttctcccctttcaacactcccctcccatggctgaatactcagacgttttctgtggtggaaatggcatcaaaagtgccactggctggcgaatccagactattttgtgtcaaagaaacatgcgtacctgcacaataaaaagaaaaggcccgccctactgacatcctgttcaggatcctcgaagaacaggaaaaaggacaaccgtccttttcacttcacgttcgcagggctttcctcgatataatggcgattacacaagcggtggcgtcttgaaaaaagttgggtttcttatctgtacggcgatcactcccctcatatgatagctgtgtagagtgacttgctctttgattggccttacttcttgcatctatcatcctttcttttactctctccaatcaccacaactcatatcattctacatttcattttattgttctgtacaatttttaggtttgtaaaatatataagtgatgtacatatcttctatatcctttccgtttgtgtctattttagggttggcttattacgcattattcctactttatttttacttgcttacttgaaaaagaaggtataccacagtgctgctccactgcaaacaatataaaatattatcaattatttttttttttcttcttttgaattagatcactaataaactcttataatgctcaaccatcccagccaaggctcagatgatgctcaggacgaaaagcaaggcgacttcccggtcatcgaagaggagaagacccaggctgtaacgctgaaggattcgtatgttagcgacgacgtcgccaactccacggaacgctacaacttgtccccttctccggaggacgaagacttcgaaggccccactgaagaagaaatgcagactttaaggcacgttggtggtaaaattcctatgaggtgttggttaattgctattgtagagctttccgagagattctcctactacgggctttccgcaccattccaaaactacatggaatatggacctaatgactccccaaagggtgttctgagcttgaacagtcagggtgccactgggttgtcgtattttttccagttttggtgttacgttacaccagttttcggtggttacgttgcggacaccttctggggtaaatataatacaatttgttgcggtaccgctatttacattgccggtattttcattctatttatcacttcgattccctccgttggtaacagagacagtgctattggtgggttcattgctgccattattctgatcggtattgccactggtatgattaaagctaacctttccgtgttgattgccgaccagcttcctaagcggaaaccctccatcaaagttttaaaatcgggcgaaagagtcattgtcgattcaaatattactttacaaaacgtttttatgttcttctatttcatgatcaatgtcggttctctatcattaatggccactactgaattggaatatcataaggggttctgggcggcctatctattgcccttctgcttcttttggatcgctgttgtcactttgatttttggtaaaaagcaatacattcaaagaccaatcggagataaagtcatcgctaaaagttttaaagtttgttggattttaactaagaataagttcgacttcaacgctgctaaaccttctgttcatccagaaaagaactatccatggaatgacaaatttgttgatgaaattaagagagctttggcggcttgtaaagtctttatattctacccaatttattggacccaatacggtaccatgatttccagtttcatcactcaggccagtatgatggaattacatggaattcccaacgatttcttacaagcattcgattccattgcgttgatcattttcatcccaatttttgaaaaattcgtatatcctttcattagaagatacactccactaaaaccaattacaaaaattttcttcggtttcatgtttggatcttttgccatgacatgggctgctgttctacaaagtttcgtttacaaggctggtccatggtataatgaacctctgggtcacaacaccccaaatcatgtccacgtttgctggcaaatacccgcatatgtcttgatttctttttcagagatctttgcctctatcactgggttggaatacgcttattccaaagccccagcttccatgaaatcgtttattatgtccattttcttattgactaacgcctttggttctgcaatcggttgtgcattgtccccagtgaccgttgatcctaaatttacatggttattcactggtttggctgttgcctgctttatttctggttgtttgttctggttgtgcttcaggaagtataatgatacagaggaagaaatgaacgctatggactacgaagaagaagacgaatttgatctcaatccaatttccgcacctaaagctaacgatattgaaatattagaaccaatggaaagtctaagatccaccaccaaatattagtgcgtttaattaacttactgtcttttttttttttttttttttaaccatattacgttgacgggagttttctgtgctgctgttatttgtttcacagaactctctcctcttccattgctatcgaacagataaaatggaatttctttatgtataattactattgtataatattcagtaaatctaaattttaagctcatatatctaaacactacaacatggaagcagcttgtcctcttcaggctcactgtatccgtttactcttatttcgcgtatttgcataccattatctcaaatgacttgttattatatcttgatatatattgtattatagaacaatttgtgaagagaggtccatattaagatttcctcccatttacaaatagaatagaaaaggaaatatatatgtagtaaaaaaatcgtgatgtatacaaactttggatttgtggagatcgtaataaatcgattatttcaacttcttctttggacgcaattggttggtgtgaccacactttctctttctacagttggtagctcttggtggtaatctggcgtaacatttacgacaaacagatttgtcacagttgtatttggaagccaaggctttcaaagatggttcaatgataccacctcttaatctcaagaccaaatgtaaagtggattccttttggatgttgtagtcagatagagttctaccgtcttccaattgcttaccagcaaagatcaatctttgttggtcaggtgggataccttccttgtcttggatcttggacttgacattgtcaatggtgtcagaagattcaacttccaaagtgatggtcttaccagtcaaagtcttaacgaagctgtacaaaattggaataagttcatttatggagtaagcacagacgtgcgtgcgtacatcataaagaaagaaacttcacgttagtaaaaaatattttttatgcgaccaagtaaatataactatgttatgcaaaataagatggaacaaacaaacccttcagcacatatgcgacattttcaatttgctctacagatttaatgtaaactcagaagcttgccgcgagtaatagtttttctcaattgctacttgtttaataaattgtgagcttgtcaatcattttccatttatgtctttcgtttatggcttttttgctatcgtataatcctcatattatttcgaacatagtattctgtattcgccgtaacatacatttgcattttgaacctttggtggctttacctcttgctgaacgggaaaaagtgatatataaggttgctcttatttgtgtatttgagattatgagttgcatacccataatgcctgggatagatgggtaatggctagtatgaggcggatcatatggcggattatccgccatatcctattgcggtacttcagaatctgaaaaacatgaaaaaaaaaaaaaagttcagcaaaaatggaaagattgcacccagacaactacacaaatctattagaggcacggatggaaatagtatttaaaaaggattgtcgaaagatgatatggcctccgatgagaagaaaggcggctatcctcatccacatatagaacacaaatgaatgccaataggtaataaatcactaaatctactagtttgtaaaaggttcgaaataatatgtcataaatttcgctgttaccttattgctcaggcgcttaacgccaaattgcattgcccatcattgaagaacacaacctaacgcgttaatatctcaagcaatgaattcaagtatccctatgcaagaatttaaaaatttctctctctatttgaactgaaccagcattttttatatctctccacatatcgcagaaagcttttctactctcaagaaaaaattgagggatgggtcaaccttccatagattctatatggaataataaaatttacttcttactaacattatatcagggtgaatattactgacaaaaataataacttaagtcttctttataatatgatgatcgacgcgcggggtaacgcgctcttcccatctttgtttcctttcattcctcttgacatgacaacaagagtatatgggaaaagaaaactggaaggcaaattgaatacagacagagatatcaataaaagtggtccattgagtcttacggcgccggagagatacgctccatttacaatatttactgatagatatattgctgcctgtctatttttccatctcttgtgctgactaggacttaactgatactcgccgaagctacacaaatagtcagtaacgccacgttttaggataatgtcggatcatgatactccaatggaaagcatacaaaatggtgaaaattcagacgaaagattgaacgccattgcgtcttttttcggttgctctttagagcaggttaaatcatttgacggtgatgtggtaaaacaccttaacgataaacttttacagtttaatgaacttaaatcggagaatctaaaggttaccgtctcattcgatgaattgaaggctagttctttaaagaaaattgatggtttgaagacagaaatggaaaacgttataagagaaaatgataaaatccgaaaagagaggaatgatacttttgttaagttcgaatctgtagaaaatgaaaagatgaaattatcaagtgagctagagtttgtgaaaaggaagctcgatgatttaactgaggagaaaaaggaaacccagagtaatcaacagcgaaccctgaaaatactggatgaaagactaaaagaaatagaattggtcagggttgagaataatcgctccaatagtgaatgtaagaaactacgctctacaataatggatttagaaacaaaacaacagggctatattactaatgacctgaattctagaactgaactggaaagaaaaacacaagaattgactttattgcagtcaaataatgattggctagaaaaggagctacgttcaaaaaatgaacagtatctctcctacagacaaaaaaccgacaaagtaattctagatatcaggaatgaattaaatcgtttaaggaatgattttcaaatggaaagaacgaataatgatgttttgaagcaaaaaaataacgaattgtcaaaatctttacaagaaaaactactggaaatcaagggtctatccgactccctaaattccgaaaagcaagaattttctgcagaaatgtccctaaagcaacgtttagtggaccttttagaatcacaattgaacgctgtaaaagaagaattgaacagtataagagagttgaacactgcaaaggtaatagcagatgattcaaaaaaacaaactcccgaaaatgaagacttacttaaggaattgcagttaacgaaagaaaaattagcacaatgcgaaaaagaatgtctacgtttatcctctataactgacgaagcagatgaagataatgaaaatttatctgcaaaatctagttctgattttatattcctgaagaaacaattaattaaagaaaggcgtaccaaggaacatcttcaaaatcaaattgaaacattcatcgtagagttggaacataaagtgcccattataaactctttcaaagaaagaactgacatgttggaaaacgaattgaataacgctgcattgttactagagcatacatcgaacgagaagaatgcaaaggttaaggaattaaatgccaaaaaccaaaagctagtggaatgtgaaaatgatcttcaaactttaactaaacaacgtctcgatctatgccgtcaaatacaataccttttaattaccaattctgtttctaatgactcgaagggacccttacgtaaggaagaaattcaatttattcaaaacattatgcaggaagacgatagtactatcacagaatctgactctcaaaaagtcgtaactgaaagactagttgaattcaaaaacattattcaattacaagaaaaaaatgcagaacttttgaaagtagtaagaaacttagccgataagttggaatcgaaagaaaagaaatctaaacaaagtcttcagaaaatcgaaagtgaaacagtaaatgaggctaaagaggctataataactttaaagagtgaaaaaatggatctagaatcaagaattgaggaactacagaaagagcttgaagaattgaaaacttctgttcccaacgaagatgcgtcatacagcaatgtaactataaaacagttaaccgaaactaagagagacctcgaatctcaagtacaagacttgcaaactcgtatctcgcaaattactagggagtctactgaaaatatgtcacttttaaacaaggagatacaggacctgtatgacagcaagagcgacatatccattaagcttggaaaggaaaaatcatcgagaatattggcagaggaacgatttaaactactttcgaatacgttagatctaactaaagctgagaacgaccaactgcgcaaaaggtttgattatttacagaatactattttaaaacaagattccaaaacacacgagacacttaatgaatacgtttcctgtaaatctaagttaagcattgttgaaacagaattattgaacctgaaagaagaacagaaattaagagttcatttagaaaagaacttgaaacaagaactgaataaactctcccctgaaaaggacagtttacgcatcatggtaactcaattacaaactttacaaaaggagcgtgaagatctattggaagagactaggaaatcatgtcaaaagaaaatagatgaacttgaagatgctctcagcgaacttaaaaaggaaacttctcaaaaagaccatcatatcaaacagctggaagaagacaacaattcaaatatagaatggtaccaaaataaaatcgaagctttgaagaaagattatgaatcagtaataacttctgtagatagtaagcaaactgacattgagaaattacaatataaagtcaaatcactagaaaaggaaatcgaggaggacaagattcgtttacatacttataatgttatggatgaaacaattaacgatgattccctacgcaaggagttggaaaaatccaagattaacttaactgatgcttattcacaaatcaaagaatacaaggatctctacgagactacctctcagtctttgcagcaaacgaattctaaattggatgaatctttcaaggactttactaaccagattaaaaacctaactgatgaaaaaactagtttggaggataagatttcgcttctaaaagagcaaatgtttaatttgaataatgagctagatttgcagaaaaaagggatggaaaaagaaaaagctgactttaagaaaaggatatcaattttacagaacaataataaagaagtcgaagctgttaagtccgaatatgaatcgaagttatcaaaaatccaaaacgaccttgatcaacaaactatatatgctaatactgcgcaaaacaactatgaacaagaactacagaaacatgcagatgtttctaagacgattagtgaattaagagagcaattacatacgtacaaaggtcaagttaagaccctgaacttatcgcgtgatcaactggagaatgctctgaaagaaaacgaaaagagttggtcctcccagaaggaatctttattagaacagctagatttatcgaattctcgtattgaggatttatcctcccaaaataaactattgtatgatcaaatacaaatctacacagctgcggacaaagaagtcaataattcgacaaacggacctggtttgaataatattttaattacactacgtcgcgaaagggatattcttgatacaaaagtgacggtggctgaaagagatgcaaaaatgttgagacaaaaaatttctttgatggatgttgaattacaagatgctcgtactaagctagataattcaagagttgaaaaggaaaatcattcttccattattcaacagcatgacgacattatggagaaattaaatcaattaaatctattaagagaaagtaacataacattgcggaatgagctggaaaacaacaataacaagaagaaggaactgcaatctgaattagataaattgaagcaaaatgttgcgcctatcgagtccgaattgacagccttgaaatattctatgcaagaaaaagagcaagagctcaaattagctaaagaagaggttcatcgttggaaaaagcgctcacaagacatattggagaaacatgaacaattgagctcaagcgattatgagaagctagaaagcgagatagaaaatttgaaggaggaactagaaaataaggagcgtcaaggagcggaagccgaggaaaaatttaacaggctgagaagacaagcgcaagagagattaaaaacatcaaaactctcacaggactcattgactgaacaagtaaatagtctaagggatgcaaagaacgtgttggaaaattccttgagtgaggcaaacgcgagaatcgaagagttacaaaatgcaaaagtagcacaaggtaacaaccagttagaagcaataagaaaattacaagaagacgcagaaaaggcttcaagagagcttcaagccaagttagaagaaagtacgacttcttacgaatctacgataaacggcttaaatgaagagattacaacattaaaagaagaaattgaaaaacaaaggcaaatccagcaacagttacaagctacatctgcaaatgaacaaaatgacttatctaacatagttgagtctatgaaaaagtcttttgaagaagataaaatcaaattcatcaaagaaaaaacccaagaagttaatgaaaaaatactcgaggcccaagaaaggctaaatcaaccttccaatatcaatatggaggagattaaaaaaaaatgggaatctgagcacgaacaggaagtatctcaaaagattcgcgaagctgaggaagccctcaaaaagcgaatcagattacccactgaggagaaaattaataagataatcgaacgaaagaaggaggaattggaaaaagagtttgaagaaaaggttgaggagagaataaaatcaatggaacaatctggagaaatagacgtggtgcttcgaaaacagctagaagctaaggttcaagagaaacaaaaggaattggaaaacgagtataacaaaaaattacaagaagaactcaaagatgtaccacactcaagtcatatctcagatgatgaaagggacaaattacgagcagaaatcgaaagcaggttgagggaggagttcaacaatgaactgcaagccataaagaagaaatccttcgacgaaggaaagcaacaagcaatgatgaaaactacccttttggaaagaaaacttgccaagatggaatctcaattgtcagaaacaaaacaaagtgccgagagtcctccgaaatctgttaacaatgtacaaaatccattactaggattacctaggaaaatcgaagagaattcaaattcaccattcaatccgttactttccggtgaaaaactcttaaagctaaattctaagtcttcatcaggtggatttaacccttttacctcgccatccccaaataagcacttacaaaatgataatgacaaaagggagtcgttggctaacaagacagatccaccaactcatttggaacccagcttcaacattcccgcctcaaggggtctaatatcttcatcttccactttgtcaactgatacaaatgatgaagaacttactagcaacaatcctgcccaaaaggattcatcgaacagaaatgttcaatcggaagaggatacagaaaaaaagaaagagggagaacctgttaaaagaggagaggcaatagaagagcagacgaaatccaacaagcgacctattgatgaggtaggagagctgaaaaatgatgaagacgacactacagaaaacattaatgagtcaaaaaagatcaagactgaagatgaggaagaaaaagaaaccgataaggtgaatgacgagaacagtatataaaggagatagtaaaaacaagggatcaatacaaactaaacctttttcaatgtggaggagcttcattctgccctatgtcaagaccatttgtaatatacgtacaacagcattcttgtttcataaagtttatatatgtataagctaagatgaagtcacgtaaatagctcaaatgccgattttttaatactccaaacacagaatcctctatatatggaaatggaatcatgaatcttacggtttgtgttttgaatgttccaaacagattttcttagtgttccgatctctgttccacccaccaaacgagaaaaaagtaggtcttcgcgaaaactccagcgacaccgctggtcctttaagttaaaataatatgaatggtggaagaacccagatcaacttgactgaaacaagtctgccaacatagacagctaagaaaattgatgacaagcaaacgggaaaagtcactggatcacacattgtaagtagaagcagtttttcaatgggaagaccgcactgcatagtttactaactatttaaactttccaaacattagagaactaaagataccgtttgaaacggagcgacaagcgaccatagcaaccaaagtcctatctccggacccgattttgaagccacaagattttcaagtagactacagttccgagaaaaatgtcatgctagtccagttcagaagcattgatgatagggtgcttcgagtgggagttagcagtatcatagacagtatcaaaaccattgtggaagccatggacgttctatcataaataattagaacaccgtattagtgtacatatagtataagtatctagacggcattcatgcacatcataacttaaatatttaaaatagcattaagataaaaaaataaagagaggtatagttgctaaatgtcctggggttgcgtgtaaataaacaattgtttgctttgagtaaagcaagcatgtggatggtagatgaggccttatttactcccattagctgggtaacgcagaaagttttaatatgaaagggtgacggcgcttggcgtttttcttggattgtagaagtcatgctaggcccttggagtaagataagagagaacaaataaaagctttggcaaatatcaactcagacgtcttttttaaagaggatatagagctttggtgttggcctatttcccatcgctgttaaatttccgcttttttgttttttttttccctaaatttgaggaacagctgtttatattgatttccttctttcctggtgcatattggttgaatcatcaacgcttaacgactaacaaattagatccagagttacagacgggtgagattcatatatagaccgaaggagtttcacaatccactatattatgccagaaacctctgttcagaatccattaaggctttctgaaaatgaaaatactcgttcgatgtttctgtctgcatcacagcagcagcggccatctgccactccatccttccctaggttggtacggaataccacagcaaatttgagtttatcagattttcaagtgttaaatccgtcttctaaaaggcaaaattcaaactcggtttacgatgatataaatagcagtaagaggcgaataagtagacctagattttcagatatcgaaggaaaaaataatgaccatacttacccagaaagaacaacagtcaaggaatcagagaaaaatccttctcccagatatgtgagtagttcgaaaagggccctgaaaagggaaaactcagttggaattactcaatcctctgcattgatttcgaaatcatttagtgaaaacggcggaagcattgcacatgagaaatggagcccggaaaatatgataaaaccactgaacgtttcacagaattcgctagctttcgtggatgcagggtcagatgaacagtccaagagtgaaattgtaggcggtttccagcgtaaatctaataatagtcaagaaatcaacgacaaggataacagtgcccgagatcaggatttcaataacagtggcaacaacaacaataataacaatcacagtagcaataacaatgacaataacaataataacaacgacgacaacaacaacaacaataacagcaacagccgtgataataacaataatagtgatgatagtaatgaaagggaagaaaatgattcctgcaagccagcaagtaataagagatcgggcattgctctaatacaaaaattacaagaattgtacaaagtgatagttaagcaagaaattgaattgcaggagcggtgctcacaactaacaaactctcaaaccaccgaactaaaaagcttgtggactatctataaaatcaatacagatcttgttaacaattatgtcacttttatcactacagctttactaccatcccaaccgcctcacgatttggtcatcggccaagaaattgtcgaaatatataggatcgaaagaaggctatgggtttacggcacgataacatttctagacgttctaaagaacttttctaacttcatggatcctgaagtttgctgccaatttatcactcacgtctttgtttcattatcaactatgatttctgacataccgtccaaatattctatcacttggttacaaagactaggagacttatcaagaatggctatagcactatatccctcgagttttatcgattggaaactgagtgctgagcattggtatactgaggcgatgaaatacatatacaatcatggaaagctatattatcatatgtctaccgtacagcaaaacactcttgaagcttttgtaaatttggggaaaagcgtcttttgtcaggaaacattcactccgtctccgcaatatatgcaattggttattgataacatttatcaaagagcctttgtagaaagaaataatggcaatcttagaaactctttattaattgagtatttgaaacatagtgaagccatgctattacccagttttttagaaagtccagatttacaaaatgtcgtgttgagctatttcattgaaaagttcggtatagatgcaaacggttgtaacatttttaacgcagaagatatgtttgttcagaatcctgattttttcaagtatttcttcaggcatggcccctcttttgcacaatcgcatattttacaaattgttggatttggagagccaaaaaacccatttgcaattttatttgaattgccgaagtatttgaaggagaggaaagacaagaaggaacgtaaaaaatcttcaaataatgactcctccgtgacggaaagttcaacgggcaatagccgaaatgacaacgaagatgacgatgaaataatgagttctaccacttccatatctgatcacgatctcttagcagaattcttcaatgacatcgataccttaaggcgtccgatactgccttcaatgctaacaaacgaagcatggttggaaacattaaagtttctaaatatgacctcattaaaatgcggtataatagtgcttcggaagtttctacatgggcctttaggtatcgcattaccccatatcttaccatggatatactttatcatctcaatttgtttgaaaagcagccaattgagtgatccagttagtaaagaattctggatgattattgttaagagagcttttccatgggatacaatggttacctttatgaatgttttgattgtgtatttattggataaccaaacatcgaactctattattggagatttatgcgatgactacgataaattaagcctttctgaacttttagaattattcaatgaaggcgaagaattaccagaaattttgggctgttggggaacattgtggtttgacacaatttgcgaaaagaatacgcattcgattagtagtgaagataattttcaagaaatcggtataaaagattatatggcattggattcgccgacagatggaattatatttgatgaaaaggacgaaaatggtgaaaaattctggaaaagggcatgcagaaccatatttctttttagagagctgtcaagaagttttccaataggcgtaataatcagaaacgatccgttgatatatcgttcatcatttcaaaatactaatatattgggaagtttagtcttcaaactcgaacccttgtgcaatatacacaacaatataccagtattaggtgccctggaaagtattattgacatatctgaggcaagaagtgaaaacaacactgatctgcacgctgtgccggaactaagtgtcaacgagggcgataatatcttccactatgttggctacaagaaacttcgtgccgattatacgtgcttcgataaaaatggagaatttttaagcgcctcgctttacactacatggtatgtcccgaacagcaacaacactaacatagaggacaacatcaattataacagcgaaaaggaaaatgaaggtctatttctggaatgtataaaatctgattatccagaaatagattttaaaactacatactttgtctttgatgcaacttcttggctaagacattccgcacgcatattcaagctagctcaaaacagactgctaagatttgccatttgtttaaccacattccaagagctgagatttttacgaaagtcaaaggacgaaaacgtcatggaggctgccacaagaggtataataactataaggcagctttactatgagaataaagtattacccctaagattcacaggtaatgtagcgacacacatcgaagagaacttagaatttgaagaacaaataacatggaggacacatgtcgacgagtttgtcatcgaatccgtaatgaaggcgcaagaaaaactagagagtgccagcgaaccgcgtctttcccctcgccgctttaactacgtagttctgatatctgacgacgacgccatgaagaaaaaagcagaagaaaaagaaataaaaacgctaagcacacgatttgtgttttctttgtgcacaaaacttggcgaacagcgccatctgtgtacagactgatcgttcgttgtacgtacatttacaacaacaccaattctactcaccgccataaataacactttaattttaatatatacttttatatgcatataaccaactgacttccatacaattctgaccagagcacttgggcagagccccacccaggccttgtcggaaaaaatcggaatatcccacacgatccaccggagaatatcgggacgctgacgggtgaatggagatctggatttcctaatttggatacatctctttcttttttgactcacaataggaaaaaaccgagcttcctttcatccggcgcggctgtgttctacatatcactgaagctccgggtattttaagttatacaagggaaagatgccggctagactagcaagttttaggctgcttaacattatggataggcggataaagggcccaaacaggattgtaaagcttagacgcttctggttggacaatggtacgtttgtgtattaagtaaggcttggctggggatagcaacattgggcagagtatagaagaccacaaaaaaaaggtatataagggcagagaagtctttgtaatgtgtgtaacttctcttccatgtgtaatcagtatttctacttacttcttaaatatacagaagtaagacagataaccaacagcctttcccagatatacatatatatctttatttcagcttaaacaataattatatttgtttaactcaaaaataaaaaaaaaaaaccaaactcacgcaactaattattccataataaaataacaacatgtccccttctaaaatgaatgctacagtaggatctacttccgaagttgaacaaaaaatcagacaagaattggctcttagtgacgaagtcaccaccatcagacgcaatgctccagctgccgttttgtatgaagatggtctaaaagaaaataaaactgtcatttcatcaagcggtgcattgatcgcttattccggtgttaaaaccggaagatctccaaaggacaaacgtattgttgaagaacctacctcgaaagacgaaatttggtggggtccggtcaataaaccatgttctgaaagaacatggtctatcaaccgtgaaagagctgcagattacttgagaacaagagaccacatttatattgtcgatgcatttgcaggatgggatccaaaatacagaatcaaagtccgcgttgtttgtgccagggcttaccacgctttattcatgacaaatatgcttattagacctacagaagaagaattagcccattttggagaacctgattttactgtctggaacgctggtcagttcccagccaatttacacacccaggatatgtcttcaaagagtactatagaaattaacttcaaagcaatggaaatgatcattttaggtaccgaatacgccggtgaaatgaaaaaaggtattttcacagttatgttttacttgatgcctgtgcaccataacgttttaactttgcactcttccgccaaccagggtattcaaaacggtgacgttactttattctttggcctaagtggtaccgggaaaaccactttatccgcagacccacatagattgttgatcggcgatgatgaacattgttggtccgaccatggtgtcttcaatatcgaaggtggttgttacgccaagtgtattaatttatctgccgaaaaggagcctgaaattttcgacgctatcaagtttggttctgtattagaaaacgttatctatgacgagaagtcgcatgtagtcgactatgacgactcttctattactgaaaatactagatgtgcctacccaattgactacattccaagtgccaagattccatgtttggcggactctcatccaaagaacattatcctgctaacttgtgatgcttcgggtgttttaccaccagtatctaaattgactcctgaacaagtcatgtaccatttcatctctggttacacttctaaaatggctggtactgagcaaggtgtcactgaacctgaaccaacattttcatcttgtttcggacaacccttcctagccttgcaccctattagatacgcaaccatgttagctacaaagatgtctcaacataaagctaatgcgtacttaatcaacaccggctggactggttcttcctacgtatctggtggtaaacgttgcccattgaagtacacaagggccattctggattctattcatgatggttcgttagccaatgaaacgtacgaaactttaccgattttcaatcttcaagtacctaccaaggttaacggtgttccagctgagcttttgaatcctgctaaaaactggtctcaaggtgaatccaaatacagaggtgcagttaccaacttggccaacttgtttgttcaaaatttcaagatttatcaagacagagccacaccagatgtattagccgctggtcctcaattcgagtaaacgaaacatgttcgttcgatatgttcaatccaaaaaaaaaaaaaagaattagaattatttcgacatcataaatgttcgtaatatattattttgtcaattttttctcttcccatttcagcttttttttaataactgaaactggatcaacaagcacatgtttttctaattaatctttcaaacatatttatgtatatacataaggaaaattcaaaaatccgatgcaattaacagaattcttcttcatagttctcttcatccattctttcgtagaataagacgtatacctcatcgctagacatttctgttttgccggcttcaaagttgttgcgatccttgcgatgttgctgtatataatcgtcatcaaatgtaacccaaacttgtctattcagtccaatttcatggctcttttctttgttcacaacagaagtatagtgtccattgataaggttaccggaatgattcaccgttccatataacttgtatcgaatcactttaccgttctttaaaataatgttcaatatcaaagggtaggttattacagtgctgtttttttttgttaaatcataatagaaccttgataaatgaatgacaagtatcggaggtaaaactataaagtctaaactcttaatcgtggttaactttttagaatttcgcttctttgcattttttgttgaatcatcgctgctatggtgatgatggtgatgatggtggggtgattttgaccttgatctggaatgaaaaccgaatatggttgattttttcttctggctagtaatttcttcttttttggatttagaatcagtaattctacaattaggacaatcccaagcattgtcgcctgacagttcttcatcgcctgtaaataagtttatgcaatcctctaatttaatttttctcgacttacttgtaaagctatacaatgatagttttggaatcgcaagtgacagaacatagaaggtagaatagctataagaagaattaccacagcgctgacatttcaaaatgttctccaactgccctcgatatatgtgatcaattggagataaaccatcagtaataacatttctctcgtaccatttctcgtatttggatgggttaacttgtaaagcattcgcatcatatgacactagatctggataatacttgacaacattttcgttcgagagctcttcatgtattcgtgctaaaactattagtagaaattcctgtgtatcctgttgatcatctgggatgttcaaatctggccttaacttcttgcacatttttaagaatctatttggtataatcgctcttcctccattcaaatacatttttttgaacaaaacgtaaatcgagcgggaaagttggacttctttcggatatttgttagtattgaggaatagcctatatttcttggttaaaaacaaatcccgaaataaggtagtgccaaacagacattgaattatactgttaatatagcatgtattgcatggattttgcaggccagtaatagataactctgataacagatcattagaatcttcaattactggtagattgtaagctttcggggccgaagattctatggcctcgatctttccttcttcctcctttggcttttccaccttggataaagaggatgaagaatcttggctagaatctctgatttgtgacgaaacctccaaggagtgcacggggggagcagttgctggactagacagcgttttgaataatgcatcctttccagtactgagttttaaatacgagggttttgataatgcttctttgcttgtgtagtacgccacttcagaaccagcttccaatttattacttgatgctatctgattactttccctgactatgtcctctttcgaattatcatttgttggttttgttagctcattcggtatttcatgtagtgagccatcaaacttgttatgtattgacaaagaggccatatgaacaggtaaaggccgtagcggtaaggagtaggctctttttctttttatggtcctgcaaattccgtttgactccgctaaataccggtcaacaataacagtactttcatctcttaccacttttaacacataacccatcacgtgttcgtcttgatagtcgttttttagctttgcgtaactgctgtagagattatttcttgtttggaattgtaacgattgtggaataataaggtacagataataacaaccaataataaatgctgtcaaagcttccatttcctgattgatttctaaatccctcaggtaaacattaaacagatgagcagcatggtctaacaatcctcttaagttctttagccgtaattgcgaataaaactgtttaatatctacttcatatacttttcgaactaggtttagaatttgatctgggtttaataacattgtctttatgacttccgatttagcgaaaagaaaacggaaagtaagatcaatgccacggttatttagtttactgaagatcctgaaagactactagcagtagcagtaacctttcagagcttataatcaacctaatgattactcagcgcacaatctaaaagggtttctcaactaattctcgaagaaatgtcaatcccttttttaagcactccggaaaaactttataatagatgtggggaaatcacctttgacgatgtgcaacggagaaactatttttttttttctttttttctttttttttttttttttggtccgaacaatgcgatgagccagacgaagaaaaaaataaaaaatgagaatgagtaattatgttaagacctttagaagaaatagggtccagtcacagaataaagccccaggaaactttaaagcaatcgaaattaaccagctatatttatataataagaaatttttcttattagtttactataaaggactagtgtacgttttttgtgtttaattatttgctttctgataatccggtttgctgatttgaatcgttctctgcaacaattgttgatctctagtggggtaaacaaaattagttttgtttaaaacttttgttgtagcgtttttgctcttttttttttatcgcagaatacattttatcgagaatgtcgaatataagtaccaaagatatacgaaaaagtaagccaaaaagaggatccggcttcgatttacttgaagtgactgaatcacttggctatcagacacacaggaaaaatggaagaaattcatggtcaaaggacgacgataatatgctacgatcgctagtaaacgaatccgcaaaggagttaggctatgagaatggacttgaagacgtaaaaacaattcaacaatccaaccatctttctaaatgtattgcttgggatgttttagctacacgattcaaacacaccgtaagaacttcaaaggatgtaagaaagcgttggacaggatctctggacccaaacttgaagaaaggtaaatggacacaagaagaggatgagcagctcttgaaagcttatgaagaacatgggcctcactggctgagtatctccatggatatccctggaagaacagaggatcaatgtgcgaaaaggtacattgaagtgttgggacctggaagtaaaggtagattaagagaatggacgctcgaggaagatttaaatctgataagtaaagtgaaggcatacggcacgaaatggagaaagatttcgtcggaaatggaattcagaccaagtttaacgtgcaggaacagatggcggaaaattattactatggttgtgcgaggacaagcatcagaagtaataacaaaggctataaaagaaaacaagaacatagacatgacagacggaaaactccgacaacatccaatcgccgattctgatatacgctcagattctacaccgaataaagaagaacagttgcagctatctcaacagaacaacccttcattgataaagcaggatatattgaatgttaaagagaacgaatcgagcaaactaccaagattaaaggataatgatggacccattttaaatgacagcaagccacaagcattacctcccttaaaagagatatctgcacctccaccaatcaggatgacgcaagtcggtcagactcataccagtggtagcattaggagcaaagtatctttaccaattgaaggtctttctcaaatgaacaagcaaagtcctggaggaatctcagatagcccacagacaagccttcccccagcattcaatccagcatctctcgatgagcatatgatgaatagtaatagtatttcagattctccgaagcatgcttattctactgtgaaaactagagaaccaaattcctctagcacacaatggaaatttacattaaaagatggtcaaggtttgtcaatttctaacggaactattgacagcacaaaattagtaaaagaattggttgaccaagctaagaagtactctttaaaaatttcgatacatcaacatattcacaatcattatgttacatccacagaccatcctgtcagcagcaatactggattgtcaaatataggaaatataaatggaaaccctctattaatggatagtttcccacatatgggtagacaactgggaaatggtcttccagggttaaattcaaatagtgacacttttaacccagaatataggacttctctggacaacatggatagcgattttttatcaagaacacccaactataacgcattcagcttggaagcaacttcacacaatcccgctgacaatgcaaatgaacttggttcacaaagcaatagagaaacaaacagcccgtctgtattttatcctcaagcaaatacattgatcccaactaattctaccgctacaaataatgaaatcattcaaggaaacgttagtgctaatagtatgtcaccgaatttcaatggaacaaatggcaaggcaccaagttcgacggcatcatatacaacgagcggttcagaaatgccacctgatgtaggtcctaatagaatagcgcatttcaactatttgccaccaactatacggcctcatttaggctcatcagatgcgacaagaggtgctgacttgaataagttactcaatccatctccaaattcagtaagaagtaacggcagtaaaactaagaaaaaagaaaaaagaaaaagtgaatcatctcagcatcattcttcatcatctgtgacaaccaataaattcaatcacattgatcagtcggagatatcaaggactacatccagatctgatactccattgagagatgaagacggcctggatttttgggaaacgttaagatccttggctactacgaatccaaatcctccagttgaaaagtcagctgaaaatgatggtgccaagcctcaagtggtacatcaagggattggctcacatacagaagatagcagcctaggttcccatagcggaggatacgatttttttaacgaactgttggataaaaaggcagatacactgcataatgaggctaagaagacgagcgagcatgatatgacgtcaggaggttctaccgataatgggtcagtcctgccactgaatcctagttgagaaggcaaggccgaaaaaaaacacaaatctttcaattgtttaacatattagttttgtaataagcataagtgtatattatacatagcacaagatggataatattctctgaaaaaaacgtgtagtttcatgactcgcatttttttttttttttctttcatgttgattaacatacttgaattctgtatttaagctgtataaaaagttgttctatttcatatacggcgattttgcataattaagaactttgccttgtacactattttactagggtattcttccaagatttctcttcttattttttccctttataagtcattgtagcaacataatttcctggaaattttaagggaatatatttctttccgcccacaaacacaaagggcgtttagtaaattatgcggcgatgtataaaagagaaagcaggcaaaaagaaaatgaaaaatgagactatgaactttaagaattatgtcttgactaattttttaaaacccatcatccatgaagagttctgtttgtattgtttacgtttgatgtttgaagtgaatttaatagaattgttcctctttttttcttctttttttaactataatataatgtttagtatatcaacagtactatttaggccttagactttctatgaactctctcttactctgtgagtagttggtaaattcgttttcgtattgatcttcctcagcaatttccccgatattgcccacatcatagttattctgtaatttgtataaatccttatctttatctgttattgcagacctgctatcctttaccgagtggtcagcatccattccttcgttatctttatcaaaagtgtttggtaactgtgattgagccgcacttttgggtgttgcaaacacatcctctagggcatcgcgcttatttaccgatgttatagaggaattccttgtatggaaggacgcgtttgaaatgttaccatttaaaaacgaggatgaagctctccttggtaatacgaaccaaagtcctgattctgcaaatttcttatcagattttcattactagattggcgagtattatgtttaagttctatcatcgaagctttgttttggtcattgctagtattagtatcactggaaggatctgcgaaaaagtttggtccttcatcagaaataacagggaccatctgatcataaacgctgatctgtctctttgttatatgccgttgggaagatgataaggaaacattggagctgttatttatacttggtaaatccacaacggacttctgcctggcattattgccgtagttattatttcgtacttgaagtaaatttattttcctacggtatgctggcacatagtatttactattctttttccctaacggtttctcttgatctcgcgattttccatctttttcttctggatgagcagatccttccgatgaaccagaagtgtgatcaggattttttagctcggagctggctagtgctgcttcatctttactgtctcttaagggtccaaaattgtcaaaggacacgaaaccactttcatcataaatagccctttccaattctctatcgtcttgttcctccctcttgtatcttttttgtaggttaaaccagaaacatactgctattataatacctacaccgacgggtatacccaccgcacaacccaccgcaactgatgtgctggcagtcatctcttttacttcttactacgatgagctcccaaaaaaaaaatatatccctgataaataacacaaaactaagaagccggacctaggtgaagagtaaaataaggactcgaaattttgtctaatactcaataactcagtacaaaaactgcctcacagtataaaatatccaacttagagatattcgttttaattgtcccgagcaggcaaacgataactgatccttagtcacaataataagtctatgctttctgttgaaaaagaacaaatagcgagcgagtcagcaagcagaatctaaagaggcttgcaacgaatggtaggcaaagaatttctaacccgaaacctcaagcgaatggtggattccttacttccaatcttctaaaagtctttaactctgatttcgaggatcagtactttttctatggtttattaatatcggcctcgaaaagtttgtcgcgagaatttgggcacatgtgacccggaatgtatattgagtaatataagaatgagaacaataatgtcaataatcacacgtcgttataagcagctgaaaaattataagataatatcaaaaaaaatgctacagatcaactccaggcttgcagttattgatggatggctggtagacactgtgaagcgaaaaccaataaattttcggagtcctgaagtaagattactgttacccaatgacgatgactacaaaaagctatcacaacaaaacttggtggactggacgcgattaaagaaggattctaattcggtgctcgttggagtgaaatctatggaactatttaaacacataaagctagttttgcgagagtttttcttgttagaagatggaagaataattctgaagaggatcagaagcaaattacgttacaaagttgtcaagaaattaacttgtaaatgctgcaggttatatttaccaaaatggggcaccgtgtacatacatccgatgctaaaagataaagaaaagcccttagcgggggtatgtgaattttcattggatgtaaaccctgatcgggagtatccccttattgagatcaatgttagtcatcaatacattataattgagggcttccttctatacttaaatgaaaggaggctctataggtggaacgataacaatttgaggagtcaggttggcttaacaaaatgggcccatttaagaaaaacttacaatccggtaagccttgacatactttatagtttgaattcaaatttttattttgtaaaggatgatctgctatttcaattattaggaaagagggtatttgttaaattttgtaaagtaatggaaaatggaaaatgcggtaaggctccactgtggtatcgtgtgaagagaacgacaactgccaaagcaacacatattgcatatgccatatcaaattcaacagccccagattcattcaaaagtaaaaataacgattataggtttattgtcagggaaaagccaattgtggagaatactatctccaacctggattattcagacataaaaaaacagcagtttactgaagcagaggttgtaaaaagaaagatctcagcagatatttctcaaatagagaatgtgcatacgcaatttaatagtcaaaaggaaaaaaataatatcagggtgaataaggtttctagcgaggtcctagatcaaatttcgaaatttcctgtgtccagagtcaccttactgttgatgtctgctggtcaagataaaaattatattgaacttgttgaagaattggcaagaaggttggaaaaaatatgcatagaaaaaaccacacaatctttagaagagataagggatacttttcaggcgaatcctgagatgcaggctagctttgataaggaatattaccagagcattgaagaatataaaattacactcgaacttattaaggaagaccttttgattactctgataaaacaaatggaaaatatgtgggcagctgaaaaaaagtttagtacagaggaggagtatgtttcgccgaggtttttagtagcagatggatttctaatcgacctagcagaggaaaaaccgattaacccaaaggatccgcgcttactgacactgctaaaagatcatcagcgtgccatgattgaccaaatgaatttagttaagtggaatgacttcaaaaaatatcaagatcctatcccgctgaaagccaaaaccttatttaaattttgtaaacaaataaagaaaaaattcctacgaggtgcggacttcaagttacatacattacctacagaagcaaatttaaagtatgagccggagcggatgacagttttgtgttcctgtgtccctattcttttggatgaccaaactgtccaatatctgtatgatgacagcattattcctgaatttgaagcaacatcttcatatgcaacaaagcagtcaaagtgtgggcggaaaatgtctttgcaaatggagcctgacctcctttttcaagaggccattagacggatgcgacatttaactgcttatgacgttttgagaagaaactatattgcggcatttgaggagctatatatgggaaactgtaacgattaaatagttggtaagattatcagttatggataccaacatataagcgggtgatgtctcatttcaatgaggtcagataactggtacagtttcgcctttaatacacttgtttgacagaaacttgtttttaattgcttgattagctaagtaactcgagccgtactgtagtaccgttaaatatatattatgtaggacttagtagaatatactaataatagatactgcaattgatgatcccaattactgttttattgactaactttcactgaaatgttttcattctctgattttatatttagttggcgaactagctcatcctaattataattaaacttatatatagcataaaccgacaataatgcgtgggtggtcctccatgccgaatttgtgaactgaattattatctaagcactggatcgatcaccttaagatgatatattatttataactaaaacgcagcagcattacactccagagtaactcctgaatttcgtcatggcatgtacttatactatataaccaacaaaggatgactgaataagaaccaaatacttttcaagagataagatacgcgttgccattgttcgcaaggcagatcaagaagcttcctaggcctgtgaaaaaaggaggaaaaaagaaatgaattttctagctgtatttagattggatttgaggttcactagtataagcaacagctccagttctttagtcaagtgccagcttcccttgaaatattaacctcccttttttcttcgtaaaccactattatgaccatcggcctgttaataaggagaaaaatagaaaactgaagcaatagcggtatcataaagctgaccgtgtaaagtcaccactaacctcccaataaactcttccaactctgtttttttcaaagctagtggtgcatttgaacgctatttaggattccgatctcttcagaaacatgctgatttagaagtagtcaaattacttataggcgtgaatttcgaaattgatctcttaagcagaatttagttgtatcaaactatattcgttttggagcgcatatactttacatttcgatgcgtttaacgttgcctctgttcttttcctattaattctattagataagtttatttccatctcatataaagaagaacctgtcgaggttatatgatctcttttccgtctttttaccgattctggttagtgtatgcttcatttgagtttcttgcactgctttgccgaccaaatatggaaatcatctattttaactctattattgaagaggcttttcctggcacatataaatatgaatataaatgttgtgcggctgtaatatttggctagaattaccagcctgattgcgggttatatattgccttcttttggacatttactcccggtgtaatgttggcagcagtagtacctatacctgtgtgccacccgtttggatattactataacttcaaaatatgggaggattactttctcgaaagttgctaaaaaaatcattcgggaattttcgctacagattaatcaaatgtagctcgacagtcttcatattatgagtttaaaagttctttaatattcttgtacatctcaattgttatgtcaaccaattaccagttaaaaagagagaaattttatgagttattagatgattatgcggtgcagaacattgaggttcctcgtgataatgataatacgcacagttagagagcaagttagaaagcagattagagagggacaagaaagataatatcttcagttctgtaaggctacttttaaaccaaatgagccagaagacttctctattcgtgagcgtcccaaaagttatggtcattgccagtggagacgaagctgtactttttactgcttcacctgtgttttatatagatagctcataaagagatattgacaccaaactcaaacgaaagcttacaattccgcatcagcattgagaccctatattcccctcatctattccaaataagaatcatataaagaattcactaggcacagataactgctgatttatagacataatcccttcgcatccacgttagcatgattggtgacacgctttctgagcattagcttgcgataggtttccagcatctccagttacaatcatggataaatacacaaggcgacgttcaaacatgactgaggaaatgcagtatttaaagcttactctttcctcagttgagtacggtaaaatcgattaacaagccatttcaatagttataatttttttttttggtcatggaagacctgaactaaagtgttttagtaaaccaattggagtgagagtttttcattccgaagattctttatctcaaaatttctttatcgaaagacacttctgtgtcactgtccgttcaatcagtcagatagttccaactccgatgtcttccaatacctcaacgaagaccgaaaaataaaaggtttgtttgacggagtgtgttgattagtgcattggtgacgtggggtagcaaaatccagatacttctattttttgaaaaagaaaagagagagtgctagaatgttttcacgtttatcagtacacgaaaaacaaaacctgaagcaaatgattaccataactattgtccacttatggggaagttgctaaaaataacacattatttactaagggaacacaaattgctcatagtatacttgactttttttacttaacttttgcagcgattggtgatgaaatgtttcaaaaaaaaaaaaaaaatcgaaaatccattgtattgcataagaaatggcgaattttaggcacgaaattaacttacatctctccattcctttcctcatgaaagaaccgttatgttagctagccctgaacttcttattttggaaggaccctcacctcaattttcaaatgaaccgcggacttcactttctacggtcgtttcttcaaaaatctttacaacgtatatcgcctgttgcattgcctttttcggaaaaccttattttacgacaaaccttttttaggattaaagtttaaaaaatttcttcgtctgcctcaaaattgcgcagctttaagcttccagaatgttttacacgaaataccctagcgctgcatttctttttttcctcagttgcggtagtagaaaagtattacatcagcacgagtaacaacttatggtgtcagtttcataatttcacgcactaaagttaatttccccttttgttcaaaaactttcaggaggtgtggccatgatggacagaaagaatgttatgctttaggattattgtacaattatttagatttgctaaagcgcgtcttatagtaatcgtgcagtaaattttgtaattcagttccagttcactttatcatgatagtgttttatcagtttcgaatttttggcacacgaaagcttgttttcctttataattcttttcaggaattataccttacttcaatttagaagcgcatagcaaacgggaagaatgcgtacactgcagggttgttgtgatccgtcacgtgtatgcaaaacgcgttagagagtagttatgtgctaactgtgtggtagaaatttatatttctcttttaaggttgtttggtatgtatccgccgtgaaaaaagtaagaaaacatccaaatgggctcctgcctgaatgtttccttcgataaacgtatacgccaatagtgaagaaagtcgcctaaatttattctgttgtaacgaatgattcatggtttaacttttttagactctagtataactagcaagtatacatatttgctcaaaacatgttcgagtgcgaaagtgttgacatataaagagacacttcttttacgttccactgtttcgagtttacgttgaagatttgttttagggtgcttaatcaaagaacaacaaataaaaaatgcctgtggctgctcgatatatatttttgaccggcctatttttgctatctgtagctaatgttgctctaggtactacagaggcttgtttgccagctggagagaagaaaaatggtatgactataaacttttaccaatattccttaaaagattcatctacatactcaaatccgtcatatatggcctatggttatgctgatgcagaaaaactgggttctgtaagtgggcaaacaaagctttccatcgattattccatcccatgtaatggcgcatcagatacttgtgcttgttccgatgatgatgctactgaatatagcgcttcccaggttgtaccagtgaagcgtggcgttaaactttgttctgataatacaactctttcttctaaaactgagaaacgtgaaaatgacgattgcgatcaaggcgctgcctactggagttcagatctgttcggattctacacaacacccaccaacgtaaccgtggaaatgacaggttactttttaccaccaaaaactggtacctacacatttggcttcgctactgtggatgattcagcaattttatcggttggaggtaatgttgcctttgaatgttgtaaacaggaacagcctcctatcacatcaacggatttcactattaacggtattaaaccatggaacgcagatgcacctaccgacataaaggggtcaacgtacatgtacgccggttactattacccgatcaaaattgtttattcaaatgctgtatcctggggtacgcttcctgttagtgtggtattgccagatggtactgaggttaatgatgattttgaaggatatgttttttcttttgacgataatgctactcaagctcactgttccgttccaaaccctgctgagcatgcaagaacttgtgtatcatctgcaacatcttcctggtcgtccagtgaagtctgtacagagtgtaccgagaccgagtctaccagttatgtgacaccatatgtcactagctcttcctggtcgtccagtgaagtctgtacagagtgcaccgagaccgagtctactagcacctctactccatatgtcaccagctcttcctcgtcgtccagtgaagtctgtacggagtgcaccgaaactgagtctaccagttatgtgacaccatatgtcagctcgtctactgctgccgcaaactacactagctcattctcatcgtccagtgaagtctgtacagagtgcaccgaaactgagtctactagcacctctactccatatgtcactagctcttcctggtcgtccagtgaagtctgtacagagtgcaccgagaccgagtctaccagttatgtgacaccatatgtcagctcgtctactgctgccgcaaactacactagctcattctcatcgtccagtgaagtctgtacagagtgcaccgaaactgagtctactagcacctctactccatatgtcactagctcttcctcgtcgtccagtgaagtctgtacagagtgcaccgagaccgagtctaccagttatgtgacaccatatgtcagctcgtctactgctgccgcaaactacactagctctttctcatcgtccagtgaagtctgtacagagtgcaccgaaaccgagtctactagcacctctactccatatgtcaccagctcttcctggtcgtccagtgaagtctgtacagagtgcaccgagaccgagtctaccagttatgtgacaccatatgtcagctcgtctactgctgccgcaaactacactagctcattctcatcgtccagtgaagtctgtacagagtgcaccgaaaccgagtctacaagcacatccactccatatgcaacctcatctactggcacagctacttcatttaccgcttcaacttccaataccatgacgtctttggtccaaacagacacaaccgtttctttcagcctatcttcaactgtaagcgagcataccaacgctccaacttcatctgtagagtcaaatgctagtactttcatatcgtcaaataaaggcagcgttaaaagttatgttacgtcatccatacatagcattacgcccatgtatcctagtaaccaaaccgtaacatctagctctgttgtctccacaccaattacttccgaatcttctgaatcctcggcctcagttaccattctaccctcaactatcacttctgaattcaaaccatctacaatgaaaacgaaggtcgttagtatctcctcatcaccaactaatttgattaccagctatgacactacatctaaggattcaactgttggttcatccacatcgtctgtaagcctgatctctagtatttctctaccaagtagttattcagcttctagcgaacaaatatttcacagctccatcgttagttcaaacggtcaagcattaacaagtttttcttcgaccaaagtcagttcctcagaatcttctgaatcacatagaacatcgcccactacatccagtgaatcaggcatcaaatcttcaggcgttgaaatcgaatctacaagtacctcttctttcagctttcacgaaacttctacagcctccacctccgttcaaatatcttctcagtttgtgactccatcctcccctatttccacagttgcccctcgttctacagggctcaatagtcaaactgaaagtacaaattcttccaaggaaaccatgtcgtctgaaaatagcgccagcgttatgccttcttcatcagctacatctcccaaaacaggcaaagttaccagtgatgaaacttcttccggattttctcgtgatcgcaccactgtgtataggatgacttcagaaacaccctccacaaatgaacaaacaactttgattactgtaagttcttgtgaatcaaatagctgctcaaacacagtctcaagtgctgtagtttccacggccaccactaccatcaatgggattaccactgaatatactacatggtgccctctttctgctacggaattaacaacggtaagtaaattagagtcagaagaaaaaaccaccctaattacggttacttcttgtgagtctggtgtctgttccgaaactgcttcacctgctatcgtttcgacagccactgctaccgtcaatgatgtcgttacagtttattccacatggagcccacaggctacaaataaactagcggttagttctgacatcgaaaatagtgccagtaaggcttcattcgtttcagaggctgctgagacaaaatccataagcagaaacaacaattttgttccaacttctgggactacttctattgaaacacatacaaccactacaagcaacgcgtctgaaaatagcgacaatgtttctgcttctgaggctgtcagtagcaaaagtgtcacaaatcccgtgttgattagtgtatctcaacagcctcgtggcacaccagcaagtagtatgataggatctagtacagcctctttagagatgtcaagctacctcggcattgcaaatcatctactaaccaatagtggtattagtattttcattgcctccctattactggcaatcgtttaataggtgcagaaatatcctttggattgatacttctgcgtctacgattcgtcctagtgccatattatgtacctatttatttactattcatttctttgttcttctacttcaaatagctcagaatgtattatttttttattaaaatcatttctatatataggattaacgagaaaccattccgggagtggcatctctatgttttctctatgtaagccacaccagagaacgttgctgtactaagacacccatttcgagtatagaagcttattgaaaatgaactgatattttttaatacatataaatctcgattaaagacaaagcttattggacatggagtagatgttttgatcaatagattttcaacaaattgaacggtttgctttagataccgtttgagataaaatactgcattttaatgaaacataaagtcaaccaacagctgaagcttaacaatagttactactgcccggcgttattatcacaacaattcgttctaccaaaaaactgtgatctttactaaaagaccttttttttttcagacaattttgcttaacgcagtaaaatgtagtaaagacgaactttcggataaaagactccaaagatagtatgataaacagacagtggtatcagtactatagacaccagttaagacgttggcactgtcttcaaatcttggctagaaattttggagggtatcagtcaattgctgtctgcgcatcccaataaacagttgtctaggaaagaacaacggttttaattgacacaacatgctgaagaatataggaaaaggagtagcggcaacggatgagctagcaagaaaagcatcactctctatctgaaagcttccatgatttatctttcaacccagcaaggtagtgtttttccaatataagaagcatacggggttatagaagctaatcgtgcccagcatgagtcctaacaaacagaacagactctttatccatccgaattctagtaagtaattattctgttcacttctatccaacgaaatgggcgtacgattgaaataacagttgattgaaattataggggccctattcgccttctacaaagcacaaggaaaggaacatttacaatgaataatacgaaacagctggcaaatgtgctgaaaaccattgagcgatgttaccacgctgagatccatgttttcaagagtgggctgtactataatgaaccaatgtgttctttaaaattgttagtgtgttttcccaacatgaaattgctactggaagaaattgatattgtaataatatatgtgagtatctaatcacacactggctgcatcacattgattcatgttatgtttttgaaattaatgtattcgttgtgcatggatgttacacatatcctaaacctaaattatgagtacaaacacacctaggtagagagctctacgtcgtcttagttctcagcttgtaagctttaatttacgcgaaaagctatttacaattttttatttgaaaattgatcgcataacttaatgaaagtgtacaaagtaggataggcattctttggtaccgattttctgaattgtcaccagcaaagcctcatttatttgaaatcatgaaacttgttaacgattaaatctagcatggcgatactcggaaagtccataaagaacttctggcaagagccgaaattcacggtaattttaattgagcaccactatagcagtgtctttattgagttggctaacactaaggtcgtattcagtacttctgaatttccagataatataatagacgctcatactaagaaaatattcactataagaacctttcacaaatactaacctagaatatttatctttctatttgagtaagaatggaaaataaaaaagtgttaataaggtataacagagtgtattttcaaccgtaaagaaatgaataagaataaacgcgatttaagcttaatagaaagtacataagcaacgtcgcgaaccggtaatggaaaaaataattgttttatcgcttttcttcagagggtttttgtaatcgatatttgggtggaaaattctggggccctacgaaatgacgaactaaaagccaagagttctaaaacccttcagtgtagtgctttttgaaaagccagttttgttatgagcaacaaatacatgtgagcttagaaagatagattgagcttacctgaatcaatgtgaatcgaaaatttcctccgtcctacaagtatatattggaggaagataaaaccaagattgatgcactgcgttttgtaaataggttctgggattaccaacgtacttcttgataaaatgggctatttttaaacgctttactttttttcttcagcggaacccggtggtttttatgatctttatacttaattgatgattacagttttggaatcaaaagctttattcggaatattgtgcaaatatattgttgtttttattggataatggtgtctagatttaaccaagatattagatttatttcgcttatagcatcattttttttttgatcaaaattttcaactctttgaaagtgccatatttcacaaaatataacatttgtcccacgatttagaaaaataccataatcactcttcaacaattttatttctttactctcctactacagttgcgtacattttaactacacgtttaaaatattcaagatttatgagactgtcatcgaatggtatataaaataaaaaaaaattatatcttagagtcctagtttaatagaaagaataaaaaaggtcacggaacatcactttctaacatatcttcctgggtttcatctttactagaactgacggtcaaaggtctttggagagtactcgcttttttgatgaaaatcacgatagttaatttttccgccatgttgtaactttctcaaaactgcaatttcagggtgtccaatttactgtcaatatgcaaccaaaaatataacaaagtccttttgagcaaataaagtcggacatgacagtacaacgcatgatcgattattaaacgaaaatgggatatcatactgttttagaagttattgggtgcattactctgtcataaaaaaatcatgttactatctataaaaaatgcctaaaaaattggattaccacttgttatggaaagatcagtaaaatataggataaccatagcgtaagtctggcgttctggaatatttgttttttagttattaaacatacttttcacgattcacagtattaatttttaggaatgataaaaaatggtacatgcccctattgggaacgtgatgatctttcggaatgtgctaggcgagaatatatcgagtttaaatttcctctatttatattgttgactggtatgatatacgcgttttgcaaagtctttcgagccttttatctaagggggaaaaatcatacaaatgaagcgccagaatttgaagaacaaggtaatggaaaccacgaatatgcaaggttctcagttttaagactaaaatctgcatgggaaagccgtagcttttgtaatgttaataatagatctactttcgacaaattcaaaaaatttatagagggtgccttcattgttttgcagcttactatccacctgtatattttatctagtatgccaatggataacaaaaagttctttcaccaaggttttctggttcaaatgtttctctggattttactgcttgttgttattacacttcgtttaatttcagcaagccagtcatttcggtgggttttagcatgtaagcgtgatttatgggctgtttcgttttactcatatgcatccctgtttactctttcgattttacctcttcgttccgtcttcattggaaagataaaagataaaattatggtcaaatatatcatttccgagactttcattgatttagcgcttttattattattatcaacgtcaagtatagaaggaactaggtactcatttttggttgaaaatgagaacaaaaagttgccaccggctcctaccgtctttggccttcttactttttctaggattgatcggcttatttggaaagcatacaaacactgccttggaaacgctgatatttgggatttggatattaataataagtctatagcaattttggcgaactttgaaatgtcttctaaaaaaggaaggctccttccaaacattatttgttattttaaggctgttttcatctcccaattatttctggcttttgtatctagttttttgaactttgtaccctcattgttgatgccaagaatactatcatacgttaatgacccaaagtcaaaatcatggaacttggtgtctttatacgtctcatctatgctcgtcagtaaaatcattgccacgacttgtagaggtcaaggattgtttttaggtgaaaagggtactatgcaactaagaacagttttgatatccaatatctattccaaaaccttaagaagaacaattctaaaagactcaacaacgtcacttcaaaaaaatgcgtcaacatcctttgaagaaaatcctgactcttctgaagcggaacctagaaaaaagtctagtaggaaagacaactctgtgaacaatgttatgtcaattgacgctttcaaggtttctgaagctatgaacactttttatctggcatgtgaagcagttttcatgacagttacggccctaatgatactatattccctactgggatggtccgcctttgctggtacctttgctcttcttgccatgattcctttgaatttttggtgtgcaactttttacgggaactatcaggccgatcaattaatcctaactgacaagcgtacctctgggattagtgaggctctgaactcaatacgtgtaataaagctactggcatgggaaaatctgttttatcaaaagattataaacgtaagagatggggaaataagactccttaaaaagaaggcaacaattttctttttgaaccatctcatttggttctttgggcccactttggtctctgcaataacattctcagtgtttattaaattccaaaatcagacacttactcctacaatagcatttacagctctttctttatttgcaatattgaggacacccatggaccaaattgcttcgactgtcagccttttgatacagtcttttatttctcttgaaagaatccaggattatcttaatgaatcagaaacaagaaaatatgagattttggaacaaagcaatactaaatttggctttgaagatgcaagcatggaatgggaagctgctgaaacaagttttaaacttaagaacatttctattgattttaagctgaatagtctcaacgcaattataggtccgactgggtcaggaaagtcttcgctattacttggactattgggagaattgaaccttctttctggaaaaatatacgtacctacagttgaatcccgcgacgacttagagattggtaaagacggaatgacgaattcaatggcatattgttctcaaactccgtggttgattagtggaacaattaaagataacgttgtttttggagaaatcttcaacaaacaaaaatttgatgatgtaatgaaatcctgttgtcttgacaaagatatcaaagcaatgacagctggcataagaacagacgtgggtgatggaggattttccttatctggcggacagcagcaaaggattgctttagccagagcaatttactcctcttccaggtatttgatccttgatgattgcttgagtgcagtagatcctgaaactgcactttatatatatgaagagtgtttatgcggccccatgatgaaaggaaggacctgcatcattacgagtcataatatttctttagttacgaaacgggctgactggcttgtgattttagatcgtggcgaggtgaaatcacagggtaaaccatcggacctcattaaatctaatgagtttttgagggaaagcataaacaatgattcaaaaaatacaactcacaatcaaattgacttgaaaagatcaacaacatcaaagaaaactaagaatggagatcccgagggagggaactcgcaagacgaagtgtgtgctgaagttgaaaattttgaggaaacaaaaatggaaggatcagttaaattttcagcttacaaatggttagcagactatttcgggggactgggagttgtttttgttttcacctcgtcctccatccttattcatggaatcacactgtctcagggcttttggctcagatactggctggacactggatcttcagggagtaagtctacctggctttatagaatagttgagggtcactctaacatctatttcttactgacttatattatcataggtcttgtttcttcatttttaacttctggtaaagtttggatagcaataatttcaggtaccaacgtcaccaagaaaatatttgcgaagcttctatccagtatcttatatgccaagttacgttttcataatgtcacgccgactggaagaataatgaacagatttagcaaggatatggatattattgatcaacaattgatccctaatttcgaaggactctcttatagcgtcgttgtttgtctgtggattatacttttaattggatatgttactcctcaatttctgttatttgctattcctttatgcgctctttattataccgtatgtacgttatatcttcgtgcatctagagagttgaagagaatagataacatcaatatctctccaatacaccagttattcgctgaagccatcaaaggagtaactacaattagagcattagcagatgagcgtaggtttatcactcaatctttggttgcaattgacagaagtaatgctccatttttttatctcaatatggccaccgagtggatcacatatagagtggatataattgggacacttgttctttttagttcttctgtaatgatcataatgaaggcctcatagttggatgcggggctagcggggatactgttatcgaatgccttttcctttactgaaactgctcaatggatcataaaagtattttcaagcgttgaacttttgatgagttcagtagagagaataaaagaatatacagatataccttccgaatcaaacggctacatatcacctccagctaattggcctcaaacaggagatgttgaactaaaaaacttatcattgcgctattctcctcattcctctaaggcactagataatgtatcattcaaggtaaaagcaggaacaaaagttggtattgttggtagaacaggggctgggaaatcttctattatagcggctatttaccggctttcagactgggaaaacggtacgattactattgataacaaagacataaaacatatccctttagagcgtttaagaaattctataagctgcatcccacaggatcctactttatttgatggaactgttcgatctaatttagatcctttcgatcggtattctgatgtacaaatttatggcgtactatccaaagtgggattaattgaagaatgcgatgaattgtgcttgatttttgagcaagagcagcctaatttttctagtcataaactaagaaatagattcattgatttgaatactgttgtgaaatcaggtggttcaaacttatctcaagggcaaagacaacttttgtgcttggcacgatccatgcttggtgcacgtaatataatgctaattgacgaagcaaccgcctcaatagattatatttctgatgctaaaattcagaaaactataagagaaacaatgaaaaatacaacaattttgactattgctcatcgattaaggtcagtaatagattatgacaaaattctggtgatggaaatgggcagagtcaaggagtatgatcatccatacactctaatatctgatcgaaataccattttttaccgcctctgtaggcagagtggcgagttcgaaaaccttttcgagttggctaaagtctcattcgataataaaagataagacaactagaatttcctatttttattcattccagttctagctacgaagtatacgatctgcttacgtcatatatttgtgtgtaattagaaggcattcaggaagtcgcttttaacttttcagggctatatgtcctaatccactactttttttgagaactttaagaaataactcctttgaacctgtctgtgccaaacaaaattttgctggtacattttatggtatataaacaagctacgttattattacttttttttgatagttttacttatactagaaaataatattatatcatcacaaaagaaactctctcgttaagaatcccgaatattcagcaggagcaaaaaaaaaataccataatttaaatgcttattcagtacttagctgctgattttatcgcaagtatactattggagagtaccgtggttcatatcgtgctatttttatctatatttaaatttatagaagtttatcgtagtatactatgtaattctctgccgtattggcggcaaagacaaaagcactgacagtaaacagtttttctgatgagaatttatgtcgaggaacaaacgaaaattttgctggccaaatttgcttacgcctttaatgtgattgcggttgaggtctgttattacgcagctgctatcatgtgtctatttgagattctctttacaggttatcgctgcatttttgtcaagaaaagaaaagaagacaacctttttcttgcactgcgatgagtatattcaggctcgcgaattttccagatttcttactaaagacacatctttgaacgcaccagcatgaattttatgaactactgatccatatattaataggttttaagtacatatagaatacttaagaaattacattccattgcgatacacctatttgattctgattgtgttgaagtctgtataaaaggcgaaaaaaaataaaatgaaaataagaaaataactgcgctacttgtcttctaaattatcttctggtgtatcgtccttttttggtatgattaatttcttattggatgaaaaactacaaaacaaaaatcctaaggcataaaaccctagatccatccaaaatacgttcttaatggagtcgcttaaaatgtttccaatagtcgaatgagaaccgtcgtagttttgaagacgatacaaaatcatgtcatcaaccgtttttccttcgtaaggctctagatgagctcgtgatactttattgtgaaaggaggcggaaaaaacagtggttgaaagcacaccaccaagagttgtacctaatgacttcatgaatgtattgaaagctgttacttcaataaagtccatagcagcttctggacgatctttggtaatttgaagctgtgcactcatgagcgatgcttgtagagcaaatccaagggaaaaccccggtaatagcaaaacaccaatttgagttgacttcgtggacgtatttgtcataagtgtcataagccctgctccaattaccccaagaacgcctccaaatattaagagtggtttaactaaaccgagctttttggtaatcacaccacttgcaatggccgcaataacgttggtaataacgattggtatcaagtgaagaccggctttccatgcactcgacgcaaatataagttggaaaaactggacagagtatatcatttgcccattgtaaccggtacataatagaaatgttaccatgtttactattattatggctggttttgctaccaatcttcttagaaggagaggcctgtaggatatattatcaggttccgggttgaatttatcgaataggaagaaatcgtacaccaatgaaaaaataaaaagtaagacacccaaaaccaaatatgtgatgacttggccagagttccaactatatttattaccaccaaaggttagccccagtaggaaaaggaccagccctgcagagcagagggcaaaaccaaagaagtcaaacttgaagattatgccattcataagtcttttaaaattaacttggtgtctgaacttactaaaagtaaagctcgagattgttcctatagcatctttaatttgttgaagtatacccttattctcggccttataggtgagtaaaaacataataatggcaagaccaccgataggaagattgatatagaagcaccacctccaggtaacatgggttgtaaaggcacctccgattataggaccaacgatagcagctacagcaaatgcacaacttaggatggaaatcaccaatggacgtgacctttcaccaaccatcgtacaaccaataacaaagcaaagcgtttggagtccgcttcccccaacaccagcaacaactctaccgaaaatgagcatattcattgaagaggcaagggcagcaattagggatccggcttcaaaaataagtattgctaaaatgagactatgctggaaacctatgatagatgcgaatcttccccaaatgagactcagaatagcatttggtaaactgtagcctgtaacgagccaacctgttttggagtagtttccgaactgttctgcgaccacgtcaataatagttcccactatcaaaatatccagtgcagttatgaatagtacaagagttaacgaagccaggcagaggtacaaggaaagtcccattggagaatcattgctacctctagcattcaatgaagcgtctgaaccacatgctccttctatctcctgctgcgaagagtacttagtttcctccatatttttgaatttctatcgattaagctctataccaggtatgatctggtctgatcagttctaggtatgagtataactagaatacatctatatatatgtatatatatatttaaaccaaaaaaaaaaaaaattcgcttctcataaaggtgtgatgacactattatcttttgcatattttgtcgactcgtatcatgtacgcgctgcatatgaggtgcggcgctatctgttaaatatgtactaatttgcacctgctgcaaaggaaatgtggcactacttttactcgcatgttaactttcacctactatatatagaaaaaagggtgttgctttcaatcgccgactaatttgctcaaatactctttacacaaaggaaattgtgtatcagtaacccttacggtttgtttatgaaggaactttgctcgtcctacaccaccggatctaggtactcaattttttgatgattttgcacttgtgctcatatcctgtcgacaggcaccgcatttttttccttgtttcaacagacataaacacaagcttcactcattagtttgaaaagagatagtttcgacggtacagtattcttgtcgtacaaaagtcttcggtataactggttcgttgtggattttcggaaagtaagttgattgtacgacgacaggtcaaagttaaagttaaagtcaccaggtgtatagacaccacattgaaggggcgtcacagcaattttttttatttttttttgatactcaataattacgagcatataattttagtacttccaaaaaaaagttaaaaaaaaaatagtgacaaaatgtgtcagtaaaatatatatgagaacatggaatgtattaaagtaattccatttctagcagatgtagcgaccgtagaatcttaaatactatttacataaataagaaaagtaaaatagttttatggactggaacgagaaaaaaaaaaaaaagaataatcaagtaaataaattatcggatgagttctagtgttgttggtgcctcaagtaataaaaaaagtggaattaggcagtcctgtgagattattgagcgagaacgtcactcaaacgatgacacgtactctatgacatcgaccttttttaagctcaaagaaaacgaaattatgtctgcacagtttgattccttgaaatataaaattctactgataagtaccgcgtttgtatgtgggtttggaattagtttagactacacacttagatcgacctatacgggctatgcaacgaactcatattcagaacactccttactttcaactgtccaagttatcaatgctgttgtgagtgtcggatcccaagttgtctactctagactctctgaccacttcggaagactaaggctttttttagttgcaactattttttatataatgggaaccatcattcaatcacaggcgacccgtctcaccatgtatgcagcaggatcggttttctataactgtggatacgtcggaacaaatctgctcctgacattaatactctcagatttctcctccttgaaatggagaatgttttaccagtacgcctcatattggccatatatcataataccatggatttcaggcaatattatcacagcagcaaatcctcagaaaaactggtcctggaatattgcaatgtgggcttttatttacccactctctaccttgccaattatatttcttattctttatatgaagtacaaatcttcaaagactgctgagtggagatctctcaaagaacaggctagaaaggaaagaacgggcggattatttgagaatttggtgtttctattctggaaactcgatattgttggcatattattaataactgtgtcgctagggtgtattcttgttcctttgacgttggctaatgagacatcacaaaagtggcacaattcaaaaataattgccactttagtttcaggtggctgtttatttttcatttttttatattgggaggccaaatttgccaaatctcctcttctaccgttcaaattactaagtgatcgtggaatttgggcaccccttggtgttacttttttcaattttttcacctttttcatttcgtgcgactatctgtatcctgttttgctggtatcgatgaaagaatcgtccacttcggctgctcggatagtaaaccttcctgactttgttgctgctactgcatctccattctacagtttgttggtggcaaagacaaggaaactgaaactttctgtaatcggaggttgtgctgcatggatggtgtgcatgggccttttttacaaatacagaggaggatctgggtctcatgaaggtgttatcgctgcatctgttatcatgggtttgagcggtctcctatgcagcaattcagtgatcgtcatactgcaagccatgactacgcatagtaggatggctgtaataaccggcattcagtataccttttcaaagctaggcgctgctatcggtgcctccgtttctggtgccatatggacacaaaccatgcctaaccaactctacaagaaccttggaaacgatacattggcagaaatagcatatgcatcaccttatacattcattagtgattatccttggggctcaccggaaagagatgctgtggttgaatcttacagatatgttcaacgaataataatgacggttggcttggcatgtacggtaccgttctttacgtttacaatgttcatgagaaacccggaactaatagacaaggcgacacacgaagaattcactgaagatggtttggttgtcttgccagatgaggaaaatattttctctcaaatcaaggcactttttagacataatcgaagtaacaagaaatcaggatgttgatccccaagctggtgaaaaaagggcaaaaaaaaaatgaaagcaaaatcacaaaaaaggcaaaaacaagtgatttctacatttttattacttccgataaaaatgacataacaggataggataaacatgctcgatagacccacatttgaacttgcgacgcatatagctgtgtcgtactttttattttcacaagcgtcggtaaaaactcagcgtcggtaaagactcagcgtcagtaaaagagtcagcgtcattgatattaaaagtgcgggaggagttactatccaataaatgatgctggaaatgcgctctgtatgaatgcattaattatgttgtaccgaaaaagaaagaaagaaagaaaaaaaagaatatcatgtaacttctagtaagggcgtcatgtcatagcacttttctaagtgtatgccattgtaaatcattctaagcgaaaaaaagtgatatgtctcctggtattttgtattgttgtcgttacaagttgatgtgttccgtagtgtgagtgcaacatgcgattttggtaccgcaaaaaaggtacagatcacatgggcacagatacaacaattctttatgcctgtattgagatcatagttttcttggagtcggcaacagtctacgggtgaacccaataatccagcagtaaatctactaaccgaacattgtgtcggaatttacacattactgatataattcgtcccattaaacttgctgcgagtgatttccaaaacaagtactacattgagcgtgttcagcgtgcccaaaagaaatggacttgaaaatcttgttgaattaactgtatatcctttaaattagctgccacaatgatagctacctccgcgatatattgacgttactaaccttttgagattcttcaccaatgttgcagcgtgatttaattttgatgaaatcatttttgttgaaagagtaggatcctgtacaggctgaaatatactgttcttcaatatatcacttattttaaatgatacagccatgtattttggggatatcagagataatatcatacccgattgagctggaactcctaggattgttgacagatgtcgactatggctccttactaacagagtatggttgtgaagctaatacagataatgtctcactcgtgcagtcacatctccattgaaagctgtggagtttttccagacaccagtagcagcgccaatggcagcactacagcgaaagttgaactcatagcacatccctgaatcgtggacagttaatgtatgttgttgtgactcagacgataacgataagcctcaaaaagttgtgtcctctcatcatcctcgagcaccagtatatcataagcaaagaatcttcgataatgatttggaaaaaaagcgaaagcgaagccaatgtgttttattactgctgcattactgaagagatataagaagcgctaactcaattacaagagcacataacggaattaatcctgcgaaacagaacagtaattgacacccttatagtagccttttttaacagttaattatggaaaactgagtttgaaattcaatgttaacgcaagtttctgttatttttgcgaatctagacggtctcaacgagacgatatgctctaagattctacttctctgcggatgattctttcggttatcgatgccctttaccaaggcctctcataccatagtatcagaagagcaatgcatattcattcatagatataatgtgatatggagagcaataattaaatttatgcgagaaaaatgtgttcaatataagaatattgaaaaaaatattaaaatgaaaattgaaaaaggcctctttgatacacacaaataatgccatctcttccagtaaaagataagtaagataaactggctatgttatgctgtctgtttatatgttgatacaaggaattaagatctatcttatatgccttagcgtagcgcaagaattgaacatttctatataaaataagtataagacacgtagggttactacttctctgtgtgcatatacctgtgttacggtattgcatgcgagatggggctagacgagaccgtagggacatatagcaccttagaaataaccttgtatgaaatctttcattatttcctgtttagacacttgcgtcaaggtattttttttatcgtggtgttgaatgtggtaacccaatagcataatatgagtaatgctttagtattgtttcagagctgttttagataaagaaaacatatagtagcaaacctctaatccggtagtacttaagaaactatagtttctatgtacaaaacggtaactatgtaattcttacatttacataacatgtagaagaatccaataaacttactacaatatgacatataagctagatcgtaattcattacgtcaacataccgtaaaattatttggcgtttcgttaactcctacaaaaacaacaaacctatcaccgtatcgtcttctttagatatagtctcttcgtatgagtagtgtcacatacaagattaaagatgcattagttatgcttttaggatattgcggttagcatatgggaatagaaataggatgccattgtatcatagcacctgcatgagtgcgagccactaccatattgtttctcggtgaataaagagtgtgtttatgtattattgtcgaaagatagaatatttttatgtttaggtgattttggtggtgattttttggttatattaacataagtgtatataaattgagtggttagtatatggtgtaaaagtggtataacgtatgtattaagagcatttatacgatatttgggcccgccgaatgagatatagatattaaaatgtggataatcgtgggaattatgcgtaaatggcacagggtatagaccgctgaggcaagtgccgtgcataatgatgtgggtgcatttggtactgatttaatgagaatgggccatggattggagtgtgagagtagggtaagtttgagagtggtatatactgtagcatccgtgtgcgtatgaccgatcagaatacaagtgaggatggctatggcatgtggtagtgggattagagtggtagggtaagtatgtatgtattatttacgatcatttgttaacgtttcatatggtgggtagaacaacagtatggtgagtaacagatggctgatggtagggtaatggcagggtaagtggtggagttggatatgggtaattggagggtaacggttatgatggatggtggttgggattggtagggttgaatggcacagggtaacgaatgatgagttgggtaatggaggtgtaagttgtgagacaggttcatcagggttggagtagggtagtgttagggttgtgggtgtgtgggtgtggtgtgggtgtggtgtgggtgtgggtgtggtgtgggtgtggtgtgggtgtggtgtgggtgtgtgggtgtggtgtgtgggtgtgtggtgtgtgggtgtgtgtgggtgtggtgtgtgtgggtgtggtgtgtgtgggtgtggtgtgtgtgtgtgtgggtgtggtgtgtgtgtgggtgtgggtgtggtgtgtgtgt

SEQ ID NO: 12215 - DNA, 1078171 bp, Saccharomyces cerevisiae
cacacacacacaccacccacacaccacaccacacaccacaccacacaccacaccacacccacacacccacacacacttttcacatctacctctactctcgctgtcataccttacccggctttctgaccgaaattaaaaaaaaaatgaaaatgaaaccctgttctttagccctacagcacttctacatagccctaaatagccctaaatagccctcatgtacgtctcctccaagccctgttgtctcttacccggatgttcaaccaaaagctacttactacctttattttatgtttactttttatagattgtctttttatcctactctttcccacttgtctctcgctactgccgtgcaacaaacactaaatcaaaacagtgaaatactactacatcaaaacgcatattccctagaaaaaaaaatttcttacaatatactatactacacaatacataatcactgactttcgtaacaacaatttccttcactctccaacttctctgctcgaatctctacatagtaatattatatcaaatctaccgtctggaacatcattcgctatccagctctttgtgaaccgctaccatcagcatggtaccctcgtgttatctgcagcgagaacttcaacgtttgccaaatcaacccaatgtggtaacaaccacacctccgaaatctgctccaaaagatattccagtttctgccgaaatgttttattgtagaacagccctatcagcatcgacaggaatgccgtccaatgcggcactttagatggggtaactcccagcgcaagctgatctcgcaagtgcattcctagacttaattcatatctgctcctcaactgtcgatgatgcctgctaaactgcagcttgacgtactgcggaccctgcagtccagcgctcgtcatggaacgcaaacgctgaaaaactccaactttctcgagcgcttccacaaagaccgtatcgtcttttgcctcccattcttcccggcactttttctcgtcccagttcaaaaagtactgcagcacctctgtcttcgattcacgcaagttgctccatactttataatacaactctttgatctgccttccagacatgcggaaaacttggctcccttgcttgcctcttgtcgaatccaatacactaattgtttctcttcttctagtaatggccaggtaccaagcataatttctctgtatctgagagtagatctctcccctttttacgctaaaaaatttcaaataccctacagggtccccatgatatggctcgatgtcttccaagtattctttgtattcctcgtcatttcgcagcattctctccacagctagtgcttcccaagccatcctccgatacgatactttctggccagcccaacagacacagagctcgaacatcttttgacagcccttgcataatccgtattgtgtgaatactccctctgggcagaagtatacgtcaataccatagaggaaaagatgtttaatttcgtcagaccgaaatccaagaaactgtaagacattcatattctcggaagtattgggaaattgtgctttcagtttctttctctctagcaaaaccatttgactccctttccgcttatacgactctttgttaatgtcggtgactggatggaatctattatcctcagcattgccatctttattggcgtcctccttggcactagcgttggtactttcagtggtagtagcattagtgctggagttggtgctagcagtggtagtagcactagtgttggagttggtaccttcagtggtagtagcattagtgctggagttggtactttcagtggtagtagcattagtgttggagttggtactttcagtggtagtcgcactagtcctgacgttgatgctggcagtggtagtagcattagtgctggagtcggtactttcagtggtagtagcactagtgttggagtcggtactttcggtggtagtagcactagtgttggagttggtactttcagtggtagtcgcactagtcctgacgttgatgctggcagtggtagtagcactagtcctgacgttggtgctggcagtggtagtagcattagtgctggagttggtactttcagtggtagtcgcactagtcctgacgttgatgctggcagtggtagtagcactagtcctgacgttggtgctggcagtggtagtagcattagtgctggagttggtagtcgcattggtactggcattagcactaccatgaatgcacgtgttgctgtcctcatcactgctgcaatactttctgcacctgtcactgctattgctctcctggaagctagacggtaacgcaacgatcgacatggaagctgtcgcctgtttttcagccaatctgtccattctttctatcagttccactgtgtcagcagacaggtctgtcctggagccacagcatccaacatgctggcccttttttcctttctttgattcaagtccatagaactcgcgtacctgttcggttatacagccttccttaatcggtggtaattcacccttacgattccttgccgcccaactgttttttctagataatagataacagaggcccccatctcttagtctccctacgccttgaatgagctcaataatattaagtctattatcaagcatgatcaccatcatcaattgcttaatgtcaattccttcagtcactaatttcgttccgatgagaactcgcatgctaccgtcagtgacaaactcctttgtgcgagacaccttttctgcagcacccagcttcccgtgtatccataccaccctaaaatactttctccaagagcaggccaattcttccacttcgttggttgtgcttgcaactacaatggccttcgactctggttcaatttcaaagagggctaaaagaagcttcagtgcttcttcgggctgtgattccactttcttccaaattttatgaacatgccctaaaggcacctcggatttctccttgattagattaaacatccgtgttggatagctggatagacctctgctgagatcttccgaccgtttgagctcgttgatgtccatcgacttcttggccagtcccgtaagcccaatacgctgcaacgcagcatcagctacagcctcaggtgctgtgccgctcaaaaagattgctttctcaaaagcgtcaaaatcaaggttagttatgcccccaaattgcgactgccggtagacctccgtttcaaagttgtgaaactcatctacaatgaggtaacccaattttacgttgttggtcctaaaggtgcactcaacaatattctcccacgcagctatcctgtctgtgaaattagtgctagcaagatcatcgtagatccccacgtataaatcagtaacgccatcgcaaccttcttcaataaagtttcttacaggggccacattcaagcaaccgcatcggcccaacctgatcatgcaattagcaagcaacactgtgtacggtacaaacagaaacgacacatatttcacgtcgcccttagacgccagtgctatcaaggggagatgaaataactccgtcttaccatagcccggtggggcctgtactgccacagagggtgtgtctgccatgtatatttcatgacataagcgcaactgatgcaagtccctgaattcaaaggagctgccaaagagtttctggcctgcgacgaggatatcgtttgtactcttgggctctcggggcctttttcgcgttactcttgaaattttttgatcatgatctgaactcgccgcctcacctgccactacgtcttccgcattccgagtactagagaatgaacaatggtagtcgctttcaaggcctaaccattgaatccagcgctcggaagtgagtccgtcaagcgtctttagtcgaggctccgatgaaccgttcttgttgtatcgtcgacgtatacgttgcgctgtagctctggataacggtaagcgtatcaccgtaagctcgtcaattatttttgagagccgcggtcattttgttagtatctcttctcaacttgggcagcacacatgcaaaacatcacccaatcggtcctttttgttcatcatatcgttacatatctgtgaaaagtactttatctcaatgggtttacgtgggcatagatcacgcttcagccgctctgtgtcgactttcttttcgccaggtaaacttgcttggtatgcagaaaaaatcgatagctcatctacgtgtagtaacaaaaacatgtggggtgccaaattgtacccatatctccttatggtgcttttctgaagactccttacaataggtgcgccagaaacaaagtcagtgaaagtacgcatcgtagagctgtcgttcggcctggcactcgctatttcgtgacaacgttccaggacacggaaactcaactcattatagtatcctctgttgaggtaaaaaagagaaagggtatcgtaatcctttctattgaatttcaaagtatgcacttgaaacaacgtgtagaccatcaagttgattttcttgggaataagatactttgaagggattggtccgccctggaaatctggttcgtcttcaacaaacgtcaggaacttttgtacatttttcccgaccatgacggaaacgacaattttttcaaaagaccttttcctatccattgcaccagttctgaattttaccactttgattaggccagacttttcgtcttcgtagaatgaccgcacttccgtggggatcgattcaaataaagttattgagggacaatgtaccaagtcgtttttgttatttagagccgactcaaactcgtcaaagtttgctttttcaaacttacgcctatcggaaactttcattttatttttgtaagtttcgaaattaacaatagtatgttgattgttatgctttttgacaagaaatccatcaatataaacaaaagattgtccagtttccgtcttatcatcatctaagaatgtaataattaagctactctattgagaagaagcagaatctgcgctatgcaggtgcaaatctccagcagcagcaaagaaaattcagttaataagaaatctcactaagataagcgactgtctgtcccaacatagaaaacagaaggatgtctcattcatccttgatttccggcctgcaaaaataaagtagtcggtacgtacgttcgttttcaatttccatggtgcacagtatcttaactatctgcttagtcgaggagaaccaggattctgttcgttgctcagccgcttcgtggatattctcttggatactttaaatatggacctacgcttagcctgcgcttagcctacaacttcttccgctctcgaaaagaccaatataatagaaagttataaattacatttccttattaggtatacgacctcgcgcttcgaagtagaggagccctttttggcgtacctacatatggcgcgtcagacagacaaacttcccccaaaaatgtattaccctgccgaataagaaaacagacccattcacccacgacgtatcaagttacttccttggtgcaatgtcccactataaaaaaattccttgacgctagatcgttggactaaaatctgcgtcacaatcgcctaaacaggaaatattgcctattttcgtacaaggttacttcctagatgctatatgtccctacggccttgtctaacaccatccagcatgcaatacagtgacatatatatacaccacacccacacaccacacccacaccacacccacacccacacacaccacacacccacacactctcttacatctacctttactctcgctgtcacaccttacccggctttctgaccgaaattaaaaaaaatgaaaatgaaaccctcttctttagccctacaacacttttacatagccctaagtagccctcatgtacgtctcctccaagccctgttgtctcttacccggatgttcaaccaaaagctacttactacctttattttatgtttactttttatagattgtctttttatcctactctttcccacttgtctctcgctactgccgtgcaacaaacactaaatcaaaacagtgaaatactactacatcaaaacgcatattccctagaaaaaaaaatttcttacaatatactatactacacaatacataatcactgactttcgtaacaacaatttccttcactctccaacttctctgctcgaatctctacatagtaatattatatcaaatctaccgtctggaacatcatcgctatccagctctttgtgaaccgctaccatcagcatgtacagcggtaccctcgtgttatctgcagcgagaacttcaacgtttgccaaatcaacccaatgtggtaacaaccacacctccgaaatctgctccaaaagatattccagtttctgccgaaatgttttattgtagaacagccctatcagcatcgacaggaatgccgtccaatgcggcactttagatggggtaactcccagcgcaagctgatctcgcaagtgcattcctagacttaattcatatctgctcctcaactgtcgatgatgcctgctaaactgcagcttgacgtactgcggaccctgcagtccagcgctcgtcatggaacgcaaacgctgaaaaactccaactttctcgagcgcttccacaaagaccgtatcgtcttttgcctcccattcttcccggcactttttctcgtcccagttcaaaaagtactgcagcacctctgtcttcgattcacgcaagttgctccatactttataatacaactctttgatctgccttccagacatgcggaaaacttggctcccttgcttgcctcttgtcgaatccaatacactaattgtttctcttcttctagtaatggccaggtaccaagcataatttctctgtatctgagagtagatctctcccctttttacgctaaaaaatttcaaataccctacagggtccccatgatatggctcgatgtcttccaagtattctttgtattcctcgtcatttcgcagcattctctccacagctagtgcttcccaagccatcctccgatacgatactttctggccagcccaacagacacagagcccgaacatcttttgacagcccttgcataatccgtattgtgtgaatactccctctgggcagaagtatatgtcaataccatagaggaaaagatgtttaatttcgtcagaccgaaatccaagaaactgtaagacattcatattctcggaagtattgggaaattgtgctttcagtttctttctctctagcaaaaccatttgactccctttccgcttatacgactctttgttaatgtcggtgactggatggaatctattatcctcagcattgccatctttattggcgtcctccttggcactagcgttggtactttcagtggtagtggcattagtgctggagttggtgctagcagtggtagtggcattagtgctggagttggtgctagcagtggtagtagcactagtgttggagtcggtactttcggtggtagtagcactagtgttggagtcggtactttcggtggtagtagcactagtgttggagttggtactttcagtggtagtcgcactagtcctgacgttgatgctggcagtggtagtagcactagtcctgacgttggtgctggcagtggtagtagcattagtgctggagttggtactttcagtggtagtcgcactagtcctgacgttgatgctggcagtggtagtagcactagtcctgacgttggtgctggcagtggtagtagcattagtgctggagttggtagtcgcattggtactggcattagcactaccatgaatgcacgtgttgctgtcctcatcactgctgcaatactttctgcacctgtcactgctattgctctcctggaagctagacggtaacgcaacgatcgacatggaagctgtcgcctgtttttcagccaatctgtccattctttctatcagttccactgtgtcagcagacaggtctgtcctggagccacagcatccaacatgctggcccttttttcctttctttgattcaagtccatagaactcgcgtacctgttcggttatacagccttccttaatcggtggtaattcacccttacgattccttgccgcccaactgttttttctagataatagataacagaggcccccatctcttagtctccctacgccttgaatgagctcaataatattaagtctattatcaagcatgatcaccatcatcaattgcttaatgtcaattccttcagtcactaatttcgttccgatgagaactcgcatgctaccgtcagtgacaaactcctttgtgcgagacaccttttctgcagcacccagcttcccgtgtatccataccaccctaaaatactttctccaagagcaggccaattcttccacttcgttggttgtgcttgcaactacaatggccttcgactctggttcaatttcaaagagggctaaaagaagcttcagtgcttcttcgggctgtgattccactttcttccaaattttatgaacatgccctaaaggcacctcggatttctccttgattagattaaacatccgtgttggatagctggatagacctctgctgagatcttccgaccgtttgagctcgttgatgtccatcgacttcttggccagtcccgtaagcccaatacgctgcaacgcagcatcagctacagcctcaggtgctgtgccgctcaaaaagattgctttctcaaaagcgtcaaaatcaaggttagttatgcccccaaattgcgactgccggtagacctccgtttcaaagttgtgaaactcatctacaatgaggtaacccaattttacgttgttggtcctaaaggtgcactcaacaatattctcccacgcagctatcctgtctgtgaaattagtgctagcaagatcatcgtagatccccacgtataaatcagtaacgccatcgcaaccttcttcaataaagtttcttacaggggccacattcaagcaaccgcatcggcccaacctgatcatgcaattagcaagcaacactgtgtacggtacaaacagaaacgacacatatttcacgtcgcccttagacgccagtgctatcaaggggagatgaaataactccgtcttaccatagcccggtggggcctgtactgccacagagggtgtgtctgccatgtatatttcatgacataagcgcaactgatgcaagtccctgaattcaaaggagctgccaaagagtttctggcctgcgacgaggatatcgtttgtactcttgggctctcggggcctttttcgcgttactcttgaaattttttgatcatgatctgaactcgccgcctcacctgccactacgtcttccgcattccgagtactagagaatgaacaatggtagtcgctttcaaggcctaaccattgaatccagcgctcggaagtgagtccgtcaagcgtctttagtcgaggctccgatgaaccgttcttgttgtatcgtcgacgtatacgttgcgctgtagctctggataacggtaagcgtatcaccgtaagctcgtcaattatttttgagagccgcggtcattttgttagtatctcttctcaacttgggcagcacacatgcaaaacatcacccaatcggtcctttttgttcatcatatcgttacatatctgtgaaaagtactttatctcaatgggtttacgtgggcatagatcacgcttcagccgctctgtgtcgactttcttttcgccaggtaaacttgcttggtatgcagaaaaaatcgatagctcatctacgtgtagtaacaaaaacatgtggggtgccaaattgtacccatatctccttatggtgcttttctgaagactccttacaataggtgcgccagaaacaaagtcagtgaaagtacgcatcgtagagctgtcgttcggcctggcactcgctatttcgtgacaacgttccaggacacggaaactcaactcattatagtatcctctgttgaggtaaaaaagagaaagggtatcgtaatcctttctattgaatttcaaagtatgcacttgaaacaacgtgtagaccatcaagttgattttcttgggaataagatactttgaagggattggtccgccctggaaatctggttcgtcttcaacaaacgtcaggaacttttgtacatttttcccgaccatgacggaaacgacaattttttcaaaagaccttttcctatccattgcaccagttctgaattttaccactttgattaggccagacttttcgtcttcgtagaatgaccgcacttccgtggggatcgattcaaataaagttattgagggacaatgtaccaagtcgtttttgttatttagagccgactcaaactcgtcaaagtttgctttttcaaacttacgcctatcggaaactttcattttatttttgtaagtttcgaaattaacaatagtatgttgattgttatgctttttgacaagaaatccatcaatataaacaaaagattgtccagtttccgtcttatcatcatctaagaatgtaataattaagctactctattgagaagaagcagaatctgcgctatgcaggtgcaaatctccagcagcagcaaagaaaattcagttaataagaaatctcactaagataagcgactgtctgtcccaacatagaaaacagaaggatgtctcattcatccttgatttccggcctgcaaaaataaagtagtcggtacgtacgttcgttttcaatttccatggtgcacagtatcttaactatctgcttagtcgaggagaaccaggattctgttcgttgctcagccgcttcgtggatattctcttggatactttaaatatggacctacgcttagcctgcgcttagcctacaacttcttccgctctcgaaaagaccaatataatagaaagttataaattacatttccttattaggtatacgacctcgcgcttcgaagtagaggagccctttttggcgtacctacatatggcgcgtcagacagacaaacttcccccaaaaatgtattaccctgccgaataagaaaacagacccattcacccacgacgtatcaagttacttccttggtgcaatgtcccactataaaaaaattccttgacgctagatcgttggactaaaatctgcgtcacaatcgcctaaacaggaaatattgcctattttcgtacaaggttacttcctagatgctatatgtccctacggccttgtctaacaccatccagcatgcaatacagtgacatatatatacaccacacccacacaccacacccacacacacacacccacacccacacccacacacacacacccacacacaccacacccacacaccacacccacacccacaccacacccacacacccacacccacacacccacaccacacccacacccacacacacccacacagtacctcaacacaacccctaatccaaccctgatgaacctgcctccaaacctaccctccattaccctacctctccactcgttaccctgtctcattcaaccgtaccactcccaaccaccatccatctctctacttaccactaaccaccgtccaccataaccgttaccctccaattacccatatccaactccactaccgcttaccctaccatcgacgatgtcctactcactgtactgttgttcacccaccatattgaaacgtctacaaatgatcgtaaataatacacatatacttatcctaccactctaatcccactaccacatgccatactcaccttcacttgtatactgatatggcatatgcacacggatgctacagtatataccactctcaaacttaccctactctcacattccactccatcacccatctctcaccatcagtaccaaatgcactcgcatcattatgcacggcacttgcctcagcggtttataccctgtgccatttacccataaagtccatcattatccacattttaatatctatatctcattcggcgaccccaaatattgtataactgcccttaatacatacgttataccacttttgcaccatatactaaccactcaatttatacacacttatttcaatatacccacaaaatcaccaccaaaatcacctaaacataaaaattatttatctttcaactttacgaaataaacatattgacttgaagtatgagcactaccataacgtcattaacgtaaaagttccttaatattaccatttgcttgaacggatgccatttcagaatatttctaactttcacagaccatacattagaataatatgccacctcactgtcgtaacactctatattcaccgagaaacaatacggtagtggctcaaactcatgccggcgctatgataaaattgtatcctatttccattcccatatgctaaccgcaatatcctaaaaggataactgatgcatctttaatcttgtatgtgacactactcatacgaagagactatatctaaagaagacgatacggtgataggtttgttgtttttgtaggagtcaacgaaacgccaaataattctacggtaatataacttatcagcgccgtatactaaaacggacgttacgatattgtctcacttcatcttaccaccctctatcttattgttgataaaacactaacccctcagctttatttctagttacagttacacaaaaactatcgcaacccagaaattttgatattttaagtgtcaaaaatgagggtctctaaatgagagtctggtaccatgacttgtaactcgcactgccctgatctgcaatcttgttcttagaagtgacgcatattctatacggcccgacgcgacgcgccaaaaaatgaaaaaagaagcagcgactcatttttatggaaggacaaagtgctgcgaagtcatacgcttccaatttcattgttgtttattgggcatactctgttagctttatttccgtccacgctttttctacaatagtgtaaaagtttctttcttatgtttatcgtattcatgaaatacttcacgaacaccgtcattgatcaaataggtctataatattaatatacatttatataatcaacggtatttatatcatcaaaaaaagtagtttcttattttattttttcattacttttcactgtctatggattttcattcgtaaaggcatcactccctagtttgcgatagtgtagataccgtccttggatagagccttggagatagctggctttaatctggtggagtaccatgggacaccggttatcattctggtcacttggtctggggcaataccagtcaacatggtggtgaagtcaccgtagttgaaaacggcttcagcaacttcgactgggtaggtttcagttgggtgggcggcttggaacatgtagtattgggccaagtgagctctgatatcagagacgtagacacccaattcaaccaagttgactctttcgtcagattgagctagagtggtggttgcggaagcagtagcagcgatggcggcaacaccagcagcgattgaagttaatttgaccattgtatttgttttgtttgttagtgctgatgtaatcttaacaagaaatagtgaaatgaaagcgcatacctcaaaggcatatagttgaagcagctctatttatacccgttcctccatctgtcatcactacttaaacgattcgttaacagacgctcatttagcacctcacatattctccatatctcatctttcacacaatctcattatctctatggagatgctcttgtttctgaacgaatcgtacatctttcataggtttcgtatgtggagtattgttttatggcactcatgtgtattcgtatgcgcagaatgtgggaatgccaattataggggtgccggggtgccttgaaaaacccttttgcgcgcgcctgtgacatttcctttttcggtcaaaaagaatatccgaattttagatttggaccctcgtacagaagcttattgttaaagcccatactcagtctgttctaaacggcttccatggaagaaaaataactatattatagctttcctaaaagtttaattaagaatagcagacatgtgttgggagtcgtatattgttagaatctgtagttttaggtgttctcagtaaattcattgaaacaattgcgtacttgtaggcttctgagaagcagatagtagtcaaatagttgatatctaaagagctgccgaagggggtttctgtatccgcgtaagtaattttttgaaattttaatgtgatttttggcggaatggtgtgagtggttcacttctcatcttcaatttcatcgtcttatatttcgataataaaacaatacagtgagcgttgttattaagtaaatcataggcacttggtatcatataattcaaaatcaagtagttgtagtagtgcgtgtgtgcgtgttagtaattgttgatggcctagttcatctccttattgaaaaatgataaacaggtggcagtttcaattgtagtaaatatttattcatttttttattattgctaacgtatctgaaggctacgatgtaacgcagctcatctcttttaaacataaaagtcatttgtgtaatgtagagatttacaaagattttaaaaaaataacaaaactatacaaaactatctatatttgaatacttcctactatttttttttttttaactataatgaatgaatgcatgccatattgacttacgtaacaaggtggcctattggtaatatattacatatcatcatcctatatgtgtagcataatttgtccattctttatccgcattcaggcactcccaatctttatctctaaggcaaagagcaaccaccatttcacctctggaggatctaggcataaaatatattaggctctcaagggaaatgaagcgcggccgtcgtacactcttgggcttcccaagccctagattgaaatcaacgtcatacaggctgacttttgcccacgaactgaccataattccagataaagtatcaattggttgaggtatagaaaccttagtcttgtccgggcatcggctaaggagcgtagcaagtgcgcatgtattataggccaaatcgaagactttagggtctagcttcctgcgaatctgtgatgcaagaacgcccaaacttttatgatccaagcttttcagggaacctgtattaaaggtcatgttgactaataaccctggatacgtttcggggagtcctagccgttttctaacatccacagcacgccctaaatttgatttcgtttctggtttaagtcgagataaacgggctcgagaaactgatttccagatgaaagcagtgacgatatcatcagtggagacaaattttgtgccagaagtacatgtctgcattgccaaaatcctcagattctgcaatgagatagcagaaaattcaacataagcccaagtagagttcgaagaacaagactgttccttttcctctccacttgtatttctagaggtttccactatttcatgaactagcgtggtgtcgggttcccaagtttcatcaaacaaaggaatagatttgcttttatctatatttccaatgagcagttcttcatcagagaaaggtttttggtggcaagatttattgagcaagttgatgatactttcctgtcctgttatatccataatattgtgctgcccgacaatagttaagacgaggccgccggagataaagtttgcttgaactgcaaatacaggcccactcttggcggccatacctatagtgtttccaggtggattgatagtcatgcaaggcgcaaaagtcttttcgtctaacatgtagataggaaagtcagctttttcaagcgaatccattgttggggcagacagatcttctcgaagatcttggacgataagtggaattttgtctgacgggacaattctgtaggtaccagtgttaccttcgtcagcaccttcatttacgacatttcctgctagccactggaaatttttagccaatgtttcaagtcctcttgttaaggtatttacgatatggtcatgagcagaaggatctggtacacggtagatagagcatatttgagtgtatagtttgtatagcgaaggttgttgtcccaaaatatcaagttgatcgttttctagcatctgtacactttttgtacgtttctgagagatgatcttgactctaaacatccatctaccttcaaagtgaaatttatagtcacgtccgtcattatgcacgtcttaaacattaaaatcttgataaatacactgtaaaagctttaacgttattggaatagaaactctcatcactcagagaccatcagttacctgcaaaacgtttcatatttgtatataaaccatgagattaagtggtctgaaattatgtatcattttttgcattctagcatgccacagcaagggggtacacgtattttttgatggtgaataagatagaaatgcataccgtgatacttcaagctggcactatctttatatcttcctccgtatatagcacttgaagctctgtatctagaatatcctctttagtccgggacgtgcctccaaatacttacggattggcgaaaaatatgcactgaaatgtgtgcaaattaaccaaaatagggcaggcagtaaaaagttctaatgatttttctatttgatcaagataaaataaccttctgctgaggaccgcacattgacgtatatacactgcttttagttttgtagatacaagatatttgttaaaagaaattgaattaggagtatttatctacagctgatgcaatttcggcgatatctttaggagacgttctacaacaaccgccaataatgcgcgcaccattatcaacgaatttcttaaccgtggtctcccagtcatccaacttattagtcggccggtgccatgtcttctctttgggattgtagatttctccactgtttgggtaaactagcagaggcatgccaggtagatgctcgtgcaacattttaagaattaatgccgattgattgaaactgacacagttaactcccattaataagagattcttgttaattttatttccgaggccttttatatggacagaaatttcttccaaagtggtaccgtctcgtagcaaactattgtcatccaccgacaacccaatataaaagggcttcgaaataatatcttcatcccaggataaaatagcctttaactcatgaaaatttggaatcgtttcaaaaccaataagatcaatatctctattttggttgaagttctccagctggggtttgaaaaagccgtagtaatcaatattctcaggatggggaccatagtcaccagtatattcacaggatacatgtgctgcccatgggccaatactcccgattaagtacctttcctcaccaataaattcacgagtaaatgacacgattttatcgagaaaacgcttgtaagcagccagagttttaatcgaggtattctcagatatgctttgaaagtttgcctggtaagtaattgtcattaatatgtttgcgccagcaatcataaagtctctgtacatttcttctaccacctttcgctcttgagaagatggctcccaaaaggattcgctcgtaaaaggagctgcagaccataccggactatttatgttaatgcctctgttttccaattctgtaccctgtccaccatcaaggataagaacttttccggggtgctcaactattagttctttgattggaatgcgcttcatctgttttttgattactttttcaagttgcacactaaaagttgctgattcagatttcttctacaacttgtctgtttaaattatcttccttagtagtacattttcaaattggcgttgttgctgttttgctattaccattgaatacctcgccacaatttggtagtactttcatgccacagtttttacttttccacagttcctgcaggaatggctttttttcattaactttttgcggggatagcgaagagatgccaggaaataaatgcgtatatattttacagatttgggtggttaagtaatcaccgtcaagagttctccatcaggataccatgaaagatacccgaaatggatgaatttgaatctaccaaactttcgaaggttcagttttccactagcgtgttaagtacgccttcgaatgaaggaaataatctaatacacagattcaagaactctttcaagcgaaatgattcaccagcgatccaagaaggtttgctgtattcggagctttcagaggaagaaaaaatacaatgggacttagccaaccagccgtataaaaaggtcctagatcaaagacacctgaccatgatagccattggaggtactctagggacgggtcttttcattggtttaggggaatcactagcgtccggacctgcttctttgctaattggtttcttgttggtcggcgcatctatgctctgtgttgttcagtgtggggccgaactttcatgtcagtaccctgtttccggctcctatgcgctgcacgccagtagatttatagacccatcagtcggcttcagtataggaattaactacttattgatgtggctcatatcttaccctagcgagctggtaggatgttcgcttaccatctcttattgggcaccatcggtcaatcctgctgcctgggttgcaatcgcgttcgttttaagcatgctattgaatctttttggggcaagaggctttgcagaatcagagttttatatgtcaattttcaaaattgtggctctattcatttttataattattggtattgttctcattgcaggtggtgggcctgattctactggatacatcggcacgaagtattggcacgatccaggctccttcgctgttcctgttttcaaaaacctctgcaatacttttgtttcggcagcatactcctttagtggtacagaaatggttgttttaaccagcactgaagcaaggagtgtttcctcagtctctcgggcagcgaaaggtacgttctggagaattatcatcttttatattgttacagtgattataattggttgcctggtcccttataatgatcctcgtctgattagcggttcatccagtgaggatattactgcttccccgtttgttattgccttgagcaatactggtgctatgggaacaagagtgtctcattttatgaatgcggtcatcttgatagccgtattttctgtttgcaattcctgcgtttacgcatcctctagattgattcagggtttggcgacagcaggccaacttccaaagatctgcgcttacatggacaggaatggtcggcctttagttggcatggctatatgtggcgcttttggattgttaggctttttggttgtttccaagaaccagggtacagttttcacatggttgtttgcgttgtgttccatttcatttttcacaacttggttctgtatttgcttctgtcaagtcagatttaggatggcaatgaaagctcaaggaaggtcaaaggatgacattatctatagatcgacattagggatatacggaggaattttcggctgtatcttaaatgttctattggtaattggagaaatatatgtatcggctgcacccgtgggtagtcccagttctgctgctaatttctttgaatattgtatgagtattcccataatgattgctgtatatattggccatagaatttaccgcagagactggagacactggtacatcaagcggatggatattgacctcgatagcggacattcgttagaggacttcgaagccaccaagcttgagagggatgaggataagaaatacgtttcctctaagccactttactataggatctatcggtttttctgttaacttagtgaagtacttcatttgaatattaattaataataattttatgagccgggaattttgcatctatattctaggtttctagcaaccgtagttttacgtaagatgtatttttttttgaatattccgttttagaatgatattctaggccctgtatattctccaataacagcggcacgtccaggttctgtgacaatgctaatatattccttttttttttttttttaacttagtatacgctgtattggaatcagtgatttcatctaagtttactaacgcttacacaattgtggaagaagaggatagaaacacctcagatccccttgttacggtaaaacccctattctatgcctcagtaataactagaaatagccgattatcattatgttaagcctgtcgatacgcattacagttcaaaaaaaaggcggacatcgtggttgatatttgtttgaggccttaaattttattgtattacatgtataaatagctaacaacatttgttcagttggtaccaatcacctttgttgctgggtatccgcacacattaacaagacaatggaaaagggagaaaactaacaatcttaaacgataaaaccggacgaaataacagctgttatttttcatgctagaactaatggcttgatagtatacttgtaccttgtatcttagtgcttgaacggatgattcccgtcgccccacacctatgcatacaagacgtcaatcttcctgtgattatattttgagtatggcgtagtaatcccatatttctcgttgggtggtgctgatatttgaaaattcatgacctgttctacatacggctgccattggtaggaccgcaatcacagtgtaattttgaagaacttacattgggccaatggatgagctgtgaccataatttattagttgtttgtgtcacaagctcagacttagaagttctctattgcaaacattatttcatgtttccttaaattttttttattgcaccaactttagtgaccccttgtgagctccaacatatttgaaatcttcttaaatttctagtcggcaagcagcaaagaatttcagtagtaatctctaccgcggcaatatcgatgcaaatgtaactacctgtaaggatattgtcttcagtggtttggtatggttttgtaccttactcaacatcacgaataaaaaggaaggaatacgaatcatgatattgatgtttaatctttcaccgtcaaacaattaacatatatagtatatatattcttttatagaatactgcttgagctatttttttacttgacagaatggcgccgcgaagaacccctaaattttgtagccctaatttcgatcagttatatatagctatggcaccctcttgaatagcttcatgattggatctttttatatagtttccacgtaccacgcaaaacttgtctcaagtagccactttacgaggattttgaacggatttctagcagtttcttcacgctggggcgctgttgcattctcttataccaagctcgaagcgcctcgcactcttccggcacttgtagttttacaattgcagcaaatattagaccagctattactgtgatgtcagccattgagaatgaatcaccagcaacatatgggcgttctctgagaacggtatcaaaataatgcattccatgtagggctttgtcgcgctggcgaagtccccactctttgttttggtaaagctcgacttcaggccccaatccaggtgtagcatggtgaaaataaacactaacagggtcgagcagttccaactctgcgcgtttgttcatcatgtggattacgcctttttccagcggtgttttgccggtaagagtgggtgtaccatcaagtgcatcaatgtattcagtaatggctgtgcattcagcgattaaagtcccgtcatcaagttcaagcactggcactgtgcctgaatagttcttggcaagaaattcaggcttcttgtgctctcccttccagaggttgatcctcacaaattgcacacttgatagcatgttcttctcagccaaggcaatgcggactcgggccggataaggccctgcgggtgtgtcatatattatcattttttgtttcatcttttcacctccattgtaaatcaggaaacctctgccattcatgtatcctttgtaggtactttatatagagcaccaagtttctatcctttagcaggaagcacattattaatcatttgagacgtaaacgaatgaattagtaagcagtgaaagaaattcgagcactaagcgcgacctaagggaacggacacggaacggagaaactgaagtatcaaatacttccatttgatcaaaccacttgtatccactccctgttttgcacacggtagtagaaggtcttttgaatatttactgtaaataccgatttctatgtccttcttgtccgattataggattcgggtcatttccagcgcctactttccttcttgatttcaaaatgtgtggttaacgtactcccaattgcactactgttcctacagttcacgcgcacctctttctgatgaaaatgcagctgcattaatctgcgatctattggcatctcgctcttgtatctgccctccattcgtgaaattttactctattaccatctttgatcatttttttgtcgcaaatgtgatacggcatccatcgaattttgctcgtaattgtttgccattatcgcccttttcattccgtattattcatccactccgcttcataatgggttccaaaaaaagaactattgtacgagcttttagactcacgaaaacattacttgaacaataattagcgcctgcagaacttgacataataaaattccattttcgatatctagctgtctgaagatatgatatctaagtaatacgggaaagtttccgctattattctctgttgcaagctcacgtgaaaatgtggattcgcgagtggggtgtaagtgaggattgccaagccttttgttcgaaaacttctgcaggaagcgttgtgttgcaaggatgatgcagcatgaaatatgtgttttctttttttcgaggttcactcctacaggtgattccttcgagaaattctgcaacccattgtgatatgatgcctggccgaaagatttcttcatttcttcggagcaggttcggcccgaaatcctcatgatcgagccgaatgccaagaagtaaaacaccaggatgactaaccagttattatcatgtgtatacagtactttggtacctttatcaagaagtatactaaaatataccaacaccacacacatgcacatggtagctgagcgaacagtttcgagatttcagcattaatttcatctaataagactttccgtctgctttcaagatcaacgtgctgaacatttttactctgctttcataatactcccattttaggctttgattcaaaagcccactcaatgcaatacctaaaatgatatccttcaaagatatgtttaatgaatatgcagccacagctttgaattcagattgaccttgtgttgcattaagtcagacacctctagatttgtgtggctgctctcaagaaaggatgttgaagaagatttatttacggaagaaataactgtatacggcattttattctttcttaaacgagcaaattaaagaatagacggatagagactggagctttagcatgtgttccgagaagtccttgacacgcgccacggttgttatgccgcacactacaatgatgtgtttgaaaaagtatattaatgcctattgtcaagatgcaattcatcaattccagcattgagtgattcttctctggtgcggtaaaacataaattttaaatctagtactcaaccaccactgaacaactattaatcatcgtggaaattattatgacggaaattgaatttgggcaaccccttcccagcaatctagactatgctgtttcttttggcattcctacatgggattcggcaataggctatgcggaaaaggtgccagaggtaataggcaaaatggctacaggatatccgaggtactttcctcaaccccccgtccagaggctttgtgcttactttgttaagaaatttgggcgaggttcagaaaactgtcgtccttttccatccgttaacctgggtttaaagtgtttcgagtacgtaaaatctgtctcaggacctgaaagtaaagctcaccttgaagtggaaacagttacgattaaaaaccgtggggcaaaaacgtcgaaagaaccggcggaattggtgctaaccattgctgctgtccttgcatcggaggaagagttcgagactgtgaaagagtattggaaattaagaggtgaatgtgtatctagtcgattggcgttgtctgtcaaccaacttcttgactgcgctaatcatggctcagagcaggtattgcgtgagctagaggctggtgtttttgcagcaaagaagggggaggagaaagcaaagaacctgataaagggaaggatagttgagaatcgcttcaggccctttggtttggagaagaaaaccccgaattgggagggactcaacctcaacccaaatgaagacgtttatcttgtatcaagtggcatgtctgcaatatctacggctcgtaatttactcaccttttgggaggagaagaagaattcaggagattcattaaacaagaccacctctgaccaaaagaaaaagccattattatgtgacactgttggcatcttcggcttccctttcaaagatacgcaggtcattatgactaaatttggaaaatgtaaattttttggatttggaaattctagagacgttgtcgaattacaaaagtttttagaaacaagcaaacaacgcattcttgccgttttcgtcgagacaccttcaaatcctctgctgaatatgccggatttgaaaaaattgaggagtttggccgaccagtatggcttttttattgtaattgatgatactattgggggccttaacgttgacatcttgccctatgctgatatagtcagcacgtccctgactaagcttttcaatggtgctagtaatgtaatgggcggctctgtcgttttaaatccgaaatcatctctgtatccatatgctcgtgagtacttcaggagcgctaatttcgaggatttgttatggtgtgaagatgcgatagttttagaacgtaattccagggattttgaagatagaactttacgtgctaatgcaaacacaggaatattgttgaatgatttgcttttacccgaggaggggaaaatatgcaaaaagatttattatccaactgttacttctaaggagacctttgagaactacgaaagtgtacgtaatgaacgtggtggctatggatgcttgttctctgtagcctttttcaatgagggcgatgcaaaagcattctatgactctttaaaggtattcaagggaccttctaatggtactaactttaccttagcatgtccatatgtccatctggcgcaccactcagaattagaagaagtttccaagtttggggccgaccccaacattattagagtaagcgtaggtttagaagatatccagtggttattgaaagttttttcaagtgctttagatgttgtgaaaagcagaggctccaaacactcatgaagcagatcatgagtagaatatcaaaaatcaagaattctttataatctttatagaatattgtttataaaagtttttttccattctagcatataatttttttggaggaagtcttttctggaaccttcacatggatcttaattaatgaaagtagacagagctcataagatcactagttgtttataaactgaagatgttccttcttattgacttcaacattatatcgctctgaattagttgatctgtaacttcagagtttctttaccagaataaaagcgtcacagtttttctttagtttatatgtacacaggttggggtttactataaactataaaaaagaagtgttgtcgccgctattttaaggtttatacacaattttaaccaaaaaaaagaataagttgagcaacgttggaactgcctctgcaacgaattccggctatatacaacctgcatctttgaaattcaaatatccaaagttaatgaagaaggataataattttcatcattcaaaaactttagatcttccacgggcctttccgcttgtggagtaatcctgaacgcatgtctgtgaattggttcttcccaatcaatcactgctgaatgttgaactctgcggttatcccaaatgacgacggaatgaggttcccatttggctcttaactgtaaatcatggctgctctccactagattgtacaagaaattcaaaagtgattcagattcttgtcttttcaattcgactattttcctagaaaatgcacgattgacatacaagcatttctttttcaagacaggatgaactctgaccagtggatgaatatgcgtgacaggtgctcttctttttatgccgccctggcgctgtgaattctctgcctgttcctttgagctatggatgacatgaagcgtgctcaagaaatcttgcaaaggcttcgacaacctgtcgaaagcctcgatcgtatccgcaaataacgtatctccaccaccatcaggaccttcaacaacactaaagaaagtataagaaggtggctgtaactcgtaagagacgtctgtgtgccagccaccagatgatgtcgagtcatcaaaaactcttgcaaattcttccgcatcaggtcttcggaaagtgatatgcagctcaggattgttttgagggtggccactagtttgatgaatgtgcaacttgccaaaatgtcttccgtattcagtcacataatcgggtccctcgtcagcaaaattctgatttctaaagacaactactcccttttgggcgacaagcaaagcgagttcatcttttgcagcatcagaaagatcagttagctggatcccattgatctcgagacctaatttcggggtgatcttcttcacctttagttgaccaacgttttcttttgcaaaaaggtttgaaaagttaccgtcagctctcaaagcaggatcatggtattcgtgaaattccagcgggccatacttttcagtaggatcccatgtaggcaaataatctggatacttcgatttctctctataagatttacggattttcaataaaccagatggagagacctcatcttggccatcataaaaatgggtatcaaaattcccgtaaccttgcttggaggtataattcaggtttttcaacccatttgtaatgattttgactggtaaatcggtagatggaagagggattgctgtttgagctgctgcaggagacatattttaactgggttactgtgctatgtttgtacaagtatgaaagggccgattatacagcaatagtacacctttttatatgtttctgtcatcaagaactgttactgactccttaacttttccagcattcttgttgtattgcctacataccttctttatgttagtagtatgataaataaactccatgtgccctgtggcgccaaataagaaatcgactcaagccacattgaggcttttgtcatcattcccctatatactaatatagcacctttccaagggccaagagctcgtccaatgagacgcatgagttgggtattttaagctgcacagtagactatatagataaagctaactagtatgtaaaaaacgttacatgctatggcgctcttagaaaaaacgcataatataagcttcaagtcagtttaagctatagttcgcacggatatcttcaagaagaccgatttgttgtggctgccatcccagctcttttctggtaccttcgcttgaaactgggccatctctagtgacaaaacaagtgaggaagccaaaatgactttccgcgtcatcaacagggatagaggccacgggaacattcaaaatttctccaatcacacgcgcaatatctttgaatggtataccttgttcaccaacgcaatgatacacttgtcctgtttttcctttctctaaaacaagtctgaacagaggagccgtatccaaacgatgtacagccgcccaagcgtttgtgccttgtccgacatagccagattttccggcagctttggcaatattcattaatattggtacaaaagccttgtcccccttgccatgaaccgagaatgggagtctgacaattcttgctgaaacacctttgtctttgtaactcaaggcaacctgttcagtgacagcacgcaaaattttggaatcttcatcaataccatcctgttcgttagcaactttgtttggtcgcaaagaaagtgtaccattcgtatataagaaaggcttgttagaacctttaagtgactctagcatagctacagtggcctgacggtcaatttcgcagcactgttcaaaatttttaaaatcatgcacaaatcctaaatgaataacgccatcagattcagtggcaccttttttcaaaatttccagatccttgagatcaccgcgaaggatttttgcagcaggatcaatcgacttaatctttgcagcagcctcgtctgaccttgccaagccaacaacttcatgacccgaggatattagttcagataatacggcagaaccaatgaagccagaagcaccagttataaatactttcattttttgatctcttttttattttcttttgtaaaagttgagttatcacgccttagcgcttatgaatacaagagtgattgtaagcatagttgatagaagcgggagccgttatttatacgttagttgagtacttgagggtcttcatcgcctactttttttccttaatatccttgtgttagtaatcatatcttcaggaaagccaagaactaatggcaaattaaatccgcggctttccctttaaactttttccagcacaatctattatgttgagaagttccgctaatttccgcattggaaaaagaatctcatctgcaaaaacgatggtttctttcttccacggaagacttatgtccgtcctctctattttcatattgttctttctctctctttttgcataacgtcacaataccctagtgctaccgtcattggcgcagcataagagtattgcatttcatgtcttcagattttgcctcgcgaaagagaaaacactaagaggtgaaaaacaataaaattatgttccagtgtgtcatacgtgaggttttatcacggggccaccgttctcattggttacttggttgtaaatgctttgcgttgtgataaatatatggcatgaaaaatcatatgacttcaaaaatgaacagattccagatgccaagcccgctttccttcggctaactagatgcgcgctcgcccttgaaatccttaatcagcacaactcaattgtatggacgtgagctctgacttttgcttccgacaattaggcctttcatatctgtccttctgagatgttatgtatcatgcattttgtatacactatgcaacacccttcgcaatggcgaaagcggaaagtcatggcaccatcaatcgtgctctgaccagtatgtaaaaaatttcttaagcctcaccatgttacagattggccagagcatctggatattcaccacacctgattgggaagactcatagttttatgaaagatttcttcagaaaaaatgacatgctgattttgtctacttgcgtgtgctttcagttctttaccagtacgatttggtcacgtgacacgcgatcaactacattcaatccatctgccccttgctggttccgagtatcaattctaaattgtggctaccactatagcaatagtacgccaagctcggatgcaaatcacggatatcttcttagcatccgagttcaacatccgagttcagcatccgagctttgcggcgaaaacttaacaagataacggataatcaaagttctctgtgatgttacggagtctttggtctgcgctgctgactaaaatagtgtgacacaacgtacatagcgccacccatattggccgataaggaccagacttgtggcgatgactgttaactctccgcgaatctttttcgaagtcgcaggtggcattgcagaaacaaaaatgtgtggcttctgaaaaaaaaaataggcaccccatttgatgtaagacatctggctaccccttgtacatttcagtcactgagcatcgaaggcacgtctttgcagcatgcaatagtgttcgaagttcttccatttacggtggctcccctcactggaacggtgatgtaatatgtagatagctaaaacatttcgcaggtccctaggaactggacgtcaagatgaataggtattgttaaaaatgcgtacctgttgaattgaagaggtcggaaaaatcaaagtacttaaacagacgattgattcgacatttagctattcaggttgcacttcttgaaggttgaacaaaacatcaagagaaaataaaaaagaaaatataacaaaaaagaaatgtcaaaagttgacgtaaaaattggagcagactcgatctcctcttctgatgaaatcctagttccttcgagactcgctgatgttacgctagcattcatggaggagaatgacgcagcagttccagaaatcacgcctgaacaagaaaaaaaattaaagagaaagctttttctcacaatattcacctttgtctctgccattaaccttttactttacatggacaaagccactttatcctatgattcgattctaggcttctttgaagatacaggtcttacccaaaatacttacaatactgtaaatacgctgttttacgttggttttgcaatcggccaatttcctggacaatacttggctcaaaagttaccacttgggaaattcttgggtgggttgttggccacatggactatacttattttcctaagttgtaccgcatacaacttttccggtgtcgttgcgttgagatttttcttggggctaacagagagtgttgttatcccgatattaattaccactatgggtatgttcttcgatgcttcagaaagagctgctgctcagccatttttctttgcagcatgtatggggtctccaattccaactgggtttattgcttatggtgttcttcatataacaaatcccagcatttcgttatggaaaatattcactatcatcattggtggtttgacttttatcatgacggttgttgtaattctgtggtttcctaataatcctgctgatgtgaaattcttttcaatacaagaaagggtatggattatcaggagagttcaggcatccacaggctcttccattgaacaaaaagtcttcaaaaagagtcaattcagagaggcaatgaaagattatataacctggttatttggattgttttttcttcttcaacagttagccaacaatctgccctatcaacagaacctgctatttgaaggaatgggtggagttgatgctctaggttcgacattggtatcagttgccggtgctggtttcgccgtcgtttgtgccttcatcgctacgttgatgttagcaaaatggaaaaatatttcagctttaacagccatcttttggactttaccagcattggtgggatccatcgctgcagctgctttaccatgggacaataagattggtatcttagcaaatatctgtatggcaggacaaatatttggtattccttttattatagctcttagctgggcaagttcaagtgcatctgggtacaccaaaaaactcacaagaagttcggtgtccttatttgcgatgggaattgctaatatcatatcaccacaaatatggagagagaaggactctcctcgctttttacctgcctggattgttcaaatcgttttatcattctctcttgcaccagccattttgttactgatccatttcatactaaaaagaaggaataatcaaagactaaaaaattatgacgaaaatttacaaaattatttggacagaattcaactcattgaaagcgaaaatccttcttccattgaagaagggaaagtggtaacccacgagaacaatttggcagtctttgatttgactgatttagaaaacgaaacttttatatatcctttgtaaatattgatgttttgttgtgtaaatgttctatctgacacttaataattagaaaattaattttttaaactttccggctgcaagaaagaggaactgtgtctctttgaaaggcacaatttcccaaagaatcatttacaatggtaaatagcttactgcttagaaaataatagataattgaataaatttatagaggaatttcttgacaatttcttcaaaacagccggtaaaagtccattaaagattagtttttcttaaataaatcacctaaactttcaaatttagcataaaaaacatgtagatatttgttctctgtactttataatctaacattttataagacagagactagtaacccctctagcctgtggttaaaatacgcaaaacctttgaaccctcaatatttttgccataataatgacaactatattgtacccatttgttcttgagttgtccgtatggatggaaagcagcactcgagtttgctgaaattacatacctcggtatgcaatatgcccagaaaatttgtaaatgataatttacataacaattcaaaacatattgatgtttttcgtgggtaaccatagttcttggaatgtcaactgagggtatttgcacttcaaaaaaaaaaatttattaaatgagactatatacagtgagcacaacctgtctaatacaacggcaaaaattatatacattggtagattttcaaaattgaactctttgtgctaaagaattgtcacaacagtttaaaaaatagtttgaattcttcaaattgaccccatattaataagacctgatgcgattccggtctcacccagattagagagggaatttaattttcttaggaccgtagctaccaaaaatctttgtgtggtattgattatatgatcgtgcttgcgaaaaaaatagaagactaaaagtagcattagtttactaactttctcctcgtatctttcaaatttgtattcccctcaaaagttactcaggttagggaaaattccaagtagcttatcaagatcaattgccattagttgattcaaggcttcattgtcataattcatgaggtcaatttcactctgtaaagattcgtcaacatcttcagtgaagtttctggaaaattcttgtgcggaaatgagtttttctaattcttccaaaatctccaaatcaagacttcccaagaattgtggattgtttaattttgtgtgaacgaaaaggacttatcccttcccataccccattttaaaccgacaatcctatggattcttgaatatctttcatccataacggcgtcactcttccagtagtcggatataaacgcagacagcgcgtcagtatccaccaaataaatgatatacctgaaaatagagacagaaatgaacgaaccgagataactcttttccagtttcgagataacaatttctacaagtaatttcatatgatatgacatcaacttgatcattttttcaatgactcgactaagtcttccgtttctatcattcaacattcccatggctgcagaggatctgtcgcatgtatccttcttataaaataatctcacgagcaaggtggcctggaatatgagtaatcgatgtatcgaaaagcgaacaactttctgagtggcaaacccaaaaggttcccgtaaatgcagaagagatccattaaagtattccgagattaattttagcaacgttaaataatcttgtatagcggtaaaagtaaagcggtgataatatgttttgtactccaaagcgtttttgaaacattgattttcaaaatgcaaagataagctatcatagatgttcattgtacaagtgtagctaatcacattagctatgaatgtttcattttcctcaaaagtgctaaagtcaaaagattcttcatttgctaaggaagagggaacattgatatgtaagctcttcatccttggttctccaagagaacttaaaatgagagggaatttctgatttaaaaaatcttttgtcttgtcgatgttatccaatacttccttcaagtaggaagggccatttattggaaaacaagaagtcagtaatacctgtaaagataaatgtaaatgatagatattctctgctgtagccatcaacgataagtctagattattagtagaagcgtaatttctctcaaatagttctggtagagattcgtcagttttcataaaggatcttaaatattccaaacttagaatgtcagaatctccttctggaatcaatattccaaacttcaaaaattgcacgccaagccataatttccttcttaaattgaataatcttggataatcgtccgattcgctgacgtatcgagtgtattggaagggttcttcattcagtcctagctttattgctacattctccaaaaattttaggtttagtatgtcactgtgagtaggatacatgtcagcttgatctggattcaaataccgcaatatgaaaaaatagagcagacaacaaagtgtatgttcattaacatattgaaaaacgttcatgagagcaagaagtttatgagcgagtagcgttaaattattcgattttacaccaaaagattctttaaatgaatgactagtacttagactcaaacgtctgtaagaaaaagccaatatgatagttagcagtgttattgtctccagttttcttctagagtctttgcccgcaaatacaatgttatacccattaaattcattcaattgcaacagctcccttatgttatcttcgaataatgatatttccagtaacggatagaccggatatattgttttgtaaaagtccacgattaagccatcaacctcattcttattgaggaaatatttggataactcttccaaaaggatgtttatggaaattttatcattattttcttcaggatgcgcttgttcataatcatacgtgttatacagaaaatctattggaggatacaatttgcttgtttttgaggtattttcaataaatttaagtgcagctttatcaataaaaaacaaaggtccaatatcaccgattgttaagttaagttctctttttttattgttggcagaaacgttttcacgatggcgttcgacatcaatcagtatcctctcatgtatgcaggtggtcaaggccttcgcatacaaatcatgttgaagaatgctatggaaggcaaaaggactatcaacgatggttgtgttattcattacaacaagcttgtcgtgtgcattcgataaattcatggcaaaatttttcatttcccagtctttagtacttggattaagtatggaagtaaaggaaccacttgcggacatcgatgcaggagtaatgtttctaatgtctctatgtggggcattttcgatagtgggagatttgttaatccgtcctggttccacttcgtagctacaaatcgaggatgaggccttgcatttggagcaagtaggccaaagtttatcacatttgattttcctttgcttacaccgcaagcaaacaaacgatggcttaacctttttctgagatgcaatgctcatatccagtgcagtacacttatcttgtcatagatttctgatgggtaaataattacttcacatcatctttgtttccaaagtttggcctcaatgttgcctttaggaggaaaaaatgtgaagaatgcatacttctgccgcttacgtaaaaacagaactctgaccagaagagataaaaacaaaaaaaaaataaaggacagtaaatatgaaaaataagatattattatattaaattaaattaaattaaattaaactacgatgggagcgttatgccaaaaaagataaaattctgagcagactactctcagtcttccttcttttgacctgccgccttttcggcattaacgtatgtagtgtaatcaaggatttgtaataattgccacactgaccaggctaagaaggcacccaaaagtgggctaatccagtagatccagtggtaatgagggaaatatctggcagcaacggcggcacccagagatcttgcagggttgacaccggtaccagtgtaaccggtcaaagccatgtgagccatgaataaagaaataccaattggaagcgcagccataaagttagtttcacgtttttcaacagcagtcatcaaaactgttaaacacaacacagcagtaccaaacatttccaaaaacaaccccctagatctggaacagcctaaacccaaagcattagtaaagagaaccttgcctggagtcatagcactagcggcaccaccagcagccatcccagcaatgatctgaggaaaccacatcactacacatctggctggtgagatggctctggccaaacacaaagagagagaaacggctgggttcaaagccccaccagaaacaccagatagaaaacatcacagagaaaccgaaaccaagggcaatcatgatcaattgacctggatgagagccctcaggctcggttgtcaaagccacatcatggttagcgacattacaaatgacgtaagcacaccataaaaacatgaaggtaccgcaaaactcacccacagcagcgataaagtggtttcttaaggtatctctgtcaatattaaaacgcgaatgcttcgtttccggctgttcaggtggaatataagcattgtcaacaccggtcgggtccaagtgcgaaatgtttttttcaaggtcgttagattcgttagacatagtataactaaggtaggctagtgtcgcttttgaatattttcaggaattgtaatagccaggaacaagaaaaaagacatgcgcacactaataagctactaaaaccaacatatttatactatcaaccgagagaggggcagatatgattcacgataaaaagttaataaaaggataacagcggcgctctaattcgttaatgaaagccatagtccggtatggacaaaaactatttccttcttttttttttttaggtttttttttaatttgcacttgcaataatctaattcactgtaggagtttaaagaaaaacatctagaaggattggaggaggtaagtcattattatggcggtgctcttttagcgggaaaaaaaaaaatacacctacgacgttaaaacagatcgtgctgtcgtctcagcggcagtaaaagtactgtagtagttacggtgcacgcagatgcaatgctaattaaataatcatgctcccatttttaagaagcagaaaaaggccgcagtaatttgagccgtgaaaagatttcggagggttgattcttaacattttccaaaaaaatgtcctttggtctgtttgcttgggtctgaaaagaaggactgcagcgccacctccactggttaaggacaaaatccatacttattccatctttctcgggacatattttcctgagacaaaagaccgtagaacttcaaagactcgttcccagaaagggatttagagttaatttttgctcggcatcaagccggaaaaattcaggcgccgcttagtaattaattgcaagtaaagaagtaccggatttattagacatcgtcttagcaagcaaattcctgaaagctaaaacgcaaataattaactaaaaatagttgctaaagagcaccttttatgcggtacataaaagtttttagtgccgtagatatatgtagatataggtgggcgtaggatcagaaggagccggagagaagatttaccaacactgatattcctcgaaatactctataattctctctgggtaaccgaggagtttttgagaaacggtgtttctaacatcgtccaccagaacaggagggccgcagcacacgaccgctaatgaatctccaggcggcgtactttttattgcgttttcaattacattgctaaaattaggtcttgcattgccgatgtgggcgaagcttgtcagttcggtcattatatcatcaaaatgtattaattggtctcgtgcgtttgctgcctttgtaacagctgttttctgtgtaaggtaaacctgcacgttgacgtgggatcggctattttttagctctagtatctcggatttatagccgttaagaaaagaaggatttttgatcgccatgatcaaatctatactcttgggtttatcagggtttcgtgacagcttaatggcatgatctaatggaccaggcaagcctgttcctccacttagtaacagcaaatggtcgaatttatcgaggtgaagattactgggcccataaggtccctcaatggccactcggagttgtaatttaccatttaaagattgcaaaatatggttataaatgaatctagtgagaccacttttaggtttgatcactaaaacacacttctcaccttcgtcgataatggtaaatggatggcattgccaaaataccaatggatgtaaaaaataaatgaaacaatattgacccggtttcgaatgccatctccggttatatttgggtatgattactttaaacatttcatcgtgcgggttgttgctggtgttcaaattgattagtgttgctttcggaaatctaaactgcaaaatgttccatattctgaaaagcttttccagcccccaaatgagcaaggataccactatccattctttccaaccgttgaaaattttgacgtgttgccaacaacagtaaaagaacaaaagggctagtatgatgtgggtgtacaggaaaaattcgtaatgtcttttccttactattccgagcgatagaactagtagaacgcaaagcactgttatggatgcaataccaaacttccaatagagctgtttgttgcttattttgaaggcatggttgataattgcgaataatgaataagaaagcgaatgtatcgttgcgtttaagaccatgattctaccgatccatttatggaaactaataaaggaattgaacttgactcctgttaaaaattcgagaaaactattccttgccgtaaaaatgataatgagagggaactgagtaaacgccagtatcccagatctatcagccaacagtcttgtaaactgcgacaggtgactgttgaaaatgaggttatatgggtctatgatgtaacttatggacaaaaatatgatgttcgccaatgtgtatccaaaaatgatccatgcctccaaggaattcggcatcagtcccgtaaagacttccacgtttagaaacttgaagtgattagcgtgcttatctactaaaaacgtaggcaacacaaaatggccccgaatataattgacgaaccggcttgcaaatagcgctcgattcaggccgttatagtgactcatatggaagaagacggcgataatacccactatgacgaagtagtaagttaaatatgcaccataaacactgctgatatctaaattataggcatgcgcatgaaaagctcgtatccatctagatcttgtctcacgatcgactcgaatggatgtcgataaactttcaatagaaccatagtcttccaaagcgtgagaagaagcattatttaaagatgagtagtattgctccagtgaaatattgctaaactttttatcgacaaacgagcacgtttttcgtacgttacccaagctttcttcgaaacttgtgttgtccatgggaataatctggtctgtaagcgaattgaagatacaaagtgaccaagtatcaaacgctggtgaataagagcatatggtagaatagaaacccggtacgacggagctatcaaatgaccacttcagagtatttatataggatgcgcatgccagcacagcgttggattccaaatggtcttttttttcagtgtgtggtaattttatattaaaagcctttgttaaagatatcagccacgttaaaaacagaagcgttctatgcatattcaacgagctatggtcgtcatgcttcactttagaagattatagaaaaatcattgctgcctggttcgatgaccttgtatcttttcttgatctacatggccagtatttccgttctgaatttagaattacaaatatgggtgcaaaaacaatgcccactagccggggtgtacgggaccttaaatctaagtattgtgttttagatagagttgcgaagagaaaattataattataataattctatacatgtattctgtatatatatgacgattttatatatagatatacattttcatttttcttgaagattgttgtcatttgtgaaatcatttaccttaatgagaaccagcgcctctgctgactctttccaaaacagaatcgtaagaaacttcggaaaaatcagtaccttgaacatcggtagagacaccgtttaaggctcttcttaaggcatccttggaggatgcatagaccatcttagatctgactggagcagtgtctggagaccaagtgaagaaaacaatcttggatctcttaccttcattaccattaatttcgtattcaaaatcgtaaatggcgtaaagacagtcgttttctggcaatttctctaagaaggcatcgtaagatgggtcagtagaggtttccttgacaacgatttcggttttagcatcgttcaatccgaataaaataaatttgtattttttacccaatttcaagtcattgaaagcggtaagggattcatcagcaacagcaacactacacagaaacttcacattttcctggcttcttatgaattttttcccccacattccttttaaagttccatgttaaaaagggaggaaagaaaggacataagagagcgagataaaacagcatcatgtcaattagttagtaattgatagtttacacaggagtacaaatgaaatttagcatacccagatctagacatcttcttttgttagttttttgtttatgtatgttttgaaatctgaagtttacgtagttgctaaccagtcttttcttgtttcctctttttcttccaattttgtcatcaaacaggggcggcgtcacccgaatattgttcttattacccggatattaggtaatttagaggtactgcatatagtataagtgattgatgaacttatagaatgttctctcgagcttccaaggccattagcctctaccaaaggaagtttgatgcctggtcttaagcttgttgaagctttagaatacaggtgtgaccgattggagcggcttataggcgccggatacagcgcgaattccgatgtttcagtgcaattagatgaactatacaatcagttacatcgtctatatttccagggtctaaagtattctcaagatctcctgcaactctttaatactttcatggctgaagacatcgagaacgtgggagctcctgatgatatttgtatttttgctagttgctttgacgatatttatacattatatagtgcatttgacgaactaaacagccaatatatggagttttgccaaatcagtaaaagttcattggatcagatttccttcaaagacgcaaatattgaaacgaaacagttgaagaagttacccgagttggtggataactgcaacataatgattttgaggtcaattgcaattctaaaccgtttcatcgactggaatattgaagttaacggattcttccagttccagaaaaagaggctgttgaatttacaaaaggtaatttatagtacgtgaacatgtgtgcgtatatacatatatatatatatatatatatatatatatatatatatactttagcatcgaaacagctagtcctttttagagttcaatttttccacaaaggcttttttagccaattcaattaggatatccaattctccactatgctcacacatgctataaaaggcactttgtttgttaagtaacaaagaatatgggtgatcatactcttttacctcacctgcatccatcaccaaaattttatcataatcgataacagatctcaacctatgtgcaattgtcaaaattgtactaccttggaactcttttcttatggtttcttggatcttcgcatcggaactgtagtcgatggacgctgtagcttcgtccagcaatatgatctttggactcctcagtaaagatctagcaaggcacatcaattggcgctgtccttgagacaaattggatccaccttcgctaatttcactacttaaatccaagaatttattaacattttcggagttagtcgacgaagcctcattgcttgtttctcttgtggcgccttgttgtaattgttcttcactaattagatttacacgtttcaaagcttcaaagatctgtctgtcactaaattcatcatatgggtctaggtttgttttaatcgtccctgagaatagtgttggatcttgtggaataatagttatagaacgacgcagtctttgtaaatcaacaccggaaatatcgatattatcaattttgatatggcctgtctcaggttccaaaaatctgaacaaggcggtaataatagttgatttaccggcaccggttctaccaacaataccgatcttagactgagcgtcgacagaaaatgaaacatttttaattactctaggtagatttggagcataccgtaatgataaatcattaacctcgattttaccgtcttgtggccattgtggtggcggtatttctttgtgttcgttgtatggctcttgctcaatttccatatattctttgactctttcaacagaattcatattcatctccacttcagagtacaatcttaccaaccacaatgccccttcagtgaaggaaatagcatacgtcaaagatataccagccatacccgaatccagattattaatattgaatagaatgaacaaaccagctccaaaaatgaccaaggatccaatcatatctatcctaaaggccaaccaacgattagcaacccacaagtagaagaatggtttattattttcatcaattttgtgtaaattctcttgcataaacctcccttcatcaccaaacgcacgaatggtggtaacaccgacaagagtctcggaaaaatgttgatagatcggtgatctagaaatagattcaaatcttttcaattcacgagaacctgccatgtagaaatacccaacaaaataatacaatattgaaacaactatagcaacagataagaactgtggagtaataaatgtaatcagtatgacggtggataaacattcaataagcgaatagaaggcgccttgtatataaggtgtcagttcctgatcaatagcttcgatatccttggaaaacctgttcataattctacctgttggagtagcatcaaaaaatcttatcttggagtgtaaaaccttgtttagaatcatattaaatatctttcttgacgcgttgataccagcaacgaaatttaaaatagttttaccagctcccaataaagcctgagcaaaaccaatgattaggtacaaaaccagataatacattgtagagtgtccactggaaggttggttttcagctgacgccatactgatttgggacgagcccctccaatcaattagatgactagccttcttggagataaatgcaatagcgcgttgtgctctgggaataattttagcaatgacattgtgtgacgcccaggcacgaacccaccatgattgtccgatatacaaaagttgggctatcaagaacaaggaagctaaaaatgaaacaatcttccaaccaccaaaaattttcaaataccatttatagacatccagaccaaccacaccttcttcttttgtttcctcttttattaatttaccatcttcagtgcgttcagcttctgtcctcaatgatttttgaagtttcttggcttcaaagtgggaggagttgttgttcacgctaacttgttgttctttgacagcgggtaggttacttaagcttgtgctactttttgcggctaagttagcagaagagtttgcacgcgataagatactacttttcactaactcgtcttcaccaaacaaacccttctgtaacatgtctattggatcaccttggtctttaaccctaccatcttctagtaagactaccaattcagcatttctcaaggtcaaggcgatgttgtgtgaaaccaaaatacatgtcctatcttccattaatggtccagtaatacaattatcgtaaatccaagatgcagtatgtgaatcaactgcacttaaacaatcatccaaaaggacatgcctagcattggaatacaaggctctagcaagggagactctctgcttttgaccaccggataaagtaatacccttctcaccgatttctgttaggtcaccggctttcaagatctcaaaatcacgtttcaatccgcatgcttcgacaacagctttatatcttgcctcattgaatggactattgaataaaatgttgttttttacagtatcatttagaagccaagcggcctgagaacaataagcgatagagttagtggttccattcgcatctactattagttcctgccttggttctagagctgggacgacaaccttaccattgagtagatacatttcacctaataatgccattagtagggatgtcttaccagaaccagtggggccaataacgacatttagtttaccagttttgaattcaatgttcaagtctttcaatttgaaatcttgattgtccttatcccaagagatggtggaattctcaaaggcaaatctgtttccatttggatctatggtcagttgatcgtatttctttgtatcattttcatttaagaaatcctgaactctatctaacgagacctttgattgaacgacaaaacttaacatatcagacaaacgatccaaaggatctcttaataacgtgaataaagaaagtgcagtaaaggcaaccggagtggttaatacctcgccttgaacgtaaatgtagtaagcaaatgaggcggctgttacaatagttggggtaacaaaccaaagaaaggaactgatagaccaaacaatggatctcattagcagtagagataattcattttctctaatagtattgatatctttttcaaaattctcctcccatgaaaagtatttgatgattctgatagcttgaaaagcttcattcaacttttgaatacgattatctgtgacagccaagtttttcttttgcaaatcgccgatgtacttggcaagcttataattcagtggaagcattgcgacaatgattaagacacccacaatcgcagcaaaacccagcagacggtataacagcgccagtgcgacaacagtcataacaaaagcctccaaaaatgaatgaaggtaaccacaaatttcagaaaccttgaaagcgtcaatagccatgagattaataatcgctccaaggttggcagaagaagtggactcctcatcgccgttgatacttttttgatcattaatttcctgtggatcctcattagaaggtttagtcttgttggtggaaatctttcttctcaaagctttagtataaatctcagagattataatacttttcattctgatacaaactctccttccaaagaatagtgcctgtgcttgacaaatagccactaatatcctacctacaaacatgacagtgacgtaaaaccaagctaaatttgagggagcagatgactgatcttcaacatattccaggatcctttttagtaaaactgttggaataaaagaaaggacgctgcctaaaaatgcccaaaagcattgtagtaccaaataattcgaaaagaaaaagaaaaggtttagtgaaaaaatacgcttccttttaaccttatggtcaacaaaatatctgaattttttcactacaaagaaagaataatcttgcatcatcaatccccaaatatccttaactttgatactaactttgtgtgctttccaaacaaaactgtctaaccaagcccagcatatgaatccagcaatagaagtgactggttctggagatggagtaatccagctgtcagttttatagatgatggcaaaattatttcttatcctcgcaaaaaagagtagcaagaaaagggcaaggttaatcgatatttgtgaaatgtaatactttctcgaaataggactgtttatatggtgaatgaaaatggaacgaaagggtaaaatcatagagataaacaaggccaaatagtttatgaacgataccgaccatagatttccgggatatttgtttatgaatttgaaattttggttgacatttgctaaacgtaaagagacaatgataaacaatgcacaccattctaccaaaccagtaatcgtaccttgttgggtgaactctgggtttttattgacatagtgtaatagtataaaagaatgtattataacttgagaaagtaccaaaaaaaattcaaggataattcttgatttttcaatgaagcctcttctaactatttcaggtgtaccatgaggttctccatttaccttaactgatttcagcttttccagagaaaagtgtctattttttagtgcgtcttttgtacaattattgtccacgtaattagttgtgatggtgttattatttatcaacggactctgttcgtcttcgtcggtagatgagtataaaagttcatcaattggatttttttgcttcaagtgtagaacgtcatagtagtaataatgtttccatatgttataagttatgaacaacaccgtgaatattaaaagcactaagggagtataataattaaggtactttgttctgccgtactgagttacgtcatcgtaaaaccaaaaccgatggtcaggtctcgttgaattgagtacgtgatgcatgttctccgtagcttttccccccttgatgagctcttctaaaaagtacaaaatctaggaaagtataatgtttcttaaatgcgatgaaatgaagtgaaaagaaaaagcgactggcaactataaagaaacaatgccggtttttcgcacttaattgttttcaaaagatcacttgtttatattagctgctaaattgtttattctatttaaaacgtgtagtaaggaaaaggcctgctctgtagttaatatattcttatctgaaaattttatatacttcattagtcacaacgtacgttctttgcagatgcgcacacaaaaaaaaaagggcaccaaaataaaggaggatgcgaaggtatgacacattttctggatacctttactggctaactattggttgtgatattttgcagagatgatgagaagtcaaagcaagtatactagctattttttttttttaattttgttttatttttgtattatctcctccttcttgtttctgttcatttttcttggcagaggctatcttaaccaacaatactctaccattacttgccttccgacctttaaattctcgacatttcttttgaatactatctccagtccccaggttgtcaaacttgatgaaggcttcgccggtgtgaaactcgtcggaaaagaaaactttgtttgttctcaaatccaccaattctcttcttacaaagtttatatttttagggtcaacaccaaagattttggcaaggtcttcatttgtcgatttcatgggaatgtttttcacatagagagtatttgtggatagtggcttgagatcaggagcagttttcttgtttgatttctggtttttttcaaaacttttttcctcttttgttaagatgttttcaataacaattttttcattcataaaaattttaccgttcatcttctctttcacttttttcagattcacaccctcttgaaattctataaatgcaaaccttttcagcggtttcttgagtggctttttctttagcatatttattgttatcttaccataatttggctcaaacaaatctctcaagtcctgtttacggcagtttttaggaagattgccgacatataatgtcctcctatcatttagtactcttttttttatttttgtattttcaggaacaactgttgttgttttttttccgttgacgttataaaactctatctcctctattagcattgcctattcttttcttaaaagtttctttcttcttaattttttcaagattacttgggaagatgccctatttccattgatttgaacgtatgtatgaatgaaaaggaagtgagaaggaacaagagaaaagaacaaaagagtttttagtttttatatttgcttacaggaacttcggcggctatttgttgtatcgtcgacagtgacgctgattctttcaaatataaatagctgccccaattagttttgcttggcaaaacccgacattgatgaactagtgccgcgcttaaaagtataatgttgctctattatttttcaaaaattcatacaaaagaaaacgggaattaagtaagtatacaaaatataattatattacgatgttcgaaattctatatatgaatttaagcggagtcggaagtcttagctctcttgtccatcttagcttgagccttgttaccaaggataccaccgccccagtgcttcttgacttcatcgtatttgtcagcgaagttagcgtcaatggtggaaaccaacttagccaaagcagcttcgtcttcggctctgacttcggtcaaagcggcaacagcagaagtcttttggttaaccaaagtacccaatctagccttacccttgataatggcgtatggaacacccatcttcttacacaaagctggtaggaaaacaaccaattcaattgggtcgacgtcgttagcaatcaaaaccaacttggccttcttgttttcaatcaaagagacaacatggttcaaaccgtacttaacagcgtatggctttggagaagcgtcttgcttagacttaccttcagcgatagcggcagcttccttggtcaatctttccttcttttcagcagcggtttctggtctgtacttgttgaacaacttgaaggtttcagcagcggtgtttctgtccaaagtgtattggaattgagcaatggttggaggaaccttcaatctgatggacaagatcttcttttgtctttgcaatctgacatattctggccatttgacgtatctggacaagtttctctttggttggacagcttggccaataccgaagttctttggagtagagtgagtcaatgggttcttagccttgttagacttagtggacttagcaccgaatggagctggagcaactttcttacctggagccatcttttctttcagttatcgtgttcactgtattgaaaaacagatataaaaaaaaaaaatagtgaatttcaacgtgcgcatcacaatacttatgtcttgataataatatcgatcccatactattgtccctggattttgagatgggaaaagtttcaatgcgttctatcgtatagtatgatgtattcaaaaaaaatgcgataattctttagttgtcggcacttcggaagccaaaaaaaaaaaaaaaaaaaaaaaagaaaaaaagaaaagggtgtctaagatgtacggatcttcattgggatggaaaacaggcaagtaaaaagaatagtaattattacaatggagaagataagataaagttagcggcaacaaataaagaactcatcagagttcttggcttctctatgagtgaaagtgtttcaaaggtgtttttttatgagacaacagtaattcccctccttcagaacagagtgtagtgattggcagtgaagctatccctctttgccacccaattttgacggcagttctcatagcatctcaaagcaatagcagtgcaaaagtacataaccgtaggaaggtacgcggtaggtatttgagttcgttggtggttatcctccgcaaggcgcttcggcggttatttgttgatagtcgaagaacaccaaaaaaaatgctgttattgctttctccgtaaacaataaaacccggtagcgggataacgcggctgatgcttttatttaggaaggaatacttacattatcatgagaacattgtcaagggcattctgatacgggccttccatcgcaagaaaaaggcagcaacggactgagggacggagagagttacggcataagaagtagtaggagagcagagtgtcataaagttatattattctcgtcctaaagtcaattagttctgttgcgcttgacaatatatgtcgtgtaataccgtcccttagcagaagaaagaaagacggatccatatatgttaaaatgcttcagagatgtttctttaatgtgccgtccaacaaaggtatcttctgtagcttcctctattttcgatcagatctcatagtgagaaggcgcaattcagtagttaaaagcggggaacagtgtgaatccggagacggcaagattgcccggccctttttgcggaaaagataaaacaagatatattgcactttttccaccaagaaaaacaggaagtggattaaaaaatcaacaaagtataacgcctattgtcccaataagcgtcggttgttcttctttattattttaccaagtacgctcgagggtacattctaatgcattaaaagacatgagtaatcctcaaaaagctctaaacgactttctgtccagtgaatctgttcatacacatgatagttctaggaaacaatctaataagcagtcatccgacgaaggacgctcttcatcacaaccttcacatcatcactctggtggtactaacaacaataataacaataataataataataataacagtaacaacaacaacaacggcaacgatgggggaaatgatgacgactatgattatgaaatgcaagattatagaccttctccgcaaagtgcgcggcctactcccacgtatgttccacaatattctgtagaaagtgggactgctttcccgattcaagaggttattcctagcgcatacattaacacacaagatataaaccataaagataacggtccgccgagtgcaagcagtaatagagcattcaggcctagagggcagaccacagtgtcggccaacgtgcttaacattgaagatttttacaaaaatgcagacgatgcgcataccatcccggagtcacatttatcgagaaggagaagtaggtcgagggctacgagtaatgctgggcacagtgccaatacaggcgccacgaatggcaggactactggtgcccaaactaatatggaaagcaatgaatcaccacgtaacgtccccattatggtgaagccaaagacattataccagaaccctcaaacacctacagtcttgccctccacataccatccaattaataaatggtcttccgtcaaaaacacttatttgaaggaatttttagccgagtttatgggaacaatggttatgattattttcggtagtgctgttgtttgtcaggtcaatgttgctgggaaaatacagcaggacaatttcaacgtggctttggataaccttaacgttaccgggtcttctgcagaaacgatagacgctatgaagagtttaacatccttggtttcatccgttgcgggcggtacctttgatgatgtggcattgggctgggctgctgccgtggtgatgggctatttctgcgctggtggtagtgccatctcaggtgctcatttgaatccgtctattacattagccaatttggtgtatagaggttttcccctgaagaaagttccttattactttgctggacaattgatcggtgccttcacaggcgctttgatcttgtttatttggtacaaaagggtgttacaagaggcatatagcgattggtggatgaatgaaagtgttgcgggaatgttttgcgtttttccaaagccttatctaagttcaggacggcaatttttttccgaatttttatgtggagctatgttacaagcaggaacatttgcgctgaccgatccttatacgtgtttgtcctctgatgttttcccattgatgatgtttattttgattttcattatcaatgcttccatggcttatcagacaggtacagcaatgaatttggctcgtgatctgggcccacgtcttgcactatatgcagttggatttgatcataaaatgctttgggtgcatcatcatcatttcttttgggttcccatggtaggcccatttattggtgcgttaatgggggggttggtttacgatgtctgtatttatcagggtcatgaatctccagtcaactggtctttaccagtttataaggaaatgattatgagagcctggtttagaaggcctggttggaagaagagaaatagagcaagaagaacatcggacctgagtgacttctcatacaataacgatgatgatgaggaatttggagaaagaatggctcttcaaaagacaaagaccaagtcatctatttcagacaacgaaaatgaagcaggagaaaagaaagtgcaatttaaatctgttcagcgcggcaaaagaacgtttggtggtataccaacaattcttgaagaagaagattccattgaaactgcttcgctaggtgcgacgacgactgattctattgggttatccgacacatcatcagaagattcgcattatggtaatgctaagaaggtaacatgagaaaacagacaagaaaaagaaacaaataatatagactgatagaaaaaaatactgcttactaccgccggtataatatatatatatatatatatttacatagatgattgcatagtgttttaaaaagctttcctaggttaagctatgaatcttcataacctaaccaactaaatatgaaaatactgacccatcgtcttaagtaagttgacatgaactcagcctggtcacctactatacatgatgtatcgcatggatggaaagaataccaaacgctaccttccaggttaatgatagtatccaaacctagttggaatttgccttgaacatcaagcagcgattcgatatcagttgggagcatcaatttggtcattggaataccatctatgcttttctcctcccatattcgcaaaagtagtaagggctcgttatatacttttgaatatgtaagatataattctatatgatttagtaatttattttctatacgctcagtatttttctgcagttgtcgagtaggtattaaacgcaaaagaagtccatccttttcatcattcaaatggacatcttggcaaagggcccagttatggaaaatctgggagtcatacaacgattgcagttggctatgccactcctggtaaggaatcatcaagtctgataattctgttttttagccctttttttttttttttcatggtgttctcttctcattgcttttcaattttaagttcgttacctttcatatagagtttcttaacagaaatttcacaacgaaaatataattaactacaggcatgtaaatataaaaacagtcctttaataataaaccttaagcattacgcgtgtattaatataataaatagttataaattgaataaataggggagagaagccaaaaggcccttcaaaaacaaagatataaattcatccttaaaaacaacaatacctgaagatactagaacaccttgtcgcctatgatggacatatatacagaccgggtcatagcattgccaatgataaataaataatagtcatagagagtaaacataaacgcctaacgtataggaatgtgtgagaatggtgagtttcgtccttgaaaataataataataatagttggtgcttttattagtgccaaaatcatttgagaggcttctgagttcttcggggctagctgtttttctgatagtctaggcaaatgccaaagatttcttaatttcagcaatagccaaaccaggattcaagccctttggacaagttctagtacagttcatgatggtgtgacatctgtacaatgacatggagttgtttagcatggcctttcttgtctttgtagcttggtctctagagtcaattagccaacggtaggcttgcattagcacggcagggcccaaatactgttcttggttccaccagtacgatggacatgaagtagagcagcatgcacacagaatacattcgtaaagaccatccagtttcttacgatcttcaatactttgtagcacttccgttccatcctttggaaacgatgatctctgtaagtaaggttggatagatttgtattgttggtagaagttagttaaatcaggtaccaaatctttgacaataaacatgtggggtaatggatagatcttgagttgtttggattcgttctggtcgatcttacatatacaagctagcgtgtttctaccgccaatgttcatggcacatgaaccgcagataccttctctacatgatcttctaaaagttagggtagaatcctgttcgtctttgatctttaacagcgcatcaagtaccatgggcccacagtcattcagatccacttgatatgactgtaaatgaggtttagcacttggctcgtctggattccatctgtaaactttaaaagttttcaatctgggggtatgcgtagctgcagctgttgtggcagtagccatacccttcttcgtcaccaaacaaaaggccttccttctcaatagcacgttcaacatccctataaatatgtatactccagtatttcaagaaagtatagctcaactatattcctttcaatcccttcctttagcctaacattttttggcattctcatagaaagtcattaatccccttatataagtttgccctttttacaccggagctaattgggccaatgcgaggccgccttttgcgcgctgcggatatttctaaggcatggtcgtgcggagctacaataatacgattgaattatagctacatagtgtacaaaagcgggtatatactttcatatgtgatcataggatagcttcacagtacttattgtattctctaacagcaatggcgatgttcctgtacaaggaccgacgttcttcaggatcgctgatgggaatgaagtattcggattgagacttgagtttaatttgaagaccggatctttccaatgtaattccctggatggaaggatatcctgtgctccacataagctcttgggtggccatttgcacctcagcaatgtgctgcatggacacaattactgctagttctttgcctggcaatataacgtgcgacaggtattcatcattcataaatactcctccattcacggtcttgagccagtattgtccttgggcctcacgtagatcataaggcttgatgatttgatcatggtccacgtaccttggtagacgcactctgcaacccttttgcatgtcaagcacagtggtggtacttttcacgccttgacttaagttacttgtaagatctaagaatccaatggctgtcttagttggcagcccaacgatacctttaccaaggcctttgaggaaaccagcggcgccttccttttgcatggccttgtatgggtccagtgcaattccgctcaacccgcttcccagtgtgctggcaaaggattgcgctgagtttgccaaggcattcctgttgtttttatttattctttgttgtaatctcctgaccctttggaattccagatcttgtgtaactgacaggcccttggccatcgaccccgtaaacttggacatactatcagagaggccaaagactgttttctttgcaaaacttagtccacctttagccagatgtataccaatttcttgaggcctatcattcatcatgtaaccttgatatggttcatagaataagtcccagacaccggaactaattgtgttgaaaagacctacaggattaccaaaacaatctgctgatcctaaaattttgtggatctgatacacgaactgggtcgtatagtgtctctcaatatggtccatcagaatgggcaatgggactcttacattatccatgaacaaagaattaactttaaccggcgcctcatttatattacctaatgtcatagcaaacatatggacatagtacaatgatgacgaaaatgactcctcggtctcttcagccaatcctggactaatttcatcggagcgtataaaggacagatgtaagacggtgggctgaatatggaagatctcgaaatatatatcacccgccgtttttaattcagaaacatcaggtaactggatttcttcatcgtacttataatctcttgaatccatgatccatggggatcctgggaattttatgaagtccatcatagcatacagcatgtcttcatctaattgtatggaaaattcctggattaataacgtaacatgtttaaagtatgggacagcctgtaaggaatcgttgactttagaaatagaacctgatatcactggatgattttcaatttccttttctgtgtaggggatttctgttggatatagaatatttgagtagtttcctgaaaataattgattatctatttgcatccatttcattttccaactgaaagtctggtatgctttagattcattgtatcttaattcgatccctctcatgttaatatatagaagttcctgtaaacgaccattgattaatgagataccaactcctttgaacgaaacaactatctgtgtattaaccttctcatcctcatccttttgcacaaagccatcagtcactgaactatttactgaaactgaagacgtggtagttgcagaggcagttttcaatttgtataacccaacattggccttatagttaacaataactaaggcctgcatatcgtcgtcagcaacaacatgtaatccaacaatgggggctggtttatcctttgaccttttatccaggcgtaacggtggcaattcgccaatctcagccaaccgaacttcccttgtacgtgtacctgattctaacaccagatatttctccttagctgtaggaaaatcccatgcgtatggcataatacttttcgagggaatcctgtaaaagataggtttgaaactacggcttgaggactcgttagactggtcatccttgtatggatcactaactttacgaggatctctttggtaaaatataaagtcatggtcgctgaaatttcttatggaaaatggccatctgtcaccaccgtccttgattcttatgaatattgttgctttgtccaaaagaatttcaatctttaaaagcttatggcgtgaatttttcaaaactttcaaatatgttacaccgacatttttgataaagaatggttgtgaccaattggagtctccgcctaagaatttcagcactaattgcttgtcgacgatgtttctcatcctgtataaaggcttagtgatgttcgattctatttgctggacatccatagaccctgtctcgcaaacttcaatagggatatctaaagtattgcttataatatacctaggtgcaatctcaataactttacttagcaagtacttccctttaccttcgctaatgttgatgcctaaatttgattcttgttccttattttttatgcgaacagatgcatcaaatgattggccaatagcgtcaaatgataatttggaactccactctgattccttgaacctaatacgagctctgttacttttatcatcttctttatcaaatgaaaacatttttggaatagtatatcttttttcgttttcaagcaaaatcttggattgtgcaatatttaagagactactttgaatgtagagttctctatcggtagagttcataataatataaggggagtatatccgaataactttggaccttgtaccatcgatgtttttataatctagtttcaacaacaaattctgacctccagatagggtcaaagacaacgaatcttctgggtttaaaggacttttatgtggtgtattaacgatggagggctttgaagcagaagcctcatcttgtaatggttgaacagacattagcaggaaactatccaaagaaatatgatgaacttccatactttctccagtcttcaagaaatctgttctcttctcctctcttttgtcaaaaatagagaagttaatatctgctggaagtaaattttcaatagtcatagatgccgaaaccacgattttcatatgaggaaagatctttgccaatggttctctttcatcatactttgcaccaatttcgaaatgaaatctttgattggaatcttcttttgaagaacagaatatagacatttggttgctcaacaagcttttccaagataacgtctgttgagaccaatcgtatatatcctctgatgcgggtcttatcctaatatcagaatcgtaggcatattctacaggaacagatttactttgatgtggtttaatagcatattttaaagatggcttatttggatctttggagtcaaccaaaagctcaatctcagttgaagttgtgttttcgataactaaagttgacctaaacgtaataatcttcacgttattctcatcacatctggcctcacaaacaattctattatgcacattatttcttggtgggctcaaaacatgcaagttttcaccttctgttgtggcatcaatattcataatggttttataattttgcccagaaacacaaacacccaaaatgttcttcgacttatcaatatccaatttctctctaatacttctccaatcttcaaattcccaaggaagagaagtgtttgcttttaagagcacaacttcgtttttgttgtcttcagtcgttttatcctgtatccagacgtcaaaatctaattctgtatcgtttaccagttgatatggcttctgagataccctggaagctaagggcagctcttcggttagagacgccgggatgtgagaaagcatagcgattgacctagcagaaagtgtaatttccgcgattctttgagttaaaatatcaaaagagaaagcaggatccatttcagaatgcccttttgataggtggaatgttattggaatcatctccagaagtggctcccagctagatctcgaatagttgaatatgttaacataggtttctagagaagcaagagcttcaaagtcggtagaccaatcctttgctgaagcagtgatttcatttacattcatgtccaatattggcatttcatggacgtcaccaattaaaataaatctcagtccgcctaagtcagcattgaatgtttcgtttttcaaaattgcagtaggcacttcaattgattcggaatctgagctctggctagccctgctgcgctcacctaaaatgcttggatccaacaccgctaatttcctttcaaattcatgagaaaattgtattttgtctgtgctctcctcctcctctccattatcctctttttccgtcatcttatttagcaatgtggtaactcgtttgaatattaacatcgccagacgaatatctctaagtgaaatacgcatcaacaggggctgaacggaaagctgtatattcgtcattagggtctgaggagttgagtttcttttatcaattgtcaaggaggatgaaaagtcgtccaataatctcaatttttcttcagacgaattcattttgaataggaagataccaacattattggctgcaactgtcataatattctgatcggttactaaaaattgtcctatcttgaaagaaatagcctcactattcatgtcgcaaggatcagcaagtaagatcagagccgtttcgatgatattaacagagtattggattttagtcacatcaccaccttcttgaacgctttcaacaatagccttgttttcaggcttttggtttgtgttttcaggatagtataaattgttttcgtggcttttggacataattgcatcaaaaaattctttgagagaaaccaaatagtccattgccaaaatcattttcggactgtccattgtcatcgaaatgttcaatagccgtccgacctctaagttctttctggaaatattagccacaaattgatattctttattcttactctttggtattagttctgtatgcttattatcttttatattacgaacatcttctatccggaaagcagcaacatgtgcttgaccatcgacggtcccatcattctttaaaccaaggctgcacccaatgtcttgaaacataattcttgtcagaccacagtcattcaaagaagtgacgccctttgtcttgttatataaagtaagggcaatctttggagctttaaaagaaaaatccaagtatttttgttctggattttttatattgcttttattcgatccctgtagagactgaggagtagctgtgcgttcgctttcgctacttaaagaagcagggtcaggagagggacttttgatctcgccttttcctcctgattcaccagagttttcgtctgtgatattgaatgcagaggatactttattggaaatttctaataagtaagtcagctggttctcagtcaaatccaacgcaaatgattcaaaattactcgttactttaagttctggagtgtcatcttgcggaaggggatctctgtctatattgaaaagtaaacctatattttcaactagatacaattgttgactggaaccatcgaagtttaagttcgaggataattggccctcgcggacaccaagtttgatatggtttattttatgagattcgtctattaccgaaaatttgttttcaataaagaactcacccaaataaaaccgcattgtatcgtaattgttctcttgtgtgcctactaatttaggaaactggataataggtgccttgattactatgtccattttcatgttatttacggcgtcaatggaaggggcttggttgtacgctgcaagacgagctctatcaaaggatactttagatttttgaaatttagcaaaaaagttaaccattctgttaacagcactttcgataaaattaacatgcatagagcccgtagaatattttaaaaacgaatcataatctttggtatttgtagccggatcgaatgattcatagctcaattcgactagttcttgacctttcatttgaattatttttctaaataccgaatccctggaaaacgattcatttgtttcatcagtcaactccaacccgcctaattttaagttaatgttgtatctttccggtagtaaaaccattgtgaattcaccagccgatagaactaacgttgccagctttatagaatcatcattaaaaataacattgacggcctccattttaattttcatattgattttttgtggcgcatcgtccctatcttctttattatgtctcaacacatcagccggcatttctggagcgttaggatccgtaaaagtaagcattgcataattcattaaagttaatacagatctaggtgttaataccaattgcaattcactcatatgcataacaatatcttgatcgaataattcaatcaaagtatcgttatgaggcacaattctctgcactctcttgtattttagcgtaaacaaatctttttgagatcttgtcactttttcaacgccggatgatatcaagtttttgaattccttgttatcagtcagctcgatgtaatcttcaacatctaatgaatgtactcttagatctaaattcatttctttggctctcttatcaaaattgaaatttagcctttgacacaatatatcaaccaatttttcgctgtttctggaatcatttttgatacattgaaagaatgctattttcgcctgatcgatatcaaaatggagctctaagaatttctgttcaatttgaagcggctgcatattttctaacgctttcaaagtattcttcaactgcaattgaatttgcttcttcatttctttttcggaaccagaagagtaattaacgtaatcgccgttgttttcttcatcatcaatcatagaaggtatagaattagcaatcaaattcataatagtcttgtattgaatgtcatttatggaaagacttaagcgaggcaaatgaccaaaaactcttatcgtgggtaatttatatgctttaggaaggattgatagatctacagttaactctaatttcattttatccaagattctaaaatcattcgtggaagaggcggtattgatcttacctatagtagactgaatatcaggaccaacaaatatctgagtatcctgagataaaatttggaacctatcaaacattaacctattgatttcgttaccgtcaatcttgtcatattcttccggcgataactcttttatttcctttatcttctcctttggcactaaatcactgagtatagacatatgaccggcatcaatgatcgcacaaggggtatcccaatcatgtgggtctaacggtaatatgattaatggtgcttgtaaatctaaagatacatttacggtcttgtggtcttccaacaaagactcaatacccattcttgtttgtgttgtccaaccttctacagttgcctcggcggcgtttacgatattgccgattgtttccatgtgttggtttgacgccttaaaaaacttgtggacctctgtaatgaaatgaacgtggtaaaacacagtcattcccaataacttaatgtttaagttcgaatctgctaatccatctagtggattcaattcaaatgaagcacgtaataaaggttcatcctcttcttcttcctccccggtagcgtggttgtcaattgaagattgatctttagatgagtttctgacactaatgatatgtttatataacgcgttgggtgagccatcttcgagactgaatttgttcaattggaaactcgataaaaatgaatcaggtctttgagcaaaatcaactttacaattttcaaaaattatggaacccaaatttagattttgcttcttctttcgtatagtgaatgaacccttttttaacaaactcgttacacgaagttcaaccctttctctaggaacttgcagtacaggacctttatcttcattctcgtcaaattcaatagcatcataaagctcctgacgctgttcttcagtcattattaaatcttcgtctacttcttctgtaggtttaccgttccaccaagaagagagccagcttccattatttttagttgcggacttgttggaagtttgtggttcaatatttgagctagctgttggtgtgggtgagtcttccgtcatgcccaacttatattgcgcgtactgtctcttagcgacagatctgaagagaataatttcatcatacgttaaatctttatgcaattcagataattgagcctcctgaatggggtcacgtagcggagcttctaaattttttaactttaacttttcaacccataattttgtgtacaacctccgttgttcacatttctccttcatgctttcccaagtccacattttgtttttttcatgaatttcattaataacacaagcagcaatgtatttaaaccattctgtcgggttttcactaactgcgaaggatggtcttgctttcttaaactttttggtaatttgtcttaactgtatactggagaggacatgcaagatatcattatattctgtatcatctaattctaaaccaaattcatcataaaacatttgcaagtcaatgtgaggttgttcctccgtggaacccagcttgttgatactaagcttccctagcccgctaaccggtttcaaaatgtattgatgcttgggggcagtggaatttttcgatgcaatcatatctttgaaaccccttacaaaattttccaggcttctatcttgatcatcatcagaaatcaagggcggagagtctgtattccaatacaaacagagtgaatttaaagtcaatagtttatgcgtgatattctgtgtaatatcaatgaaacttggagcccagttggaatctgtagatacagctgatagctcgttcaaagttaatccaacggaagatgggcctgtagtgaagattccgtccatgtcctcgtaccttaaatggatattttttatggtaacttgtaaattgtctatgatctttgtagtcaaagactgcataaacccggcgttatttttttctgaagaagaagaagaggttttgttctctgattgggtactcagtatgcgagcctgatttgtcagttcccattcacttaccttcctcatcttcaaccgaaaagctctctttatcatctcctcatcattttcgtgatcttctgaacgtggtgagcataataaataacagtcctcgataatgattttcacgggcttattctttaaacttgaccatgggaccgttaagaccaaatcacccagtatccctgatttcacatctatgggtaaatttaatgagtccaaacagtcttttcttagttttaagttttttaacttcacatcaccactccatatgccgacatttaattgattagggtcgaaattttccacatatgagcctagcaatcggtttagcaaattagcagctaaagactctaacatttaactgttcttaattttccttttttctgccttttcccttttggtagtcacaatattctatccgtatcaaattaaatagagttaaaaggttgactcaattggtcggcttatgtgcgtttactggagattgaaacatgataggacactataaaggtggtttatattccctaataaaaatccctttctatcaaaatagctaatggtattacccggcttcgcgaaaatagtgaacgtcatagtataagacgattcaaaaatccaagctcttgaaaaccaacatgaataaagacaataacacagttgaacaatttatttagtgttctatggagtatttatcaaaaaaaaaaaaaaaccaaaaagaaaaaaggagagtaaacatatatatattgacataatgaaaatattgcgaggactgatcagttaccacccctcaacctcaagacaaggtgaagagtggactccttttgaatattgtagtccgacagcgttctaccatcttctagttgcttaccggcaaaaatcaatctttgctggtctggaggaataccttccttgtcttgaattttcgacttaacgttgtcaatagtgtcagaagattcaacctctagggttatagtcttacctgtcagtgtcttgacaaaaatttgcataccacctctcagtctcaacaccaagtgaagagtagattccttttggatgttgtagtcagacaaggttctaccatcttctagttgcttaccagcaaaaatcaatctctgttgatccggagggataccttctttatcttgaattttacttttgacgttgtcaatagtgtcggaagattcaacctctagggttatagtcttccctgttagagttttgacgaaaatttgcataccacctctcaatctcaacaccaaatgcaacgtagactctttctgaatgttataatcagacagcgttctaccgtcttccagttgcttaccagcaaaaatcaatctttgttgatctggaggaataccttccttgtcttgaattttcgacttaacgttgtcgatagtgtcagaagattcaacctctagggttatagtcttacctgtcagtgtcttgacaaaaatttgcataccacctctcagtctcaacaccaagtgaagagtagattccttttggatgttgtagtcagacaaggttctaccatcttctagctgcttaccggcaaagatcaacctctgttgatccggagggataccttccttgtcctggattttcgacttaacgttatcgatcgtgtcggaggattcaacctctaaagtgatggttttaccggtcaaagtcttaacaaagatctgcataccacctcttagccttagcacaagatgtaaggtggactccttctgaatgttgtaatcagacagcgttctaccgtcttctagctgcttaccggcaaagatcaatctttgttgatctggagggataccttccttgtcttgaattttcgacttaacgttgtcgatggtatcggaagattcaacttccaatgttatggttttaccggtcaaagtcttgacgaaaatctgcataatctattagttaaagtaaagtgggagggagagttcgagagttcttgtcgtattgtagtagatagaagatatacttatccttatccgtacagttcttgctctttctgaagtagcactttcggaagaagaaagataagcaggcgaattcaaaggtggcaaaacccggagcctctctatatatacccccaaaaggaggaaccgccctcaaatgacactgaattctaaaaacaactgataagtggcatcgcccctgaaaaaagaaacgaagtggggtaaccaccgtgtgtggccggatgtacggctgtgtgatgctccactgggcggctatttttttttttggtaccgaaattggtttatccaggattattctagaacgttctagaaacaatactgaccacaaagacttttcggaatagaatattgtcaaacaagaactttttcactttcttttcataaaacgtcactttcatcacttttgcaggatttcccacagttcgtttaaagggacatttcctatcatgggttgccctgcgcgaataagatgattggtcaaggaagactctaaaatcatctgaacgggttatttgaagacttgggtctaaatgagagcttgcttattccacccgccacgccgggcgtatcttcactgtcttcttcggccaggggatccaaagagaatcgggcatattcgtgcgtattccttgtccgttgtctctggaaatctaagctagtgctggtggtgggaggctttgctttcttttctaagctttgtcgcgtgagctcgcttctcatttcctccagcttcaaatggctattgtccgtggacttcctgcccggagtcgatatgcttgagcggaattgtattacatccttgcgttgtttttctagtaacccgtcgtcttgcagcagccccagaacgttcctgcttagcttttgaatatcttccgccttacgttcatcccgaggatcctgaacctgaaaatcctccaggatctcaattagtatcatgtttcctttcagccacttgatgaattcattggacccgttattcatcagatatgagaccaaagtcagcgtcttcatcacctggatacaatttcgatgagaatttcttctgttctgcccaagtagcaatcgcttccggattacctggatgatttctcgtactgtcttggggctgtaggtcaagattgatatttcgttcataagcgtccccgttgctccacttgtttcgtcctcgttggtagcctgtttcacctttgattccgtcggtgattgaataaaactcttgaaggtatctaacaaaggcatcacgaccccctcactatatgtgtactcgttctttgacacctttatgctttctaggcttattcaacacataacctcaattttcgttttctcattcttttttctttttttttttttctcactaaagcgttgtcctagagatgtaaaaagagaaggaaatgaaatttttactggaaatgttactactattacacaggtttatttagaaagtacaaacgtgtcagcgtatttagggtgtcaatgcaacaatattgaaactatcatttgtcttcagaatagcggcaataccaccatctccgcataccacgtccatatcagtgaaatcggcagtgtcgctttgcaaacagagggcgctctcctcgtctttagtccaattttttgttttcttgtcaaatttgtatatcgtcagcgaattgctctcgtttgagtatgcaatcatattctttccagagtcgtcaatgtcataggtaacggtgcccgtcttgaattctgggattgtgtaagttggatacgctagcgtgccgacatcctttcttaggtcaaagcaaaccacagtttggtcacactctactaccatccagtacccattgtctgcaaatttaacctcttttatcttggcttcttcatctacggggaatctagagcttgcctggtcaggtgatgacaagttgtaaacgtctaatataccgtccggagagtaaagggctaataataatgaatccttatgtaggacaccgctgctgtactcaacatctgatttagcagaatgaacaatatactgggaatcatcctcgtaggattgaaatcctatggttcctctattatccgcccagatgaagtactctgtgttgacctcgttgtgaccatacatatatataatctcattggcggaatctacctctatttctctgaggactttgtttgtttttgagtccaatatagttatttggttacctggatatagtagtagcaaacgattacaaggccctctggaaataatagctggatgctctcccccggtacggggatttggtgtagttattgtggtaatcgttttcgaatcttttaattgggtaaaatgtaaagcaccatcctcacagcgacacatgcacacccatttatcatagtacatagatttgttaagctctttatatgggaatgttttgatgttacgggagtaattttgtgcctgtaatagctccaaattttttaaaatcggccatttgggtgctttgagcttgcccctcgctacaaagtctctagaagattgtaacagcccttgtaaaaattcttctctcgtaatagctaccgcttgctgtgaggatttgggtaaatccttcgaatcttcgtttttttccatcaatagttgcgcagcgaccaactttgcagcatctctttcgtacattacagtcgacagttttttcgttaaactatctagagttgatcgtaacttaaagttttcgagcattatagcatcccattcattctgtaaacttgtcaacagattcggaatcgaataattcgcttttaacgtagcagagtttgtagactctgttagtgaggcttgttgcgcactaggtacgatttccactatttcttcgatgcttaagggctcatttgttatcggatcattccccgtatctttaacatactgttcaaggagcgacttttcaaaaatagtcctggatttaggtgatagaactggccttctaggaactttcccactaatagcacaaagcattgttccctagttggctttcttggctatgttttggtctttaatatttcttggaaagtttgcatctttctaaaattgcccttacgaatttttcaccgctgctacccgaaaaagtacgaaatttatcaacatgaaatttattcctgccaagtcatcgagtgctctgcgcctaaggcttaggttgcatttaagttgtcttaattcacgcttatagtgcaggtagtataggttccccactcctgatctttcccttctgaaataaggaaagactgcagtttagtttggcagagagaagaagataatcatttctattatattctaccgctatggtgatagattccaaacaggatctacctcaatataccaaagattcaggttcagaatcggactcagactcaagtaataatttcattgtggaatctccgtcaattccatcttcaaaaagtgcaaccgtagttctcaatagtgaagagtatgaggacgacgaaggtgatgacttgaacgggctggatgctgaattgatcgataatataacgtatgaaggagatgaagatgaaactatgtttgtggggttgaaagaaaaacagaagttacatttatctggtgttttccggctgcaagtggtgaaaggaggtattgtctacaacaatgtacactataacgcttcgagagaaattttaaccttctggcacccgttatcacagtccatacctactatagatttttcgcactttgcaggctggcaagacactttttttatgccgagaaacaacaggtttaaaattagagatgaagaattcaaatcatttccatgtgttcttcgcgtttttaattctaatcatacgggcttgttagaagcaggtcatttatatcgggatgttaattatctatggaaacctaaagaaccttactttccattaaacgagagaacaacgtatcatttattacatgagtcagaccgaattcaatctttatccgtgccgggatattggtcaactccgttagagaagttatatttgagtcacaagaacgctgcgtatgatacaagaatcatggtgattggtggtaaaaactctgggaagtctacattcttgaggcttttattggaaaaatttacgcaagatatacgagattctactacgagccaggaagaattggtatacctggatttagatcctggtcaacctgaatactcactacctgattcaatatccctgaataagattctttccagccctatttctctcggacaacatctctgccaaggttcaaatttccaaactttgttacagttctacgctggctcctcttccccgcaggacgagcccacatcatacctgaactgcgctgataaacttatagaccatttggaagagcaagccttcttcggaacgtcattgcttaatctacctgggtggataaaaggattcgggatgcagattttaaatcatataataaggaaatataagcccactcacttattgtttttggaaacagctaattcgaaaagacacctggatgaactaacaattccacagagtttttccacatcactacgagatgcatatgcacctgaagttgttcgcgttccagcccatagtctgaaccacaccttatcttctaggttccatgcatcacaactgagaacattcaaaatactggcactgtttcataaaataactcaatttgattatgattttgcgcctcttttaaaatctgcacctttgcaaatttcatatggcaaaggtaaaagcggtattaaaggcattcaatttcctatggaattccaggatctgaatcctcaagatatcaagtccgcattggaaggtactgtcattgggatatatacatattctggagaagactcactagaggtgaaatccttgaatacctttcccatcctacaatcgtgtacttcttcttctaaaaatttcataactctggggctgatacactctattgacacctcccagcaaataatgaacatttacgtgccaccttgccatacccagattttagataaacaacctgaggatgctcaatggataatagtaagaaataagacggaaactcctttttgtgactttcttccatccccccgcacaattacatgggatgataatatacaaataccgttcgcaacttttgaaagaaggaaaaaattggaacatgtgtggaaagttcgtaagaacgtcatgagacgtggccaattcatgaaaagatagaaagaaaaggtaatcgtacattttttaatagtgaaagatagaggatacacaaaaatcatgcaaagttttatatatttgttatgtatactcatattccttcaatatctaagtcatactaacttctagggactttaccaaaatattatttataaatttattgtttcatttcttccgcatccttcatctcctccgttaaacccattttcttatttaatctatcatatttcagtctatctttatcgctcacagagggtttaatctttcttaatgcacttcggaagtcagacatggtcacaataatttcttcgccagatacgccaaccgatagatcctcaaattccttgtctaagtcattatcaagaacagattgtatttcttcgctctgaaaaaacttcctttttagagccaagactgaactctccctgactaaagcagccaagtcagcgcctgaaaaattgttgcacttctcatttctgataatttcttcaaaatcaacatcgctactcagaggtgttccgtgtgatttggtcaaagttttgataatatctagtttttcctcagtattaggtaactcaataaacaaactcttatccaatctgcccggtcttaacatagcaggatcaatcatatcaggtctattagtggcgccaatcacaaaaattccccttctatcgttcagcccatctaattccgttaacaaagtgttgacgactcttgaggaggattcggacaaagaagtatctcttcttggcaccaaagcgtccagttcatcaaaaaatataacacacggtacagacgcccttgctctagtaaaaacttgtctgatggacctttctgattcaccaacgtatttatttaataattcaggacctttgattgatatgaaatttgcacgagattcattggcaacagcttttgctagtaacgttttaccacaacctggtggtccccacaataaaacaccaccaggggcgctaattcccactttttcataaagctctggtctcttgatgggttgcacaatagccatatttaattcaagtctaactctttgcaatgcgcctacattagcccaagtaacatcaggtaccgtagcgaacccttctctctttgctgttggttgaattgttggcaacgctttcaaaaaatcttcgtacttaatcgataataatgataactgctctcctgataaaggctcaggataattacgaataaattgttggactacggataaaggcaacggatcgatcatattcgcagtgttcttcaggctagattcatctccgtttgctgtttcatcaatttccatgttatcttctgaactgtccgttgccgtagttggtgtggattttatattagcataggtttggaaaattcttttaatagcgcatgtaccggcagcagtaactaaagcctttaaatcagcgccaacaaagcctggggttaattttgccaatttggcaaaatcgatagcaccatcaatttttaggttatcagacattttctttaaaatatgtaaccttgagacttcattcgggacattcaggcatatttctctatcgaatctacctgctcttctcaatgctgcatccaaagagtcaggtctattcgtggcacctatgataataacaggttttccatttgtcttttccatcgttaattcatccattgaggtcaataattgggcaactattcttctctccatttctctttgggctcctccatcacgttttggtgtaatggcatctatttcatcaaagaaaacaagacatggtgccaagcttctcgcttcatcaaacaaatccctaatctttttctcgctttccccagacataccacttacgactgaaggtgcagaaatagatataaatgggacttgtaattctccagctaacgcattagcaatcgacgtcttaccgcaacccggtgggccatgcaacagaacacctctaggtggttcgacacccgtggataaaaatatctctggatgaagaatgggtagacctattagttccataagttgtgcaacgacatcatccataccacctaaggatttcagagacgaattaggtggagatctatcttccttgattttttgacgttttaccttacatgtaccttctttggatctttttttagattttttaacctcttctgtcttaggatcatcagtttctgttatagactcggaaacagatccagatttggaccacgtgctagttatgcgtttgttcatctcatttgtgtctcgctcaatcatcatatttttcttagctagttcttcttccaagcttggtttctcttcctcttcgttgttgtaacctgggtaagaaccaaattcttccaattctgattcaatcacgtcttttagcatgcggtcaattgtcttttgtaagacaactttcttaactctttgaagtgataaatctttagtcaaacaaaaggtaaaaatctcacctgctgttaaatctttagcgaaaaacatggattcaaatatatcctcatcttcttcaccctcgttgttctcgccctcttctccttgggattcttgtctcagagacctttttctgtccaaagttttttcttccaagagacgatagataagatcgacgatcttgttatctagagaacttgttaatgagttctttttcgactttactttaaccattattccagccttcccaccacgtagctattatcggccctaatgatcttttattctaactgactcgcagattaattcacacatcggttgttaatcattgtttgaatttccaaaatatgcgatgagctgaatgaaaaattttggaacctgtcactatcgacgaacatcgaagtttgccatgacaaccatatatgaagaaagcttatgagactagctcgagtatatcatacgtatgcatgttaatcgcagttaagcggataacacaatgcgtaagccttctattacgataacaacagcaaaagctattataactccagactatactcttattaaatcgcattctaaataccaacttccttcacgttttcaaaagctagatgcagactcacctgagagaagtacagttgttaagctattttaccgccgatttatgaggcttaagcctttcatatcgaatgtgaaaatggttaaagatacttacagggattatgttcgatataagtttatgaaagaaaactacgaactcaaacgatacttggtattcaatcctgatggcttgaggtcgaaaatcaatcttgagcttctcagcaacacgaaatgttgtgaaaggatactccccgtgactgagatgcaaagaaccttggaatttgttctgaagagctgttcatacttgcccgaaacaaaagttcaaaagtgggatattgcaagggacaacacatattgcaggcaaattttaaagaaccttttaacaatgcaatatgaaaagtacagatcgattttgcatagaggaataggccatgatgagcttgacgtcaaattctctcatttgaaaactacttctagtccgctaactaagctaaataaaaccgaaaagaaaaagattccgcttttcaaagtatttagtgatttcgatacaacattgatatatctcaatgagacattaggtacaaggttataaagatcattatcgtaaaagaggagcggagcggagctttttagtatgtatggtaaaatatcaatcaaatactgtaatagatgcggatatgcgcaatgacatattttgtggtgtgcatatccattgaaaaggtgcgtagaacgttacaatactactgaacttttttccttctcattttctgccattttgatatttatgcctattattggtttgagctttattagagttggcataattataatcgtactcgtatgtatatccgtatccatacccatatccgttgtaataagtgtttggtatatatcctttgatggcttgggctcctcctaccgtcgttataacaggcattttgtggcgttgtggtgaggctcctgattggctggtattatcgatggtcgtacgacttttggcattattcattgatctgaaattgccattggtattgctattactggtgttactcttgctggaggcagaccctagaacaaattttttaattatttttttaaatattattttcgtcttttgtgtttccaaataattggatagtaattcgattgcttttgttagagtattctcattagtatccttttcaaaagtaaaagtgataaggtccttctcaaaagttacaattatgttcataatttgcaaaaatggaacaacaattaggttataaaattcgtattctttattgggatctatctcttgatctattttgaactcgtattcataaccaaacgcactattaaccaattcgttagcggctcttgatgcattctcatcatttccttgtatactcaattgagatgttccatccaagggctcttttaacggtatcattatgtaaacattttcgttcttttcgatttgtcctataatattcttttggccgttaacatgcaaaatatgtctatattgcccactagaaaatctaatgagcgtcttcgattgtaaactatcatattcttgaacaatttgttttaaatcattcttggctaggcatatattagctttgtttttcctggggcacctaattatcacattatcatacctgatcatagaaattttattttgtggaagattgaaactattggaaaactgaatgaagacgttatgctttctcattgtggcttgaattaaggaaccacctgtacctataatcggtctgtgacaaacttcaggaatgaagaaagattcttcggcaggaaattcatttataacattcttaaatgattccttgaaatcagggaaagagtcactaaccaaatttaaataaaggttatcatcttcctcttccatttccagttgaattaagcaagcagatagttccattatacgtgttaatttaccatttttcttgcctgatatgaagtcttcaaaatcaggatgtatctcgaaaatggcttttatctgtcttaagtttggattaatcacttgatttgagcccataataaaatcagataagtaatgcaatatggaagtatcggacgcctcatctgtggaagattggttaccaactactattaattggttgaaggaatcctctttgggagttattactacaatttggtttccagtgtgtccgaaaaagctgtcgattattaattccggggacattgcgcagttttcattgagtgaaatctgtacttctacaatttcatgtaatacttgaatagtgaagttcttaataaccatttctaataagttcgtggaaatcgattgaaattcaatgtattcgttagtaactctaataagcgattggtatttcaaaattaactggtttaccttttgttggtagtattttcggataaacagtagttttcctggggtaatattagtcaatcgacgataaaaaaaactctttgaattcacgcttatggactcacgtagagttttcctagccagtaaacttagtgaatggacagcgcctgagaagaagatttgtggatttgccttaagatccctagacagcgtaatgagggaaggtgcgtaaatgctggttttaaaagctctggatatatgtttgaagttttccatatctacacccatatataagggaagcacagagtatgagttcagttccataggttcgataatgtagtgttgtggaggcaaagtcataccattcttctttattaaatcgacaaatgccaataactggggttcgcattccattaaattagatcggaatcctaatgcatgcacgtaaatacataattccttgctctcgcctgtctgttctggtgtgaagtaagctggttctttggtgatgattagttctaaattgaatttttcactcaagtccaatagtatacgtttcattttttccaattctgctgttagatcatttgtgttcataggtaagggcaaagaaatcctgcaaatagcatcgaggtccatatcatctgtggtagcttttattgagatcatgtcatctctaatgaaagaagcatttagattgacccatgagggatctatatgacagattgcttttgtgtttttaagttctttggagcttattcttttttgaagaaattcaactaaaaaaggtgcttctatgggcttccataatctatttgtcgtgtataagtgtggaacttgtaaaaaagcagttgtgataactgtactgtaaattttgaagttatccatgcctcaaccgtgtgtttactgctgtttttctttttaaacaattgtgtagacttaacctctgcgggcttgaatagtgcttcaaaaggttcaggtagtcaagaggttagctatataaacaaagatgacttttcatcctttatttcttttattttgtttttgttttttgcctttgtggaaaaaaaacaatctacaagcgaaaagaaaaattttggagaaaaatataatttaggattacaagaaagtgatagaaaaatgtacaatcttaaaagaataaagctgcagaaaagagatgcttttgctttcaaatttttgcaatatcaagagatatgatttacttgtatctaaattacatgtagatatatatatatagtatatttgtaagtaaagagtggaaatgaagttcgtcatttccaaaaaatgtcatttatgtgcttaatcaatctcccactagcaaatgcaattgtaccaaaagtaacgaccagttgagtgactattaaacttaaagaagcaaagataaaccttgggcagaagattttccaaaccatcaagtgtctacggaagtgagtaacccaaataaaggagcttagacataaaatagtattgtaagtgagtaatataccgcagtttgacacaattcttcctaaaagtgtttgtggcttcaacacatcaggaggctgtgaccacagtgtcagtaacgctacagataaggagacgagaatatgaggcccaaatgtatttaggatgatggctatctgagtgaaggggaacgttaccttttcagacagcataaatccgatatcccattgcactgatggaattgtggcttgatgaccggtggtgaaaaaatgttggtaagataagagtcccaacgcaattggaccaattatgttttcctttaattttaaaagatcgataatttctaaaattgatagtagttggttgcacatgaggaagtatgacaactgggccaggggtttgttgaatagtaggatactaatgagaacgtttatgaccaaaagaaaaaactctgagccgtaaatattagtataacctaaaattgttgcttcgtgagacttaacatcagtattatgaatgtttaatttaatacaaagtggtcccattagccagccgacattagaagcaatcaatgaaaaaccggcaataattctagccaacgtaaatttaaaaatagtgacgtcccgtaagaacggtattgctattaccgcactgttattttctaatgaagtcaatgaccaataaacaaagttcaaaccaaggataccctttaggaaaacgtttatccaaattggagctgcagcttgataagacgatgttagattataataaccggtgatgcatgcaggtaatatgaatatcattaggaaacagagacccaaaacccaccacgaggaattgttttgattattaaatgttggaatacaatattcgccttgttcctctctacaaatggtaatcatagaagctaaccgggtaaaaatgattaaaactgcagaatggtaacctcctagtaatcttgcaaatcttgttaatggtaagtaatttgaatttgctgtcgaaggattgacccctgaagtggttccttccttttcactgattgttgcagttaataatgcagtggtggattgcctttttggtaagaagacaaattcatacaacgtcaacatgccgaaagtagataaaaggaatgctacaattctatcctcccaaatagtaaatgaattggaagtgaaaagcaaagcatgaataatcataaacatgacagcaattcttgaccaataatcagctaatgtttcacccagtctcatagcaatccaaataaagttgtacctatcaaatattgtgatataacaaccaataatgataccaattgcagtcgctaacagggtaccccagaattggtctacaaaacttggttgttgataaacgtaaaaaattccatggaaacataggtttgtaactaagaccattatgataattcccggaacgaattctggaaccatttgattcacaacaatagaaggaattaattttgtaatggatatcaacaggaccagtgaagtggccagtagcgttataccggtggcaatggaataataatcgaatttggcccatagttcttcgcaggtctgcaagaagaccttttggtatttatgacccagcttaacaaatttttctggatcgcttgttgggggggtgttagatatatttttcgctaacggttccaatatttcgtcattgccatggtggatctgcatcgtgtccttatataattgtaattggcttatcgctgagttgacaaattgagaccattctctatcgtttcttgctatttcgtcaataggccatccaagattgttaaatggtatcggttggcccatcaataacgccaaactagacaccaaatcaatttgtctcactgaacggtaatcgtgtcccaaattatcaatgttgtaattcgaagtttctttaagtctccacatgtccggcttcttagaataaagaaataaagtgctttcgagctcgtcgatggagtcgccaccgtgattgcccgtatggtccattccatggtcacccaaaataaccaataaggtatcatcatcgatcgattttagtatccaatcgataaattgatctacttgaatttgtttttccctcatagtaaaatggtcggggccatatttgtggcccacatggtcaatacctagcatgtgtccaatcatgacgtcccattccttgtcctgctgtaaatgatcatggaagtaatccataacaccgttatcgacagtatctaagtcccacacattgagtgattctagtgggaaactatcgttggaaaggaacggatggaacagagccatccatgtatcatctccggcaaatttgacagtcttatttgccaaatggagctgtttaagaaagttatcctcttcgattactgttccatcgaagttagacccggcatcaatgaaagtcggtaaggaccctgttgtgagacccttgagtctttgtaaagtagtggttggtgggtcggcaatgaacttcaacaatagggaagatgcatccttatcgcttgcaaaagaatcatacaatgataatatattattatgatagttcaagttgtaattagagtgggattcgtttacaggaatagcgaaatcaaatctcaaagcgtcaataaccaaaatcaccgccttgttgaacctaggaggtaacttactcgtttcgttttgtgaggaaatattatcaagaacgtgtcttgacagtaagaatccccgagtgaaaaaagctattgatatgaattgtaaaatggcgatgaaaaccaatagaataatataaaatttatgattcttttgaaatttctttattcgcgatttgtatattattttttcatcattggaagatgaaagaatcgactttttaattgtcttttcatccatattacgggagctttttttttccacttaatgtattgatcttcctcccgttctttgacgattcggcgttgcccttaaaacatatgcttctattccttttttgatcttacccatttatttgtttttttttattttccggtggacaacaaaatgttaaaggaaaaaagaaagtaccttgctcgtcatcgcgcttgcataatgtgcgccattaccctgtaacaaaaacaaaagatagagtggcaacaacttgacacaactttgcaattgtaccatgaaccccaacaagaaaggcggttgagagtaaatgatgtggtttggttccttttttttcctacatttaaggttcatagagaagaaaattttctgaaatgtcttttcctcttttaatgaattgtaaaaaagccagtattggaataatattctattcaatatagtaagaaaagaggcaatgggcagaaatcttctcccgcataatcctttaaatgcaaaatacatgttaggcgtctaaatttttttcagtgaatccagatgcagaaacatttaaacaataaatatcttaaacccattttgaagcatcggcggctaaaaaaatgattttgcatggaaaaaaatgagagctgtgaacccaataaaaaagacagctttttaaaaatgtataacggtacattaagctcttgtttattcctcaaactgctcctaaaaaccatcctctcaaaaataataatgatagctgaagattatctgccacgaaatgccattgagccgcttacttgtaggttttcatgagtaataacgaagataatttacccgtctttataacccacgtaaaaataaacatataattatttcttattatttcaactaaccgttaaagtgttcaaatatggtagaaagctttccctatgtgcattatgattatcttttagccgccagagtttagtttaattttgttttgtttttgacgacttctggtgttacccgaaggtatatccccgggtgacccctaaaaatcgcaccccattttcccgaattttcttctacgttttcttttttcagaaatacttcgaatgagggatggaacaagaaggaagcgacatacaaaaactgagtcagtttagtcttaataggtgcaatatttacaaatacaggaaaggcaggaagcactggcaaaaagactgcatagctaaaaaaaaaaagaataaaaaaaaaacggagacctcaacagagcgaaaccaataattacaaacaaaatcttcatatgacttcgaaaccatccaccagtgacggcagggctcactcgatttcccatgtacctggcacgcacatgagaggaacatcggcatcacacagccccagaccgtttaggccatgtgcggattgtacgtgttctccaggcttactgtctaggcaaggtcgtagagcctctctatttttaagacagttagaaaattcaaggaggtcctccagcatgcttctcaacgagttgaagggcgctggcggaggtagcagtgctggaaatgggtctgtttactcatgtgactctctatgcgctgttaacagggaagttaacactactgatagattgttgaagttgcgtcaggagatgaagaaacacgatttgtgttgttatattgtgcccagttgtgacgaacatcagtccgaatatgtatcattgcgagatcaaaggcgcgccttcatttcagggttttccggatcggccggtgtagcctgtatcaccagagacttgttaaatttcaacgatgaccatccggatgggaaatccattttgagtactgatggaagatatttcaatcaagctagacaagaactagattataattggacacttttgaggcaaaacgaagacccaatcacttggcaagaatggtgtgtcagagaagctttggaaatggccaagggacttggcaataaagagggaatggtgttgaagataggtattgacccaaaacttatcactttcaacgactatgtttcttttagaaaaatgattgacactaaatatgacgcaaagggtaaagtggagctggttcccgtggaggaaaacttagttgacagtatttggcctgattttgaaactctacctgaaaggccttgtaacgatttactactgttaaaatacgagtttcatggtgaagaattcaaagacaagaaggaaaagttactgaaaaagctgaatgataaggcttcctctgcgacgaccggtaggaatactttcatagtagttgcgttggatgaaatttgttggttgttgaacttgcgtggatccgacattgactataatccagtttttttctcctacgtggctattaacgaagacgaaaccattcttttcaccaataaccccttcaatgatgacatatcggaatattttaagataaacggtattgaagtcagaccttacgaacagatatgggaacatttaacaaagataacttcgcaggcttcttctgcggagcatgaatttttgattcctgatagtgcatcgtggcagatggttcgttgtttgaacacctcaaccaacgctaacggtgcaatagctaaaaaaatgactgcacaaaactttgcgataattcactcacccatcgatgttttgaaatctatcaagaatgacatcgaaataaaaaacgcacacaaggcgcaggtcaaagacgcagtatgtttagtgcagtattttgcatggctggagcagcaattagtggggcgcgaggcactgatagatgaatatcgtgccgcagaaaaattgaccgagattaggaaaacccaaaggaacttcatgggcaattccttcgaaacaatatcctccacaggtagtaacgccgccatcatacattattcgccgcccgtagagaactcttcgatgattgatcctaccaagatatatctttgcgactccggttcgcaattcttggagggtacaactgatataacaagaacaattcacttaacaaagccaaccaaagaagaaatggataattacacactggtacttaaaggtggcttagccctagagaggttgatttttcccgaaaacactcccgggtttaatatcgacgccatcgctaggcagtttttatggtcccgcgggttagattacaaacatggcacaggccatggtatcggatcatttttaaacgttcacgaaggacccatgggtgtcggctttaggccacatctgatgaatttccccttaagagcgggtaacataataagtaacgaaccaggttattataaggatggtgagtatggtatcaggattgaaagcgacatgttaatcaagaaggccactgagaagggtaacttcttgaaattcgaaaacatgactgtggttccctattgcaggaagttgatcaatactaagttactaaacgaagaagaaaaaacacagattaacgagtaccacgcaagggtatggaggacaatagtgcattttctgcagcctcagagtatttcatacaagtggctgaaaagagaaacaagcccactatgacttcgaggcgagcggggcgcaatacaattaatgttagtatttattctaagtagtttctttctttttatttaatttgagtgataacaataacaacaataatgactaaaaggtgaaaattgaaaacattaccttcatttttttacggccggagaggggtaggtacacttaaccccgagcgcttttagtgccaaaaagagttaatgtgcgtagtcggattttaaacgaccatgcatgtacagccccctagtgatttatactgatgcctcatcaagaaattttttcatccagggtccctgctcggcgaacctttccgcaagagtcacaaaaatcaatcttataaccaggcaccagtagtactgccaagcttggactacatagccaacgtaaagacaaggagtctgatttagtatttcttttttgccagccagtattttctgcgcaggatagattattttaagagccgagaattccttatgcgggcccggtcacaacggattataggttccgccagaccccgttgctttggttccatggagcaggagcaggattttccgtggaaagagaagcaccgagcgaaaagcggatacggaaggcggatgcggaaacggatgcggacgcggaaggaaggaaggaagcaaacccttccgtctatgtcgctatgaagccgtctcacagtagagccattcgagatttccgtccgtcggtacacagaaatcttcgtatcgggagttttactttaaaaggaaacgatcgtaggaattccctaaagaaaaaggaagaaaaatttaacgttgaacattgtcattttcttttttttttttatgtgtgcagaatatactatcaagtaatgtgttctatatataaagggtacctcatttgatcttgatgtttctttctgctcgtatgccttgagtcaccagttttcaaaaataatcttggtctatagaagagaaaaatccaataatctgaaattggttcttcgcacccttgcaacgagatcatatactaaatatcgggaactctttatttctggatcttttatcagtcacttttttttttagtcaaagaagcaagagaaaactagacagagacaatgtcggatcattctcccatttctaataaggaaaatcatctgctgccatcagactcgtcaagaagctcatccagcgatatgcattcgacgggcaccacgggaaccacaggcgtcgaacctgtagatttcaccggtgaaggtgccaaatacacaactgctacggagggcaatggtggtgcagatttagcgattcaaagaacgacgactatgaattctgctgcagaatcagaggttaatatcacgagaagattaactaaaatccttactgggtctgttaacgagcctgaccgtgtagaggttgattataccaattgtgcgcccatgggtggtgacagaccttaccctccatcgttgccgagcagagacctgtacgaggttacttttgatggtcctaacgacccactacatccatttaactggcccatgaagaagaaagtgctgctatgtctggtcttatgtctggattctattgccattgctatgtgttcttccatttttgcctctgcagtgccgcaaatctgcgagatataccacgtcatcgaagttgtcgccattttgggtatcacgctttttgttcttgggtttgcggcctcaccggttatctatgctcctctttctgaattgtacggtagaaagggtgttctggttttatctgcgtttggatttgcccttttccaatttgctgtcgctactgctgagaacctgcaaactattttcatatgtagattctttggtggttttatcggggcagcacccatggccgtcgtccccgccgcgtttgccgacatgtttgatactaatgttagaggtaaagccattgcgctattttctctaggtgtttttgtaggccccattttatcgcctgtcatgggttcttatatcgcacaaagaactacctggagatggttagaatatgttgtcggttgtttcgcttccgcagttttcgttgccatcgtattgttctttgaagaaacacatcaccctaccattttggttaacaaggccaaacagatgagaaagcaaagtaataactggggtattcatgctgctcatgaagacgtggagctatccatcaaagacattgtccaaaaaactgtgacgaggcctatcattatgcttttcgtggaaccattgctactattcgtgactatttacaactcttttgtctacggtatcttgtatttgttactggaagcctacccacttgtctttgtggagggttatgggtttactgaaaacggtgagttgccatacatcgccttgattatcggtatgatggtgtgtgctgctttcatttggtatatggacaacgattatttgaaaagatgtagagccaaggggaaattagtgcccgaggccagattgtacgcaatggtcattgcaggtaccgttttccctattggtatcttatggttctgttggacgggctactatcctcacaagattcattggatggtccccacagtaggaggggccttcatcgggttcggtttaatgggtattttcttgccatgtttaaactatatcattgaatcgtatctattgttggcagcttctgccgtcgcagcaaacactttcatgaggtctgcatttggtgcatgcttcccattgtttgcaggatatatgttccgtggcatgggtatcggttgggctggtttgttattaggtctatttgccgctgcgatgattcccgtgcctttactattcttaaaatatggtgaatctatcagaaagaaatccaagtatgcttacgccgcttaagaaaaagaaaagcagaaatcatgctctttctatatttgcatttttttatttcattgttattactcaccctgccccacgctcaaagggctcgataacgacatagcattatagacactgtgcagcgtaaagctgacatataaagaaattacaaaaaaaaattaaaaaaaaaaaaaaaaacaatcaaaaaagacacacaactacagaacaaaggaaatctttttctatgcacaagcacaagagtacttagagagtagtgatatccccttttttttctactatttttttttttcccatttttttcctccaagactcctcttatgtggttgttatgtatagcccatagttactaaataaaacactaattaatgattaataatccctctctaataagaaatagataaaagctattgttcttctcatcgccggttctcggcgttgtccgtacccttggccgaaactcgggcgggggcttattagtcataccctcagatttcattggtcagataacagtcacccggtaaatgcccgtttaatgacttctttattttggattaaaattgacagggaatttcaacggaataaaggaaagagattgagatgcttttaattcataaaggaaagggaaagaggacaggaaagcaaggaagagtaatggaattttgcaaatatttgtaaatcctttagaattactaagaaactgttatttattgacattattttactcgtcttatttatttatttatacatttggccaccatttttgcactcgtacgaaagaccattttagatttttttgatttggtagtataacaaacgatcggaacaataacgtaacataatgataaacacaggaagaagcaggaattcagtactgctggcacacagattcctttcaactggaggattttggcgaggcggtacgaatggcacaatgtctcgcacaatcaacaacgtaaatcctttcaaattaaaattcataccgaagacagtgcccgcagctgcagactctgtctctccagatagtcaacgtccaggtaagaagcccttcaaattcatagtttccaatcagagcaagagtagcaaggcttctaaaagcccgaagtggtcgagctacgcattcccttcgcgtgagaccatcaaatctcatgaggaggccatcaagaagcagaataaagctatagacgagcaaatagctgctgcagtatccaagaatgactgctcttgcacagaacctcccaagaaaagaaagaggaaattgagaccaagaaaggcgctgatcaccctgagtccgaaggcaatcaagcatttaagggcactgctagctcagccggaacctaaattgattagagttagcgctagaaaccgtggatgttcaggactaacgtacgatctacaatatatcaccgagccggggaaattcgatgaggtagtagaacaagatggcgttaaaattgtcatcgattcaaaggcgttattcagcatcattggaagtgaaatggactggatcgacgacaagttggcctctaagtttgtcttcaagaatccaaactccaagggcacatgcggttgtggcgagagtttcatggtttaaaaaccttctgcaccatttttagaaaaaaagaatctacctattcacttatttattcatttacttatttatttacatatttatcatacatattaacattgaaccctccatcgtggtagtgtttgctgttcctaacttttctttcgttgttcttgtagatatatatttttccagaattttctagaagggttattaattacaatcttaaacgttccataaggggccgcgatttttttgttcaattttcaacagggggcccatctcaaagaactgcaaattatatcacagtaaaaggcaaaggggcgcaaacttatgcaacctgccagattattatataaggcattgtaatcttgcctcaattccttcataattcgttcctttgtcacttgttcctttttacccttgaatcgaatcagcaataacaaagaaaaaagaaatcaactacacgtaccataaaatatacagaatatatgaacgaccaaacgcaatttacagaaagggctctaacgattttgacgttggctcaaaaattggcttcggatcatcaacatccacaattacaacctatacatattctagctgccttcattgaaacgccagaagatggatcagtcccttacctacagaatctaattgagaagggccgttacgactatgatcttttcaagaaagtggttaatagaaatctagtaagaattcctcaacagcaacctgcacctgcggagataactccaagttatgctttggggaaagtccttcaagacgctgctaagattcaaaaacaacagaaggactcatttatagcgcaagaccatatattgtttgctctattcaatgattcgtctattcagcaaatatttaaggaagctcaagtagatattgaggccatcaagcaacaagctcttgaacttcgtggtaacactagaattgactctcgtggcgctgatacgaacacacctttggaatatttatcaaagtacgccattgatatgactgagcaggctcgtcaaggtaaacttgaccctgtcatcggccgtgaagaagaaataagaagcactattagagttttagcaagaagaattaagtccaacccatgtttaattggtgagccaggtatcggtaagaccgctattattgaaggtgttgctcaaagaatcattgacgatgacgttcccactatcttacaaggcgctaaattgttcagtctagatttggccgcattaaccgcaggtgctaaatacaaaggtgatttcgaagaaagattcaaaggtgttttgaaggaaatcgaagaatcaaagactctaattgtgttattcattgatgaaattcacatgttaatgggtaatggtaaggacgacgctgctaacatcttgaagccagctttgtccagaggccaattgaaggtcatcggtgccaccaccaataacgaatatagatctattgtggaaaaggatggtgcctttgaaagaagattccagaaaattgaagtcgctgaaccaagtgtgagacaaacagtggccatattgagaggtctgcaaccaaagtatgaaatacatcatggtgtaaggattctggatagcgccttagtcactgctgctcaattagccaagcgttacttgccatatagaagattgccagattctgctttggatttagttgatatttcttgtgctggtgtcgccgtcgcaagagattctaagccagaagaattggattccaaggaacgtcaattgcaattgattcaagtagagataaaagctctagagagagatgaagatgccgactccaccactaaagatagattaaagttagctaggcagaaggaagcttcattgcaagaagaattggaacctctaagacaacgttacaatgaagaaaagcatggccatgaagaattgacacaagctaaaaagaaattggatgaactggaaaacaaggcccttgatgctgaacgtagatatgatactgctaccgccgctgatttaaggtacttcgccatcccagatatcaaaaagcaaatcgaaaagcttgaagatcaggttgctgaggaagagagacgtgctggtgccaactccatgatccaaaatgtggtcgattcagacaccatttctgaaacagctgcaagattgactggtatccctgttaagaagttgtcagaatctgaaaatgaaaaattgattcatatggaacgtgacttatcatctgaagtcgtgggccaaatggatgccattaaagctgtttccaatgccgttagattgtctagatcaggtttagctaatccaaggcaaccagcatccttcttatttttaggtttgtccggttccggtaaaactgaattggctaaaaaagttgctggatttttgtttaatgatgaggacatgatgatcagggtcgattgttctgaattaagcgagaagtatgcggtctctaagttgttgggtaccacggcaggttatgtcgggtacgatgaaggtggctttttaactaaccaactgcaatacaaaccatactccgttttgttattcgatgaagtagaaaaggcacatcctgatgttttgactgtcatgctacaaatgttggatgacggtagaattacttctggtcaaggtaagacgatcgactgttccaattgtattgtcatcatgacttccaatctaggtgctgaatttatcaattctcaacaaggatcaaagatccaagaatctaccaagaatttggtcatgggtgctgttaggcaacatttcagaccagaatttttgaacagaatttctagtatagtcattttcaacaagctatctagaaaagctattcataagatcgtggatattcgtttgaaggaaattgaagagagattcgagcaaaatgataaacattacaagttgaatttaactcaagaggccaaggacttcttggccaaatatggttattccgatgatatgggtgcacgtccactgaacaggttaattcaaaacgaaattttgaacaaactggcactaaggatcttaaagaatgaaatcaaggataaggaaactgtcaatgtcgtcttgaagaagggtaaatctcgtgatgaaaatgttcctgaggaagctgaagaatgtctggaagttctaccaaatcacgaagctactataggggctgacacgttaggtgatgacgataatgaggacagtatggaaattgatgatgacctagattaatttaatatagtgtgatttttaaaaactttcgaacaagaatcagtaatataatatatataattaataaaactaatggaatttgtttaattgaacttgacacccgagcaaaagagctcacattttaacgtttagttcatcttgctgtgaataatctaaaagtaaacaatggacaaaaaagtccactggacgtcaaatctttttttattgtatttgggacatatggcgttgataactaaagtttaaaggaagtaataagtgaaggttaaatctggacctctttactttcatattagaagtataaaacacacgcggattggtccattattagaatacgggtactacaataatggttttgatagttactgtacatttgaatgtagcgactcatatgactcatatatatgactaccaaatcatgttaaaattagtatatctttaacttagacttcagtactatctgaactgcacgtttaaatttttaccatagcagttcatgtaatattaataatcacttgtgccaatataatgttacagcgaacatttttccatgcgcttggaaaattgaatgatagaaaattcgaacagcgatgatttccaacgatgtaatccattaagatgattgttagaatttctattgttgcagaggtcatatgatattaagaacacagcacaatatattaaaatttcttctcgaggatattgagaaatgggtgaattttgaggtaattgttgggattccattgttaataagggctataatattaggtatacagaatatactagatgttctcctcgaggatctacgaatcctcataatggaatcaatatttctatatactaatattacgattatccctcattccgttttatatgtttcattatcttattacattatcaatcctttcactacagcttcctctaacctcgatgacagcttctcataacctatgtcatcatctaacaccgtatatgataatatagtgatagttataactattagttgatagacgatagtggatttttattccaacagatataagaattacaaaaagagaactgttatttctacataataatattacgattagtactccttttatatgtttctttatccatttacattatcaatcctgattaaaattcccacgaacccccagtactagattgttcataatggatcaagttcacaagttaataagggcgtgtggtctagtggtatgattctcgctttgggcgacttcctgactaaacaggaagacaaagcatgcgagaggccctgggttcaattcccagctcgcccctttattttctttttttggacccaaagcactagcttaggctgtccatctttgttcttgattctaaagatcacagtagaataatggtttatttcttagagttctacaagttttagcgtactactgaacaatgaatgtcctgattttttaaaactcgcgcatatttggaggccatatcgtgccaccaactttactacagtcaaacacctgtgcccaattctaccacttattaaacaattacttagtaagatcagcaagcggttcatctgtcccccattcatatatggctttcaccctctttacctgtttgaaacagaaaaaaaattacaactaatggtatgcaattcataaagcataggccaaaagaccctgatacagatatatgctaaaacaataattataaaggattatgccgtaggaaggctgagaatcctcagtttgtgcactttgaaattcaaaatacaaaaaactgttgacaaattagtatcataactatctatcgcatatattcacgtcacataccgcctctgtggcaattgacaacacttatccctatcaaagacaatacaaagtatttgttaccgagtgagattatttagtacaatatgtgggtaataaaaactaatcggagatatttttttacgttttttgatgcaaacgcaataaattcttgatttttgaaattttgcaggacatcaagatacgtttcttttaagcagtttggattgcttctttcgttccgaaagtaaaacgtaatgaaaacccctatagtattgtgacgcgttttccaactctgcccttagcttgatttgacggcttagaacaaaggaacagtagcacgaacacttcaagtgcaaatgacagtttaattgtgggtaaaaaaggtagcctcaaagttgcattttttatggactgtaaagaacatacgattgttatacacttttgaacaaccaagatgtactacctcaattgtagtgaattaatgtcgaaatttgttagatgccccgaataaatagtaactttatttagggaaagcactcgaatttttgttattacggtcacgccatattttagcatgtacttagtaaaagacccatttcgccatcactatttttaccatttttttctatacgatttgggagcaaatacctgaactgcacactaatggacataatcacttggttgaaaaagtactatagtagactatacgtcgtacgctgcaatctattttaagcacagaaagcatccttcgtatgataatataacctttttggtaacagagttaccattgaagcgacattgcagtgaaacttgtttcaagatgtagttgggaggaattatgtgttgagttcgtccactttatgagctcgaagataacgagaaaattgctaagatgccggtgttggcttcttgcatatgaagaggcaccaataaaacgatgcattaattctttattacggaagttccgaagcagcgaagaatgaaaaagaatacaagcgctcataattgtcctcggtggacatcatatacagcataaaagtgtcttttttaagttctctcccctaaagatcacaaacttcacgtaattagtaacgtgtagactactaaccttgaaaaaacgaaccccttttctgcctagcaaccgtttaagatataccaaaaaaggcaactgtgatgacttctgaacgagggtccacgccaagtcacgccaagtttgttttcggatcttctgctagcagaaactcaacacacctacatgaaaggtaaagggtttcttagaaacattcactgtaccgtgcattgttcaaacctgcgcgattgcttggcaacggcgagaattacattacaagaaggtgtgctttcataaacgagaagtaataaacttgtgtcgttcagaaacaatagtatctcatattggctacaatggagaaacttacgatgtgtattcagtatattggttagaaaactgtagtttgttagttgaaaaattaatataaatagggtgtttttaatcagctgtaatagaagtacatcctcatccttcttcttcactaagctcacatcatcactaaagcaacaaccaaaaaacaacaaatacaatggtcaaattaacttcaattgctgctggtgtcgccgctattgccgctggtgtcgccgctgcaccagctaccaccactttatctccatctgacgaaagagttaacctggttgaattaggtgtctacgtctctgatatcagagctcatttggctgaatactatatgttccaagccgctcatccaactgaaacttacccagttgaaattgctgaagctgttttcaactacggtgatttcaccactatgttgaccggtatccccgctgaccaagtcactagagtcatcactggtgtcccatggtactctaccagattgagaccagccatctccagcgctctatctgcagacggtatctacactgctgtaccaaactaggatttgacgcccttacgaatagaactttacgagtattagaatgttatgaataaatgaaattggtttcgacggtatagatgaataaaggtattttgaaaattataaaaaaaagttttaataatatagatttggtaaaataaataggcgtatatacacattgtatactgttgatattatcaagtttttattattaaagagctctttttattttttatttataggggaaaatgaccgatattcctagtcttcaagtcactattatttttttttttattcataagtacaattgaataatattattgatttttttattattgttcttattctttttttatcatttctatataaaatattatatgatttagtttatcgtaaaaaaattaaaaaatacagaggaaagcaaaagtaaaacttttcggatattttacagggcgatcgctaagcttaatcaacttcttcgacagttggaccttcagcttctggagctggaggagcaccacctgggaaaccacctggagctgcgccttctggagcaccaccagcttggtacaatttagacatgattgggttggcaacctcttgcaattccttcaattggtcatcgaattcttccttggtagcagtggtgttgctgtctaaccaagcaatagtttcttcagccttcttagtgacagcgtccttgtcagcttgctctagcttgtcaccagcttcagaaatggtgttcttcaaagagtaagcaatggattccaattggttcttggaagcaattctttgagattccttttcatcttcttccttgaatttttcggcttcagcaaccatcttttcgatatcttccttggacaatctacccttgtcgttggtaatagtgatcttgttagacttaccagtacccttttcgacggcggaaacattcaaaataccgttagagtcgacatcgaaagtgacttcaatttgtgggacacctcttggagctggtggaataccactcaattcgaacttacccaacaagttgttgtccttagtcttggctctttcaccttcaaagacttgaatcaagacacctggttggttgtcagcataagtagagaaaacttcggatttcttagttggaatggtagagtttcttggaatcaacttggtcatgacaccaccagcagtttcaatacccaaggataatggagcgacatccaacaacaatagatcttgagtcttggaagattcgtcaccagtcaaaatagcagcttgaacagcagcaccgtaagcaacagcttcatctgggttgatagatctgtttggttccttaccgttgaagtagtcagtgaccaatttttggacctttggaattctggtagaaccaccgaccaagacaatttcatcgacttgagatttatccaatttagcatctctcaagaccttttcaactgggtccaaagtagatctgaacaagtcagcacacaattcttcgaatctggctctggtgatggaagtgtagaaatcgataccttcgaacaaagagtcaatttcaacggaagtttgagcggaggaagacaaagttctcttggctctttcacaagcagttcttaatcttctcaaagctctttggttggtagacaagtccttcttgttctttctcttgaattcttggatgaagtggttgaccaatctgttgtcaaaatcttcaccacccaaatgggtgtcaccagcggtggccttaacttcaaagataccgtcttcaatggacaacaaagagacatcgaaagtaccaccacccaagtcgaaaatcaagacgtgttcttccttacccttcttgtccaaaccgtaagcaatggcagcggcggtaggttcgttaataatacgcaagacattcaaaccagcaatggtaccagcatccttggtagcttgtctttgagaatcgttgaagtaagctgggacagtgacgacagcgtcattgaccttggcacccaagtaagattcggcagtttccttcatcttacccaagaccatggaggagatttgttctggggtaaagttcttggtttcacccttaaattcaacttgaatttgtggcttaccgtcaacatcgatcaacttgaatgggaagtgcttcatatcaccttggacttctgggtcattgaagtttctaccgatcaaacgcttagcgtcgaaaacagtgttagctgggttcatagcagcttggttcttagcagcgtcaccaatcaatctttcagtatcagtgaaaccaacgaaagatggagtggttctgttaccttggtcgttggcaataatgtcaacacgatcattagagaagtgagcaacacaggagtaggtagtacctaaatcaataccgacagctttagacattgtataaatatttctgtataaaatctgcttgatctgttggaattaatcaattgaagaatagaagtaacttaaataagagagtattatattttcaacattttttggagaaaacccagcccaattgcggcttatatataacaattcgtccacaccttcccatagtgcttaagaatgaaatttcgtcaaaacctcgaagctttttttttcgaaatcttcgatggaatgttctagaaaaaaacttcgagaaagtgaatcggaagaacttctcggaaaaaaaagcttcggaaatactacgaataagggcccaagagagagtaagaatgcagtgccatgcagtcaattcaccactgtgagaccgtaaaagggttggttgagtaactcaattcaaggaataaagatataaaattgataaaaaatatataacaaattgtaacaaaaagcaaaagagaggagtggaatgttatacaaagtaattagaaggtattgaacttgtaaaaagtaataataaaactcaattctgcttcttggtcacttgtggggcaccgcttaagcggtactcagacaagcggatcaagctcattttaattgcattataagctcttttgacgaatggtgggatagatgggtggcttatgatcccgtccattctaactctccattgagcaaaggcggctttcatgtacttggagttttcgtatcttaacttaataaagatggcgtacacaacaagtatgatccaagacctttggaagcacagaatggctctgaaaaggaccaaaatgaaaataagcagctcagcagtaccgacccagtgcatgcacaagtcattgtactgaacaacaaacttgtcgatgaagctgaggatcttacttgaatctttactggaaaggtggaagacttttggtaagagaactttttcaacgtagattaaaacatggaatacagcaaacgcgaaaaatgggattaagctgaatgaaaatcttggagtgaacaaccagaagttggccaaaaccaaataaagcacgtcttcactctttaggagtccagcaacgcgtgattttatggaagccttagtggcagcggcatcttgagtctgcaatggttcattgcgggtgaaaaattgctggtaaatgatgataccgaaagattcgatgacaccgagatatgccgatctgtaataaaattctgacatcttgagcaggtaaagaatggagctgatcaatacgacggaatgaccggtaaaccatgcaaactgcaagctcttggctactgccatgaacctttgcacgagcgacttatctctggcagggaggtttggggggccttggttattagcgggtcttgatgacattatactgactattcttggctagtgtttcttgctccttatgaatagagaaaaatgactttttttagatgtagtaagtatgtcatttcagggatggtctgcttgctctttaaatattttttcacccttttaaaatggggccctttcgccgtaccaaagaaggagaaatatacattacgtatgtaggttgctacattttacacaaaactatcaatgccttctaggcttcttcttgaccagttgagagagatcattgaagtcaccaaggggcttttcgagggcggggaagccgatggaggtcgtgggctgcgaaagaggcctcttggagccgtgctgctgattttcttgcacctcatcaatatcgtcttgaatctgtgcgagccttgcctgctgtaactcgctgtccttgggtcttgtagtcatgtgtttttcaagcagagccttggcatgcttgaatctttttagtttgtccttagccggcacctgatcaacccaccttaaagcatcacacaccaaaaattctgcttgtatcaccttctcagttacttgttctgcgggtttcaaggtcttgtaatagccaagcgccttcaagtaatgatgaatggctctactgaacatctccgcctccctttcgatgtcacccatcaggatatacacatcaccgatgcgcaatctgctgttctcggttagagattggccatctgctgtagggcggcccaacagcatcaaggcctgcgccagtaggtccaaagcattctcatacagatcattttcaaagtaaatgtggaaaccagacttgcgaagttgcgatacgtcttcaatttcatcgtcatgttcattcgctggactgaagttagccaattcgtgcaaagctaagcgttcttcctctttctccacgttttcttcctcttcttcgctaccttcgccactgtcctcactatcaccactgtcgacatcaccagtcaagtcttcctcttcttggtcgaattggaacatcctagaattaggaatttctgtttgaccgttctcgttcccctcttctccattgctcacatcagactcaggctcagactcagactcagacccagatccatcgtcacctgccagaagagcgtccccaaacagattaccagaattctgtacttccatgttgtatacagcttgtgcgaatatagtaaacagttcaggatcaggcaacaaaccatcttttgggagagagtccaaagtttgttggcagcgtttagcagcttctaagaactttttctgtgcgagtaaatcttttgcaatttgaacctgtctttccatatcaatttgaactttatgtctgctagttccgtttgccaacacgtcttctgcccttagtttcatattctgttacttctagaaggagacctcatcgccgatgttacctcaaaattgagtagaatgaaataatacaaaattggaaaaaacgcgaaacttcagtgcagtaacatatcgttccgacattctctgagaagtggtaagattccactgccggggagctacgagtgctcttgcaagtttttagacactgctatatccttcgactacgtaaccccatttttttatttttctatataaaaacatgcactgtatacatataatcacgtaagttcaagtcgtgcttaaaacgggcacagaaaactaactatgagttgccgtaccatacataaactaggagaaggtagcgcagttctttttttttaccaaaggtttgcacaaaaaagatggtctaacgtaagtaagttatcaataaaactgttaaaagtagtataagaatcttgagataggcttattattatgactttttatggcggaaaaggaagaagaaatactgcgccgggtgatgcgtgacgcgtttttggaaacgatgagaataaactttgaagtattttgagaataatattctattatcgagttctttcagcagaaagcaacacatagctacgtatagttcggtaagataaatttggtcagaagcgtgtgaaagacgctgagaaaccacgtgagacgaagattcaaatcaaggcgtgaggaataacgcaatacgagccaccgaaacagaataaacaaaagaaaagaaagagtaaacatgggtacgtcaagcgaggtttctctcgcacatcatagagatatcttccattactacgtctcactgaagacttttttcgaggtgactggcgaaaatcgtgacaggtcaaattcgacacgagctcaaaaggccagagccaagctgttgaagctatcttcttcgcaattttacgagctgagtacagacgtgtccgatgagctgcagaggagaatcggtgaagatgctaaccaaccagattaccttttgccgaaggcaaatttccacatgaaaaggaaccaggctagacagaaactggccaatctatcacaaactcgatttaatgatttgttggacgatatcctttttgagatcaagagaagagggttcgacaaggatttggatgctccacggcccccattaccgcagccgatgaaacaagaggtcagcaaagacagcgatgatactgcaagaacatccacaaattcttcctctgtgactcaagtagctccaaacgtctccgtacaaccttctttggtcattcctaagatggcatctatcgattggtcttctgaggaagaagaagaggagcaagtaaaggagaagccaaatgaaccggagggaaaacaaacaagcatggatgaaaagaaagaggctaaacctgctctaaaccccatagttacagattctgatctgcctgactcccaagtgctcgctcgtgatatcacatcaatggcaaggactccaacaacgacgcataaaaattactgggacgttaatgattctccaattatcaaggtagataaagatatcgataacgaaaagggtcccgaacagttgaagagccctgaagtacaacgggctgagaacaataaccctaactcagagatggaagacaaggttaaagaactgactgatttaaacagcgacttacatttgcaaattgaagatttgaatgctaagttagcatctttaaccagcgagaaggaaaaggagaagaaggaagagaaggaggaaaaagaaaaggaaaagaacttaaagattaactacaccattgatgaaagttttcagaaagaattgctgtcattaaactctcaaatcggtgaattatcaattgagaatgaaaatttgaagcagaaaatttcagaattcgaactgcatcaaaaaaagaatgacaaccataatgatttgaaaatcactgacggttttattagcaagtactcttctgccgatgggctcattccagctcaatacatcttaaacgctaacaacttgataattcaatttactactaggctttccgcagtacccataggcgactccacggcaatttcccatcaaattggcgaagagttatttcaaatattatcccagttatcgaacctaatctcccagctattactatcggccgacctattacagtacaaagatcaggtcattttactgaaggcatcattatcgcatgcgatcacatcgataagatatttctctgtttacggtcccgtattaattccgaaaataactgtgcaagctgctgtttcagaggtttgttttgccatgtgtaatctaattgattcagcgaaaataaaatccgattcaaatggtgagagcaccacctctaatgaaggtaaccgacaggtattagaatattcttcaccaactgctaccaccccaatgacgccaactttcccctcgacttctggaataaatatgaagaaggggtttataaacccaagaaaaccagcatctttcttgaatgatgtggaggaagaagaatctccagtcaagccattgaaaattacacaaaaggcaattaacagtccgatcataagaccgtcatcgtctaatggagttccaacaacctcaagaaaaccttcaggaacggggctatttagtttaatgattgattcatcaattgctaagaatagctcccataaagaggataatgataaatatgtctcgcccataaaggcagtaacatcggcctccaattctgcaagtagcaatatttccgaaattcctaaactaacactacctccacaagccaaaatcggtactgttattccaccgtcagagaatcaagttcccaatattaaaatcgagaatacagaagaggataataaaaggagtgacataacaaatgaaatctctgttaaaccaacttctagcattgctgataaactgaaacaatttgagcaaagttccgaaaagaaatcatcaccaaaggaaaatcctatagcaaaagaagaaatggattcaaaaccaaaactatccaataaatttatcacttcaatgaatgatgtgtccacagatgattcaagctctgatggtaacgaaaatgacgatgcagacgatgatgatgattttacctatatggcattgaaacaaacaatgaagagagaaggttcaaaaattgaaaaaaataatgacagcaaactacctgcaaatatagtggaacttgatttacatgagtcaccggagtccgtgaagattgaatctcctgaatcgataaaggaaatcacgtcatctgaaatgtcttcagaaatgccaagtagttcgctgcctaagagattagtagaggatgttgagccttcagaaatgccagagaagggcgcatctgtagaatcagtcaggaagaaaaattttcaagaaccacttggtaatgtcgaatctccggatatgacgcagaaggtcaagtctttgggtatgacaggaaaggctgtaggcccagaatcagatagtagggtcgaatctccgggcatgacaggacagattaaatctttgaatatggcaggaaaagttgtaggcccagaagcagatagtagggtcgaatctccgggcatgaaagagcagattaagtctttgggtatgacaggaaaaattacagctcaagaatcaatcaagtccccggaagcggctaggaagttggcgtcatcaggagaagttgacaaaattgaatctccaagaatggtaagggaaagcgagtccttggaggcagtaggcaatactatcccctcaaacatgacagtgaaaatggaatccccaaatttaaagggaaatactgtgtctgaacctcaagaaataaggagagacattgcctcctcagagccgatagagaatgttgaccccccaaaagtactaaaaaagattgtctttccaaaggctgttaatagaactggatcaccaaaatcagtcgaaaagactccatcttcagctacactgaaaaagagcgggctcccagaaccgaatagccaaattgtttctcctgaattggcaaaaaattcacctctagcaccgataaagaaaaatgtcgagttacgagaaactaataaaccacatactgagactatcacttctgtggaaccaacaaacaaggatgccaatacttcttggagagacgccgacttaaaccgtacgatcaaacgagaggaggaggacgaagattttgatagagtgaaccacaatatccagatcactggtgcatatacgaaaactggaaaaattgattatcataaaatacctgttgatcgtaaagcaaaaagcgaagcagaagtgcatacttccgaggaagatattgatgaatcaaataatgttaatggaaaaagagctgatgcccaaatacacatcactgaaagaaagcatgctttcgtaaatccaactgaaaattcacaggtaaaaaagacgagccactcaccatttttaaacagtaaaccggttcaatacgagaactcagagtcgaacggcggcattaacaaccacataaagataaaaaatactggagaaactacggcacatgacgagaaacattatagtgatgatgatgattctagctatcaatttgttcccatgaaacatgaagaacaagaacaagaacaaaacagaagtgaggaagaggaaagtgaagatgacgatgaagaggaagaagacagtgattttgatgtggatacatttgacattgaaaatccggataatacactatcagagttactattgtatttagaacatcaaacaatggacgtcatatccacgattcaatcgcttttgacatcgatcaagaaaccacaggtgacgaagggtaatttgaggggagaatcgaatgcaatcaaccaagtcataggtcaaatggtggacgctactagcatatcaatggagcaaagcagaaatgccaatttgaagaaacacggtgattgggtggtgcaaagtctaagagactgttcgcgtagaatgacaattttgtgccaattaactggcgatggaatactagcgaaggaaaagagcgatcaagattatgctgacaaaaacttcaaacagcggttggcagggattgcgtttgatgttgccaaatgtacaaaggagctggtaaaaactgtagaagaggcaagtttgaaggacgaaataaattatttgaattcgaagttgaagtaaagttagtagtatctagaggagaaagaaaaggaagacaaagacaatcaatagaatgtattatgtatgacatataataataataattataataataataataatagtagtagcagtaataataatattattatagtatattaaaacaacaaaaaattagtaaaaatactataaatgtttgaatatgaagatatatatgtaggaagaatttttattgaatatagaaatttaaagaaatattattaaaaaccggaaaatgaaaaagaagagttaaaaaaaaaaaaaacggaactagtaaaagatgtgaaaaaaagaagagaaaagtagaacgagaacacccactatccttgggtattattataagttgcaataccatcatccagtatgcccagattaaaccattcatggtccagagcgtcctttgcggtaatcctttttgttgggtcgaactcaaacattttcctgagtagatcgatgaaccagtaccaaaacaagaaagtttccttatcgagttcatcagtagttgaggaagaagaggaatgtgtttgtcttttccatgccaatttcgaatttatcaaagaccagtttttctccggcggtagattccaattgatgcttaagctatcgccgtaatcctgtttcaagacctttgagatgtaaatatctaagcgatcacatgactgcaagacccttttcattgacttttcggtggttatggtatctccgcgtttatttttttcaggccattgtaagcttaaagtttttctgtcgaaatgctttatcaccgttgaatttaggtctgatggagagttgcccaatttatgtttagatttgtaaaacatcttatcaataatgtctgtggggaaaggggttccattgattcgttgcatcatagccatatgttctagattttcatgaatggggtaaagagattcgccaataaccagttctactaggacacacgcgatggaccaaatgtcgcaggggaacgaccagcccaagccaaggacaatttccggggctctatagtgacgagtggatattacaggaggatgatattcgtaatggaaaattgcgctaccgaaatcaatgattttgatttctggatttttcaagattttgcgcttccccttactggcttcacggcgtctcttgcttagcgactgtacggttttcaaaggcaatttttgagcaatatgggtttcgtcacaaatcaggatattttctggtttcaaatccgtgtgtattatgcccaaatcgtgcaagaagcagacagatctgattagctgtctggcaatggcctgaatatgagagccggggaacctggcaatgccgttggagcacataaaatcgtaaatggacctgccgtatagatctgtcaccaaacaaatgtgatttttgtaatcgaagcactcccttagcaagaggcactggaactgaccttgagggtcattattcaggatagtctgtagaattcttagttctgttttggcggcttctctatatctatctacagcccttatcacttttacagccacgtaattaggttcatacttgttatcgatgcatttaagtactttaccaaacgtgccttggcccaataggtccttcacaacaaagcggccgccactgccaaatatgtcgttttcctggtaaacgtagtgaccgtctttgtccgttttgaaatttgatttattggatgatgcgctttctgaagagccgtttgatgtaaatttccgtagtgaagaaccaatttgtttcttgaggttggattgaggcagggaagctatttgtgctggtgggttggaaaagggagaagtgctgtgagcaatcgtgagattcactgccttgttgccctccagagtctttgcacacgaccccgttagatgcaacagctcattttcagtttgcgttactcttggcacgatagcgttggtttgatcaggaacattaaaatagttcgattggtagctcagcttcgatagaggcaactgaggcagtgagatggttctttgcttcttgaatttctttggtgtcgtgatatacgtactattgcttgtagctgcggtaccgcaccctggattatttgaagtaacaatattattgttgttattgatactgctgctactaggcagaatcaaaggtgacgaaaactgaattggctgctctttgataaaaatgatgtcatcgtcagcatcctcgtccactcgactactgttatgattattactgttattgattgtggtgttaatgatacgcggctcctcgtctagttctatggcattttcattgtccaagaacaactggtgttggtgttgccgaggacggagcggattgtctgcttgattcaggtctagactgttcctcagattgtctgttagaaaagaattttgccgagcaaacatctcgtccagcagcttgtttgtgcgcgtttcttcgaaattatccaaaaaggtcttgttagagcttgtattgttagcagggcccgtagtagtggaattattcatatttgctcttgaacgttttctagtgccaatttgaatattctgtgacataactaaggtacgcggaagataaagcaataatgaagaagagcagtatgcgtgtagattagtctttgttgtgctaaatcttcgacttggtaaatactatgtttctttcactctttttctgtctcccactttgtttcctttttctttttcttttttttttttgggtttgcttgctatctggcgcagtatttcgtgaatataatatctatttagttagcgtaagcacgaggagttactgcactgtttcctttcacttggtggtgaggtaacaatactttgtaaatccggtagatctgggaagtaaatactaaactttattctaatataggaacttcataatataaaatccaacgcacgatgctagagataaaaaaagagggtgggagatgtggagccaggattcaaatcgaaaatcgtaatcggaaactaaaccagcattgcaaccgggccataagccatatcgttaagcacgccaaagctttttcccttcgctgtgtgtttcctcgcaactttaactccggccactcactaagccaaggcgtgaggagagagactaaagctttgtggaaaaccgcccaatcacgctgacccctttggcccgtttgccgccccctagaaaaaaaagaaacggacgggcctgggcccgcacagcctcgagcagggtcacttcgcgccatatcggcggctatttcaaaaaaagaagttctttaccagttgttgtagaaagtatgatattaccaacagcgtctagcttttattcgatattccgatgtgggcggctatttattatcggtggcgtcttttatggttttaccgttgttgcctggagcatcctcaggaagacctaaatgtgaccattcatcgtagtccatcaattggtggtccatcctgcaccgcaggtagtcctttgccagtagtctacaattcattgcattttcgttctgcacaagctgcatacatttgagatactcttgcatgtacttggtgcattcgccgtcgtggtctagcgggaacgaacctctctcgggtggagtaggtctcaatgcgctcagcgagcttcctgggttccctgacattggattcttgtgttatgtttcgtaaaagatactttgtgtgtagtgggtgcgtttgcttgttttcttgaagtatagaagaaggaaagaacggaagaaaaaatttttttccctcttgttcgctttatttggattttctcgtttctcaactccgcgaatttgagcccttttcttagaccccggagagaagatgcagagatgtagtaataaaagctttttatccaaaaagcttttaagctgttgttttaaaaaaggttaaatgggcgctttagagatcgggtagtgggcaaagcctgcgataagaaaagagggagcgtgctacttgaccgggagcagcaaaatgggcggcccgagccttagatcatactcatcgccgataagagtcagcttggtaatagaaccgctggtgcgtaaatgaggcatagaacttattatcgtcttaaaaaactgcccaaaaaaatattttccaggtttcttgaagagtaatcttgttatgtaatttttttttgcctgtggattgtataagggaccagaggcggtcaaaaacgcaaaaagcggcatggtaggcgaaaatactaggacgattactactcaactgacgcgtcaacttaatattgtcctggtacataaccgaaccatcccagatgcgctgtaagtactgtttaaatgtattttaatatgtgcatagagcgtgtaaattatggcgagctatggtttccgaattgtcggactgctcatagcccttgctttcggaatattagaagtggtctggcggtaaagaaagtgtgacatatgtcagacgttgagacttatatgtgtaaagctaaatataataattcagttaaaataaaagtgggtgacaggaaaaaattagaaatgttgaaaatttttttaccttcactcgctacataaaaacgttggaggagactccttcatggtcttaatctctttggatctcttgggaacaatgaagctcttctgatatttttcaaatccaaatagaacataacaactctttccaaaccgataccaccaccggcgtgtggaggacacccatagctgaagccgtcacagtagtcctttagacctgggtcctcaggagacaaaccatgggctttcatcctttcttgtaatagagcatggtcgtggatacgttgtgcaccggacaagatttcttcacccctcatgaagaaatcatacgagttagaatacttagggttggctgggtcgggcattgtgtagaagggacggatctccaaggggaacttgtctaggatgtaaaagtcggtgtcgtatttgtcgcgaaccaacttacccaagaacttttcattttcggtactcaagtcttcaaaatcaccaatttccttaccggcagctcttagcatttcaataccttctttgtatgttagacgaaccatcttaccatctttaggtaacttgaattcttcaacagggtattgcttacgtaccaactcaatttcatgagcaaatctcttgggcaattcactgaaaataaacacaaacaactcactcaacgtgtccaaaacttcgtggtaatgttcttcgaaagccatttccatgtccaaaccagtaaactcggtcatgtgacggtgggtgttggagttttcagccctgaacacaggcccgatttcgtaaactctttcaaagtcggccacaatcaattgttgcttgttaaattgtggagattgagctaggtaggccttccctttgaagtatgtcacctcaaacacactggaaccaccttcacttggtgcacccaacagttttggtgtgtgtacttcggtaaatttctttgtggccaaatattctctgaacaactcacaaacaccagcttgaatcctgaaaatagcttggttggtgacggttctcaagtcaatgacacggtagtctaatctggtgtccaagttgaccacgggcaaacctgcagcttcagcttcagcttcggaacgggaggcatcttccaaaaggattggcaatgcttctggagtctcggaaatggtataaatcttggtaatgtgaatttccaggttttgcacagtagcagacttgattggctcatctaccttcttgacaatacctctgacaaggacaatggactccaaattcaatgaaccagcccatttgaccatgtttttgctgatggtaccttccttgttggcctttactagaccttggatcaaggaagcttgttgccttaaagttaaaaaggccaatgttgcaccttgttgtctggtgttgtggactcttgccctgaagaggacttctttgtcgctatccttagcctcatccaagtcaacaaacttgacacgcttctgaccagttctgtcagagtcacgagactggatcaatggcaacttaccgtagttgtcctttgcggtgtcttcggcagcggctttcttttcacgggcttctctttcagcttccaactggagagctctttcctccttctttctctgtttctcttgctctttctgcaatttcttcaaggccttcttggacaatggcttaccatcttccccaagaataacttgagcaggttctgcggattcttcaacagctttgacaatattttcgtcttgagacatcacgtaaaatgtttctttttttcttttacaattaaccttaagaggccgttccagccaatgatcgaaaacttaaacaaatcggttgtcttgcttcatccttatatgacattaaataatttttcatttcttcttttttcacgaaaatgcgtcataaggtactcgtcactgatgatttcatagacaataaagcaacagcacaacgtaaaagagttcttatggatgagtcccaatcctattgttttctgtagcctaatggtacaaaatgtgacggtaatagaatatatactttcataatatcataggaacatcttcagcttggcctgtctctttgagaaacaaaaactgcatgtgcacaattactgcagatgaacttcaaggaaacatatgtcctgcttggaggaccagaagcaaaccattctagctgtatttgcaacgcttttgtaccaaatgtacgttattatgttatgtcgtcagtgtagatatattagatttacatgcggctgtaccgcatcattggaaaataatgtctgcaggctcgcaaaatttaagggttcccttctacaatagtagtcaaaattgcttttttgcatataacaaagtgaaaaaaaaaaaaaatatgagagacatatctaaaagacatatataatctgccaccagaatgagttgcactgcgtcatatgccggcatgacaactccggtgaaggataaggaaggccacgggattccatgcttacaacctatcgatgtagtggaatgtacctatcaatattttacaaaatcacggaataaactgtctttaagggtaggcgatttgatttacgtactcactaaaggttctaatggctggtgggatggtgttcttatcagacacagcgctaataataataataattcgttgatactagacagaggttggttccccccttctttttacacggtccattctaaacgaactacacggggtgcctgacatcggtaatgaattggaaatatttcaagcgggtcttaatcttaaactggaattatcaagcaacccagtgatcttatcattggaagactttttagactgctgtcgcgatattgaattcaaggaacaactggcttggtcacctactcccgtccacgaaaggaaaggctgctgtgagctgctgtactataaccaggatttagatgtttattgtcgcacgttaccatatttaccacaaaatcaagttgaaaccgtgaacgactattcgtcttttcctgcaatatcgaagatagctggtaaaaagatgcctataacgtcaagccccgatctgttctatctcaatgattgtgatgtcgtctattggtatgacctcactcgcttagtgtgtcattatgttaatttaacagagcgcgacctattggcaaatgaacgggaaaagtttctaacttccttggatttattaacagctcaaataacctatgtttatatgcttttcaggaatctccgtttagttgaagatagtttcaaaaaaaccctcaaaaaactaatttacaccttgtctaggttttcaataaatgcaaatatttggtttcattccacattgtttgaagaaagagaagccatagcctcccagaaggatccagaaagaagatcccctcttctacagtcaatcctaggaaccttccaaaaatttcattttctactgcgtttactacatttcctctcaaatcctaacgaacttacaatactgcctcaattgactcctcgatttttcaaggattctttcaatacaatttcatggaataacccgtttttgcgtaagcgtctcaaccagcatatgtcccatgacctaccgagacagatgattaaagccgttgctggtgcttcaggaattgttgcggaaaatattgatgaaattccagcttccaaacagggcacttcatgctcgtcagaaacgtctcaccattcaccatcagccccgtttcaaagaaggagaagaggtaccattttctctaatgtgtcaggaagttccgatgagtctgacaccatatggtccaaaaggaaaaaaccatacccgctaaatgaagaaactctaagccttgtaagggccaggaagaagcagcttgatggtaaactaaaacaaatgatcaaaagtgctaatgaatatctcagtaacacggctaatttttcaaaaatgttgaattttgaaatgaatttcaaaacctacgaagaagtaagcggaacaattcctataattgatattctggaaaacctagatttaactatttttctaaacttgagagagttgggagatgagaatagagtttttgacgaagatgtcgctattgatgatgaagatgaagagtttttgaaacattctttatcatccctatcgtatatcttatccgactattttaatatgaagcaatattttcatgatgtagtagtgaaatttataattgtcgcccagcatttgacattagaggatcctttcgttttctcgccaatgcaaaacgacttgcctaccggttattatgaaccaatgaaaccttcatccttgaatttagataatgccaaggataagaagaatgggagccaaaatactgatatccaagaggaggaagatgaatatgagccagacccggatagtcttattctcttccacaacctcatcaatcaagattctgatttcaatgatttaaagttttttaatctcgcccacgtttttaaaaaatcctgtgatgactattttgatgtgcttaaactagccattgagttcgtgaatcaattaattctagaaagagagaatttgttaaattatgctgctagaatgatgaaaaacaatatcacggaattgctattgcgcggggaagaaggctatgggtcctatgacggcggtgaaactgccgaaaaaagtgacacgaatgctgtttatgcagattcagatactaaagacaatgacgaatggcgtgacagccaagtcaaattaccgaggtatttgcagcgcgagtatgacagtgaactgatttggggctctaacaataggattaaaggtggttctaaacacgcactgatctcttacttgacagataatgaaaagaaggatctatttttcgatattacttttttaatcactttcagaagcatctttactacaacggagtttttaagctacttgatttcgcaatataatttggatccaccagaggatttgtgctttgaagaatacaatgaatgggtgacgaaaaagcttataccggttaaatgtagggtggttgagattatgacaacctttttcaagcaatattggttcctgggctatgatgagcccgatcttgcgaccctaaatctggattattttgcgcaagtagcaatcaaggaaaatataacaggatctgtggaattactaaaggaggtcaatcagaagtttaaacatggtaatatacaagaagcgactgcaccaatgaaaacgttagatcaacagatctgccaggaccattactcgggcactttatactctaccacggaatccattttggccgtcgatccagttttatttgccactcaattaacgatactagagcatgaaatttattgtgagataaccatttttgattgtttacaaaaaatttggaagaacaagtatacaaaatcgtatggggcttcaccgggtttgaacgagtttatcagttttgccaataaactgacaaatttcatatcctactctgttgtaaaggaggctgataaaagtaagcgcgccaagctactctctcattttatttttatcgcagaatattgtaggaaattcaataacttttcttccatgactgcaatcatttcagcattatattcttcaccaatttatcgtttagagaaaacctggcaggcagttattcctcaaacgagagatctattgcagtcactgaacaagttgatggatcccaagaaaaatttcataaattacagaaacgagctgaaatctttacatagcgctccctgcgtaccgtttttcggcgtttatttatctgatctaacctttactgattccggaaatccggattatcttgtcttggaacatggtttaaagggtgtccatgatgagaagaaatatataaacttcaacaaaaggagcagacttgttgatatcttacaagagatcatatatttcaagaaaacacattatgatttcactaaagatcggacggtaattgaatgtatatcaaattcattggaaaacatcccccatattgagaaacaataccaattatcattaattattgaaccaaaaccaagaaagaaagtcgttccgaattccaattcgaataataaatcacaagaaaaatccagggatgaccaaaccgatgaaggaaaaacatccactaagaaagacagatttccaaaatttcaattacataagacaaagaaaaaagctcccaaggtttctaagtaacggcgccgtatgttcgatttccttctctcggtggattaattattttgtttgttttctcctgttatattatttattgatcactatagtaaactatgtccgtcatcaagcccgacggctgctatcccacaatgttgatcgtattgtttgcctagtttattatatatttgcttatttatagcataccataatatttaaatgccctcaaatttttggccgtagcgacatcgcgataattccaattccctttaaaaaattgcgcctgagtataagttaattcagccagttctccaaattaaaatcgcatactcctgaacctatcaacagattgtcctcgcatacttttctataccaaggtctcttctgaacatatattagcagtggttaattttaaagagatcataaagaaaattttgtctaaaaaagattaatataaagacaatgtcttcactagaagtggtagatgggtgcccctatggataccgaccatatccagatagtggcacaaatgcattaaatccatgttttatatcagtaatatccgcctggcaagccgtctttttcctattgattggtagctatcaattgtggaaactttataagaacaataaagtaccacccagatttaagaactttcctacattaccaagtaaaatcaacagtcgacatctaacgcatttgaccaatgtttgctttcagtccacgcttataatttgtgaactggccttggtatcccaatctagcgatagggtttatccatttatactaaagaaggctctgtacttgaatctccttttcaatttgggtatttctctccctactcaatacttagcttattttaaaagtacattttcaatgggcaaccagcttttctattacatgtttcaaattcttctacagctcttcttgatattgcagaggtactatcatggttctagtaacgaaaggcttactgttattagcggacaaactgctatgattttagaagtgctccttcttttcaattctgtggcaatttttatttatgatctatgcatttttgagccaattaacgaattatctgaatactacaagaaaaatgggtggtatccccccgttcatgtactatcctatattacatttatctggatgaacaaactgattgtggaaacttaccgtaacaagaaaatcaaagatcctaaccagttaccattgccgccagtagatctgaatattaagtcgataagtaaggaatttaaggctaactgggaattggaaaaatggttgaatagaaattctctttggagggccatttggaagtcatttggtaggactatttctgtggctatgctgtatgaaacgacatctgatttactttctgtagtacagccccagtttctacggatattcatagatggtttgaacccggaaacatcttctaaatatcctcctttaaatggtgtatttattgctctaacccttttcgtaatcagcgtggtttctgtgttcctcaccaatcaattttatattggaatttttgaggctggtttggggataagaggctctttagcttctttagtgtatcagaagtccttaagattgacgctagcagagcgtaacgaaaaatctactggtgacatcttaaatttgatgtctgtggatgtgttaaggatccagcggtttttcgaaaatgcccaaaccattattggcgctcctattcagattattgttgtattaacttccctgtactggttgctaggaaaggctgttattggagggttggttactatggctattatgatgcctatcaatgccttcttatctagaaaggtaaaaaagctatcaaaaactcaaatgaagtataaggacatgagaatcaagactattacagagcttttgaatgctataaaatctattaaattatacgcctgggaggaacctatgatggcaagattgaatcatgttcgtaatgatatggagttgaaaaattttcggaaaattggtatagtgagcaatctgatatattttgcgtggaattgtgtacctttaatggtgacatgttccacatttggcttattttctttatttagtgattctccgttatctcctgccattgtcttcccttcattatctttatttaatattttgaacagtgccatctattccgttccatccatgataaataccattatagagacaagcgtttctatggaaagattaaagtcattcctacttagtgacgaaattgatgattcgttcatcgaacgtattgatccttcagcggatgaaagagcgttacctgctatagagatgaataatattacatttttatggaaatcaaaagaagtattaacatctagccaatctggagataatttgaggacagatgaagagtctattatcggatcttctcaaattgcgttgaagaatatcgatcattttgaagcaaaaaggggtgatttagtttgtgttgttggtcgggtaggagctggtaaatcaacatttttgaaggcaattcttggtcaacttccttgcatgagtggttctagggactcgataccacctaaactgatcattagatcatcgtctgtagcctactgttcacaagaatcctggataatgaacgcatctgtaagagaaaacattctatttggtcacaagttcgaccaagattattatgacctcactattaaagcatgtcaattgctacccgatttgaaaatactaccagatggtgatgaaactttggtaggtgaaaagggcatttccctatcaggcggtcagaaggcccgtctttcattagccagagcggtgtactcgagagcagatatttatttgttggatgacattttatctgctgttgatgcagaagttagtaaaaatattattgaatatgttttgatcggaaagacggctttattaaaaaataaaacaattattttaactaccaatactgtatcaattttaaaacattcgcagatgatatatgcgctagaaaacggtgaaattgttgaacaagggaattatgaggatgtaatgaaccgtaagaacaatacttcaaaactgaaaaaattactagaggaatttgattctccgattgataatggaaatgaaagcgatgtccaaactgaacaccgatccgaaagtgaagtggatgaacctctgcagcttaaagtaactgaatcagaaactgaggatgaggttgttactgagagtgaattagaactaatcaaagccaattctagaagagcttctctagctacgctaagacctagaccctttgtgggagcacaattggattccgtgaagaaaacggcgcaaaaggccgagaagacagaggtgggaagagtcaaaacaaagatttatcttgcgtatattaaggcttgtggagttttaggtgttgttttatttttcttgtttatgatattaacaagggttttcgacttagcagagaatttttggttaaagtactggtcagaatctaatgaaaaaaatggttcaaatgaaagggtttggatgtttgttggtgtgtattccttaatcggagtagcatcggccgcattcaataatttacggagtattatgatgctactgtattgttctattaggggttctaagaaactgcatgaaagcatggccaaatctgtaattagaagtcctatgactttctttgagactacaccagttggaaggatcataaacaggttctcatctgatatggatgcagtggacagtaatctacagtacattttctccttttttttcaaatcaatactaacctatttggttactgttatattagtcgggtacaatatgccatggtttttagtgttcaatatgtttttggtggttatctatatttactatcaaacattttacattgtgctatctagggagctaaaaagattgatcagtatatcttactctccgattatgtccttaatgagtgagagcttgaacggttattctattattgatgcatacgatcattttgagagattcatctatctaaattatgaaaaaatccaatacaacgttgattttgtcttcaactttagatcaacgaatagatggttatccgtgagattgcaaactattggtgctacaattgttttggctactgcaatcttagcactagcaacaatgaatactaaaaggcaactaagttcgggtatggttggtctactaatgagctattcattagaggttacaggttcattgacttggattgtaaggacaactgtgacgattgaaaccaacattgtatcagtggagagaattgttgagtactgcgaattaccacctgaagcacagtccattaaccctgaaaagaggccagatgaaaattggccatcaaagggtggtattgaattcaaaaactattccacaaaatacagagaaaatttggatccagtgctgaataatattaacgtgaagattgagccatgtgaaaaggttgggattgttggcagaacaggtgcagggaagtctacactgagcctggcattatttagaatactagaacctaccgaaggtaaaattattattgacggcattgatatatccgacataggtctgttcgatttaagaagccatttggcaattattcctcaggatgcacaagcttttgaaggtacagtaaagaccaatttggaccctttcaatcgttattcagaagatgaacttaaaagggctgttgagcaggcacatttaaagcctcatctggaaaaaatgctgcacagtaaaccaagaggtgatgattctaatgaagaggatggcaatgttaatgatattctggatgtcaagattaatgagaacggtagtaacttgtcagtggggcaaagacaactactatgtttggcaagagcgctgctaaaccgttccaaaatattggtccttgatgaagcaacggcttctgtggatatggaaaccgataaaattatccaagacactataagaagagaatttaaggaccgtaccatcttaacaattgcacatcgtatcgacactgtattggacagtgataagataattgttcttgaccagggtagtgtgagggaattcgattcaccctcgaaattgttatccgataaaacgtctattttttacagtctttgtgagaaaggtgggtatttgaaataatgacattgattattatatatgaagatatagaacatttaatgcgctgcaatatgtacggtcacgccaattctttttctttctatatgctttctagtaacccgggtaatcacaaatgaagctagtagagatataactaaatacaacttaattttaaccttatgttggattgctcaagcagtgttcgagaaagacagcggcagacagatagaaatgagctcaaatgaagaggtatttactcagataaacgcaactgcgaatgtggttgataataagaagcgtttacttttcgtgcaagatagctcagcacttgttctagggcttgttgcaggatttttgcaaatcgagtcagtccatgggtttatttggttcctgattctgtacaacttgattaatgtcatttacattgtttggatctgtcaacttcaaccaggaaagttctaccaaagcccacttcatgacatttttttcgaatcgttttttagagagataactggttttgtcatggcatggacatttggatacgccctaatcggatgaacatataagaactacttctataaacggttagaaacaggcttgatttattatgtacagtaaatataatgttatttgtgttttttttttttaaatttttttagttccttctatgtaaaaagacatgacaacagtattctcagtcaaatgatttcaaatacacaatgttaaattctctatctgttgcagaaataagaagagcgtaagagcgcaaagatttttgcagaaaaatagagatgaggtacaaaaagtaggtaatggaaaaaagcaaataatgaatataggggaacataaatgttatggacaagagtagatatcaaaataaaacaaaataaaatagagtaagtgaaagacaaatggaggaaaaaaaaaaaaaaaaaaaaaaaaaaaaaatagtaaaaagtgaaaggagaacgatgataacactaatcacacctccgcattttcaaccaatgctgcaagtttctcaacactggctaaatgtctatttcctagggagttagatttgtttagtttatccaaatatgctctaatggcaatgacgatcaatttcttaccctcaccctcagagacattaactaatttttgaatcacatagttggcaaattgatccttgatcattaaaatcattggagaatcgtcttccagattcaaagcatgatttttgtctcttggtaaaatcttagaaattattaaatccttctgatttttagagccataaagaatagatttttcgaccacgttggaggcaaatttatgtttagagtattcgacaacattattggccacagtttctatgatttcctgtttgatatcgaccatttccttattggtgaactgatcttgttgcaaaacatattgaatgacatagttaccatattggtcttgaattagatatggtatgaaatctttcaattcgtttaaaatgctttcctgatcttcgctcgaaccaaattctaacaatctttgaatgaccctacagccgtaggagtgggtagatagatggtaaatgtggccagttaaagaacttaagataaaaggtaatttttcgataggaattgtttcgatggccttttgaattacgtgattaccgttctgatctttgatcatttgcaaaacggagtcagataattccaggactaactcaattctttgattggaatcaatatattctaacgccttttgaattacacgacatgcgtacatttgtagagataactgtttcatgttacctttaaattgatcaaccaaagtatttttttgaattttgctaccaaattcaaaaaacttctgaatgacgtaattaccaaatacatcgttcgaaagctcaatggcgtcatcgcgaatttcattgaatatgacctccttttctgaggctggtgaggtggccaactcgcgctgaatgaaccgtgaaccatgttgatctttgcaaaactctaaggaatggccaaagatgtcttttagtgacatgttcgagtttgaatttttgtcagaactactgtttcttagttgctctaacaacggcgatcgatgatacgtttgctgctgttgctgtagactttgagaatgaggatgagaatgagagtgagatttatggttgttggccgttgactcattagatttggaagaagcattctttttagaggtattctttgtgggtatagaattttctagataaggatttgcctgtttgttggcgttgttggagttatttgcaggatgattcttgttatttcttttcttgaaggttttttcgtccttgggcattttgacaggtataggatttggagtagggtagtaaatataaggattctcctgttgctgttgctgttgttggtcttcttgttgttgttgttgttgctgttgctgttgttgctggggagcagagagtggtggaggtggcataaacatcattgggttggggtaggcaaacgggaacggagaattgtttggaggggacgaaggtgaagaaacagaagaaggtctgtttgccttcttctttttcttaccatttgagtcttcggtgtcttcatttgctggaatctgtactgaaatcatctgggagatgaaatttgaaggagatccgatcaagtagttggggaagttttggtaatgagggccctgatgaaactgattgggtgggaagccgttcatgtagggggggaaattgttatttgcaggcccatcttgttggttaggaagcgcgacatttgtggccccaacagcggctggattgttactaggtctaaatactggtgtgttggctacgttccagatatttctcttggggtaatgagcattttcggactctaaagacgcagatgagcctgaatttgaactggagtggtaaagcgaaccactgttagtagtgttcctattcaatttgttgaagtttttgtcagactcgacattttgctcgaaagtattctgtgtgtctaagctggcgttagagacgctttttgatatgaattgggactgagtattgacagcgtcgggtctatcttgagattccagttcccttgtaccgtcaatcaaagattttccgaacttctcaaaaaacccttccccaccagagttgttgttgtcattgccattgtagtaaacgggaccagcaatggaagctgaatactggcccagaagatggttgaccttgttgtttttcccgagattagccgcagtatgatgagtatgatagttattgtacgatgcggatgacagggaggcagtgtcggttgatctgtactggtaataattgccgccgttaccaaaaaactttttcgagttcgtggagaatggcggagcagtaccaactgatagggcggttttcttgaagatcggtgaagattcactggaaccgtgaagcagcaagatctctgaatctacttcatttgccgtggtgaaactcgaccttctgaagccgccaatttgctgtgatccagcagcaccgccgttcacaatgccggccgcggcggcctgaccgccgttgttgttactatgggacagggcgcttaaagaagaaactatggatgcgagttccatatccatatccatatccatgttcatttccatttatacccgcaatattgcgttattcagaagaaatttaaatgcgtagttcttgtttgttttcttgtttgcttgcgtacttctatgcttatagatatatcagtagcaaggaagtttccttttcaccgcctttcaatgttcctatctttttcttatgtttctctttagagaccagatgaccagaaaaaaattagctaagcagtgttatactatttacagtagatattcaaatatgtgcaggcaccacttatttttctttttccttcttttctttgtttttttttttctcctattcatcaagcttcatacatccaatatacattctcaagtgtgctaatggtacatttgggaaattatcttcctctctccacaatttttagaaggaaaaaagaaatgcagttcagggtaacagagtgcgcaattaccgtagatagcgatcggatgtttatctttagccctctttttctagctcaaaccccggcacgaattttttaggtcttgctgctctgccctcgggcacttttcttcgagaagttctggggcggtctgatcgggaaaaaacgttcccttttcggacgtatcgcaggcaatgtgcaaaagcttattatatacgagaaaagaaacgcgaaggaacgaaagaagatgaaaaaaatgcagcgataaaatgatattgtggttaatctaaatttatatatatatatatatatacatatatatatagaaatctattgttatacacaaaaatacttattttttaatatagatggctgcagataaagtaatagttttatatataggtatatttactgcacaattcacacgatgggtgtttctgcggtgttgaaaagagctaggaatttactagcaacgttcatagtctgctgttttatggcagtagtgcttgttctggcgctggcacaccattttataaatgagcacagagacactaggagttcatcgacccaaatcgaagttgatgacgaaagtaaaagaaacgtacaccatgaccatgttctcactagaaccaatgcatacgcgacgccatacctcgatctggaacatgacaagaaaaacggtatcgtctacgatcatacaagaacggttgtccgtaaaaagaaccacgaagtggggtcctcgtcactgcataaaaacctttttcacaaatttttgacaaagcttatttttaggtttatcgagaaggaaaaagttaccgaaggcgtaacgcaaggaaagttcaataatagtagcaatgaaattgccaatcatgaaccggtttttgaaaaaattcctgtacagtgcgacaatccattacagaatctaatcttatcggaagacttgacattagttgcggatcttaattattattttaaccagtacaatattcaaatagaggaatttagattggagaccgaagatgggtttgttatagatttgtggcacttgataccaaaatatagaacgacagattctgacaagaagaagaggccacccattttgatgctacatggccttttgcaaagcagtggttcgttcgcatccaatggtagaaaatctctggcatattttctgtatcaatccggttacgacatatggttagggaataacagatgcgggtttaggccggaatggaacgaagcgaaagtaccgacactagcttccaggtgggactgggaccttcgcgagatggttaagtacgatctgacccttttgattgataccgtgttagctaagacgcagtttgaaaagcttactttgatctcgcattctcagggcactacacaggggtttatgggcttggtcaacgaagataagtttttccctcccggttcgggatctaaagaatcttttttcacttctaagatcgcaaactatattgccttggcccccgcagtgtatcctggtcccttacttaacgagaaattgtttgttaagcttatgacaaaggaaatcgaaaatccctggttctttggtgaaacgagcttttttgagataatgatgattgtaagaaacttgtgcgttggtgagagcttgttctcctttgtttgttacaccatcttcaattacctgtttgattggaacgataccctttgggataccgcattaagagatcgccatttcctgttttcgccagtccatgtttcagtgaagttgatgcaatggtggctgtcacccgaccccaacaaggtaagttttaaatttggttcccataagatgttccccgacaatgttaagtggttttcagacgcatcaaaggccccaaatatctacttgtttgttccaaagcaagatagattggtggacggagaaagactaatcaatcatttcgtcaatgtggagtcgaatgtcaactacaagatctggtacattgatgagtatgcccatattgatgtcctatgggcacatgatgtcatagagagaattggtaaaccaattttacagaatttgaacaactattactccaagaagccatccagcgcctttgaaagtgattgttcggacacagaggtggaaacggagctggaaatggttgctgagaaggcttgaagaggaagcatgatatataggttaatataaattatacttgggaatacatagatagagggctagtaaatttttagtttttaattgttctttttttttgaagtattgtgtcacaaattgtcgggagttgggacatcaccgtgcataacgatacatttttttgaaaaatttgatattgaaaaaaaatcgatgagtttgaattacattacagttgtataaagcaaccgcatttcattaacgtagtttgactcgcgaagataaggcgttaaaatgaagattaagaccattaaaagaagtgctgatgactatgtccctgttaaaagtacgcaggaatctcaaatgcccaggaatttgaaccctgaattgcatccttttgaaagggcacgtgaatatactaaagctttgaatgccaccaaattggaaagaatgtttgctaaaccctttgtgggtcagttaggatacggtcatagagatggtgtttatgctattgccaaaaattatggtagtctgaataaattggctactggttctgcagatggtgtgattaaatactggaacatgtctactagagaagaatttgtttcctttaaggcgcattatggactcgttactggtctttgtgtgacacagcctcgttttcatgacaagaagccagatttgaagagccaaaattttatgttatcttgcagtgatgacaaaactgtcaagctatggtcaataaatgttgatgattactccaataaaaactccagtgataacgactccgttactaacgaggaaggtttgattcgtacttttgacggtgaatctgcatttcaaggtatcgattcgcacagagaaaactccacgtttgccacaggtggggccaagatccatctttgggacgttaacagattgaagccagtttccgatctatcatggggagcagacaacattactagtttaaaattcaatcaaaatgaaacagatatcttggccagtactggtagtgataattctattgttctttacgacttgagaaccaactcccccacacaaaagattgttcaaacaatgaggacgaatgctatttgctggaatccaatggaggccttcaactttgtaactgccaatgaagatcataacgcctactattatgatatgaggaatttatcacgttcattgaatgtattcaaagatcacgtcagcgcagtaatggatgttgacttttctcctacgggggatgagattgttactggttcgtacgataagagtatcagaatatataagacgaatcacggacattcgagagaaatttatcatacgaagagaatgcagcatgttttccaggttaaatattccatggattctaaatatattatcagtggatctgatgatgggaatgttaggctatggagaagtaaagcttgggagaggtctaatgtcaaaactactcgtgaaaagaataaattagaatatgacgaaaaattaaaagaaagatttagacatatgccggagatcaaaagaatcagtagacatagacacgtgccacaagtcatcaaaaaggctcaggaaattaagaacattgagttgagttctattaagagaagagaagctaatgaaaggcgtactagaaaggatatgccatacatttccgaaaggaagaaacaaatcgttggtaccgtgcacaaatatgaagattcaggaagagataggaaaagaagaaaggaagatgacaaacgtgatactcaagaaaagtagttattctgttttatgttgtctgtatatacacatatgtacaatatttgcatttttttaatttttaattcacatgtatttgataaatgttcacgccagtcccgttaaattaaaattaccattttattagattatgaatttatatatgaatacattgtgtcgtaatggtagaagaagttgaaaaaaaaaatgtcaagggacagcatgggtacagtgtgttgagccaaaaaaaaaaagaaaaaaaaagaaaaaactttttgttctctggttcttttcttcatcttcttcatcttcattctttggtagcgggggccacaagaaattcgggcgaaagtgctcattatattgttacatccaaaattttgcccacatccagtgaggttttcacagaaaggtcttctaaaagaggaataatatctaataattcgttatcatgagtatctgagaaccaggacgaaatcggtattgcatgttggggatgaaaaatataagatgccggagagttatcgagaatgatgatatctgataacggccttccaatctgggataagttttttatatagtttccttcatagttatagcaagcctctctgaataatctgtgatgaatgactttatctgtgtctaatatatcaagcaaaggatcaccgtatcgagagacactagccgtgaagactacaacctcgaataattttccgactctttccaaaaattcttccacaccaggtcttttaatgacatagacattgtgtacttggtcatctatttccacagacaaaacaaaatccgcagatcgtaagtatttgaaagaagagtgtaccaaggtttcatccaggtccagtattaggcatttcttgccctttgtactttcatcttgtggggggagcagagtgttgtaacctggtgcatgatactggccctgctgcaaaagcgttagatcaatatattcttcatcttcatcgtcttcgtcgtcggcatcgttggaagtttcactggcttgagagctgctacttaccctactcaaattcatatcttggataagatggtcagacgatacttgtacagtaggccctcgctgctgcgactgcgactgcgactgtgactgtgactgtgactggggttgtggttgtggttgtgactgttgttgttgttgctgctgttgttttttctgcctggaagtatctttcacagcatctcctttttcctgtacaatgccacgactgcgacggttatcttcatcgtcgatctcttcatcttcgtcaacctcgtatttttcctcgtaaagatcatctttactaattcgcttctctacttttgtcatattattagtagtagtggcggtgacggctgcagtcggcgacgatggcttctttttttcattatcgttcgtgcttatcccagatttaccggtggatcgttcagtggaactgaaagtagcggctgaatttgtcttagaaggaggagagtttgtctgatgtacgccacgggttcggcttttcgtgttggaatgtttaacgcttctgtttttattgagagaactgctctgttgttggcgataagcagaattggaattggattgtgtcgtctcggaagagcagcacagtattgacgatatgaaacccatactgttttgctacttattgttgttaaagcttacgaacacgaatgtaggcaaataaaaagcttggataaacgcacaatgaaaggggaagtgcgattgattatgctataaggaatgacacgaagagagcagactataggctaggcaggcgataaaggaaggagttgtacttgacgacaacgtaataaagagttcaatgaaagagtattgtgagcagtatggttcaacgagcacttcttctcgacacctatttctatactttttcacttaatatacactaactaatcccagacttttttttttttccgttctttccagaaaaaaaagaaacaaagcaagcgtgccctgacttagggtttcctaaaaaagttattaggtttgtgtcacgtgatacgtccttttctggtcacgtggtcttagaacactcttaaggggccaagcacaagaggacagtgctagcagtagaagtggtgtagtagtgatgaggtaatgttaattgtgcatcgcacatatttacaggtagtatatactatagtttgtgaatacctattcttatatatacaagaaatggttgtcggcagactgtcagtaagactaatttgcacttggaacttcgaagccataacccttcatgcactctttgtacttttcaatgaattccttgcatttttcagagtcttgtccattgaataagatgcatgtatcccgctcctccttttctggcttacaaacgcaacatggcttaggtttgtcctcgcactccgcgtggttttcttgttcttgtttcttgtcagtttcagtcattgggtataattgattgtgtagttatctgattgtgtacactaaaattttgtttagttgtactagagacaagtagttaggtggttactagattctgattcgccgctatatatcgtcattttatctttttttgaaggagataggtagggttataacattatccgggtaatgatttgaaaaaaaattttcaaaaaatgcgatgagatgaggttgaaaattgtaagttagaatatgcttagatagtatgagtatttacgttggtaacttgggtttcgaattggagctgtgtgcctacaacagcgtcttatatatatactatggtggtaggaactaaaaaatactctaatttggactttgtccctacaatcagtgacagtgaagacgatgttccaattctagattcttctgatgacgaaaaagtcgaggctaagaagactacgaagaagcggaagggtaagaataacaagaaaaaggttagtgagggggataacctcgatgaggatgttcatgaggacttggacgcggggtttaagtttgatttggacgccgatgataccacttcgaacttccaaggctggaactttctagcagagggcgagtccaataaggacgatgccgaagcttttgtgaagaaggacgttgacttggataagattattagaagaaaaggtgggctggtgaaaatggcccatattgatagtaaacaagaagaagaaaccgagaaagaaaaagtagaaaaagaaaacgatagcgacgatgaggaattagcaatggacgggttcggtatgggagctcccatgaacaatggagacgaaaatcagtcagaagaagaagaagaagaggaggaaaaggaagaggaagaggaggaagaggaggaacaagaagagatgacgttagaaaaaggcggcaaagatgacgaaatagatgaagaagacgattctgaagaggcaaaagccgatttctatgcgcctgaaactgagggagatgaagctaaaaagcaaatgtacgaaaatttcaacagtttgtctttatctcgtccggttcttaagggccttgcaagtttgggttacgtcaagccttcccctattcaaagcgccacaatccccattgccttattgggtaaagacatcattgccggtgctgtgactggttccggtaagactgctgcgtttatgattcccataatcgagcgtttgttgtataaaccagccaaaatcgcttccaccagagttattgttctattgcccactcgtgagttagctatccaagtcgctgacgttggtaaacaaattgcacgtttcgtctccggtataacctttggtctggccgttggtggtttgaacttgagacaacaagaacaaatgttgaaatctcgtccggacatcgtcattgctaccccaggtagattcattgatcatatcaggaactcagcaagttttaatgtggactcagtagagattctggttatggatgaagccgatagaatgttagaagaaggttttcaagatgaactgaacgaaattatgggcctattaccaagcaatagacagaacctattgttttctgctacaatgaactccaaaattaaaagtttagttagtctttctctaaaaaaaccagtaaggattatgattgatcctccaaagaaagctgctactaagttgacacaagaattcgttcgtattcgtaaaagagaccatttgaagcctgccttgttatttaatttgattaggaaattggatccaacgggtcaaaagaggattgtcgtttttgtggctagaaaagaaactgctcataggttaaggattatcatgggtcttttaggtatgagtgtgggtgaattacacggttctttaacccaagaacagcgtttagattccgttaataaattcaaaaatttggaagttcctgtacttatctgtacggatttggcctccagaggtcttgatatccccaagattgaggttgttatcaactacgatatgcccaagagttatgagatctacctgcatagagttggtcgtaccgccagagctggtagggaaggtcgttccgtcaccttcgtcggtgaatcatctcaagatagaagtattgtacgtgctgctataaagagtgtagaagaaaataagtccctaactcaaggtaaagcacttggtagaaacgtagactgggttcaaatcgaagaaacaaacaaacttgttgaatccatgaacgatacgattgaagatattctggtggaagaaaaggaggagaaggaaatattaagggctgaaatgcaattaagaaagggtgaaaatatgttgaagcataaaaaggaaatccaggcaagaccaagaaggacatggttccaaagcgaatcagataagaaaaattccaaagtattaggtgctttatcaaggaacaagaaagtcactaacagcaaaaagagaaagcgtgaagaagctaaggcagatggcaatggtgcacgttcttatagaaaaaccaaaaccgaccgtattgcagatcaagaaagaacttttaaaaagcagaagagtacaaattcaaataagaagaagggcttcaaaagccgtaggtaataattttcatcgtcattatcataaaatatcaacatacttatcactgtcattatattattaatactttgtatttaaatatcattaattcatctaataaacaggggattagtcaaaaattcctttttttttgttgaatctgtagaagtgagtattaataaactgcaagctatatgctatattaaaaggatttttcaagtacaaacgaactgaatggagactcaagctacttgcgggaaagaattacaaaattacattccattctagtaaaaaaaagttataaataaaaaaaaatcgtctgacgacaaatttgtatcttaatcaaaataaaaattttgggttactttctttaacgtttccaagttataaaattcttcatcttcgtcctcgtcgcttggttcaggtggaggcactatgatgtcctgacgaacgttcaaatttatcatctgaacatttttcctcaaatcaaataaagtgtctatttgttctttcgtgtcttctgatatatcttcatgctggaatggagatatcaatttcaatccgtctagccatatatatcttccctcttctgtgtctaaataaaatttcaaaactgtcctgtcgttacgatcttttaattcaactccagtgtacacattggcttcatctaatttgatgtaaacattactgctcgtccgacgactcggtgtagtaagttctatgcttttgaaagaggttatatgtttcaaaacaacaacttttgttctgccattagctaatgcctcagaacctggacttgttaaaattttattgtcgaatagataaggtaaatcgtttgtttgtgtttcgaattctctggctaataaatttgcgtggttatctgaaactatgaggaagtagactttaggcgtgccagcttcaggattcagtgggttctctgcgtaaacccacgttcccttttgcaattgaagaagtctttgatgacgaacgtaatcacgaacctggcctgatagcatggtatcgaagctagcgatactagatgaccaggttcgatactgttcttttttgattgagtctaattgtaatgttcttgcaaatttatatctcatagagtcaagtgcaacaacttgggtcttgagaagggatttcgtctgtattgctgcttccaaatcactggatgacaaacaaacatattttaaagtgataatagctaaatttaacagtgaaaccaaatcactttgcgattttgctaatgattctatccaaaatctcaaaaacaactcgagtgttttgtaaaaacatgtttgtcgattgagaacagcggtagcaatttgtaattttaaatcacgctctgagtctgagtattggttctcttttttcccacttagattgaaaagtcttctaaattggtctgaaagtttaaatattgcttcataaagagggaaatcgttctcgccaaacaacaattgttcagtgtaaagtctcttgaaagacccattaggactgtttaagaatgtgaatgtatcatacgcatttaataaatttatactgggaagatcgcccatttccatttctaaccctttttggaatacggagttatctttgatggctgtaagaagatcagctttaagcgaacaggaataatcatcaatactaaccgaagatagaaaatttattagcctctgctttaacggtacaaattcttcaaggattagtggttgcaagtcttctatgtaaagtaattcagacatggaagctggaaagttatactgaaatagcaaaatgaggattctgggtacaaattctacggcgtgtgatagtgatgtctcacataatgtaagtgagcattttaaaaatagggttatgcatagtatagtgtccgtaaacaacggtatatgaataggtctttgggacaaaagttgtaaaagtattccaatgagctgagagttctctctggagatgtggcagatgctcacaataacttcattcttattagaatcttggcatttaagggctacattaaaaatcctaatgagatttgctaccaacgtttctgaccttagcttttggcaattatcacacaatatagcccaaaatcgggaatctggaattacggttttacataggtatttttcatcacaaaggaggatatagtttgccaataacttttcgtattcatcacttgtcttgttcaaatttttattactgatcagcgtatgatagcaagcttttgattgtgcactcgtaagtgacttgactggctttcctaatttaggattcagtagcacttttatgttttccaagctttcatctggcatctgcctgttatgcttcattgcttatgccgttatttgaggttactttaatctattttcctactgatgacacaattgagtcaatccaacgtggaacgggttgcccttgtatacatttcagtttacttcttttcatgtatttccttaatagtttattttttcactttctgcctatccgtttcaattccgaagaaccgtcaacatccaataaagatcatctacaacaataagtgcccctcataattttctcaatgagatgaaagaactttgagagagtcaatataatacctgtagcctttttctgaaaatgactgatagtgagaatgaatccaccgaaacggattcgttaatgacgtttgacgattatataagcaaagagctacctgaacatttacagagactaatcatggagaatttgaagggttctactactaatgacttaaagcaaacttcaaacaactcagagtttaatgtcagtaaaaacgggagcttcaaaggtctcgatgatgcaattcaagctttgcaaatgcaaagcgtgttgcatccttcttcgttaggatcgttagcaacgtcctccaaattttctggatggtcgtttgctcaagggttttttgtaggacagctaagcatagtgttgttgttcatctttttcctaaagttctttatattcagtgatgagccatctaaaagtaagaatccgaaacctgcagcctcccgtcacagatcaaaatttaaagaatatccctttatatctcgcgaattcctgacttctcttgttaggaagggtgctaaacaacactacgagctcaatgaagaggcagaaaatgaacatcttcaagaactagctcttattttagagaaaacctattataatgtcgacgtgcaccctgcagagtcattggactggttcaacgttttagttgcccaaataatacagcaattccgcagtgaggcttggcacagggacaatatccttcattccttgaatgattttattggaagaaaatcacccgatctgcctgaatatttggataccataaaaataactgaactggatacaggtgatgatttccccattttctcgaattgcagaatacaatattcgccaaattcaggaaataaaaagctagaggctaaaattgatatagatttaaatgaccacttaactttaggagtagaaacaaaactattacttaactatccaaagcctggtattgccgcactccccataaatctagtagtgtcaattgtgaggtttcaggcgtgtttgaccgtatctttaactaatgcagaggagtttgcttctacttcgaacggtagcagtagtgaaaacggtatggagggcaattcaggatactttttgatgttttctttttctcctgaatatagaatggaatttgaaatcaagtcgctaattggctcacggtctaaacttgaaaatattcccaagatcggcagtgtcattgaataccaaataaaaaaatggttcgttgaacgatgcgttgaaccaagattccaatttgtcaggttaccaagtatgtggccacgtagtaaaaatacgagagaagaaaagcctacagagttataaatatttatgtacaaattttttgttctatctttttcctatcttctctgcctcatttttggtgttccagttttggttagtgcaagtggctattctccaagtgacaatcaccaaataaattcattgaatacatattaagatcgaatttcaggtgatacgacttctccaaaaatgattgttcttcttcagaaattcctagtttgtcccttggtagccaaatttcatccgaatttctacaaatggagaaaatatcatggaaagtataactttcttgacagaattggtccttcctttcctctgttagattcgacaagtattccaaagttggtatgcgttgaggcttcgattttatttgtttggagattttggagtgcgtgattactgttagagcaaagacaacaagcattatagttgacaatgtgtattgatcaaaaagagtgaacagcccgagtaaacaaaattccatgaaataaatgcccgcgtacaattgcataagggcctgtatgtacaatttaccgaacgtttcagaatagttctctttgttatattggtatttgaacaagtaactgaaagaaaagaaaaccatcgaaaatgagatgcaacataataataatataataggagcaacaacactgtatatgataccaatacagcccaacactgagaatataggataaatagatcctagttggaaaaataaagatgtctttaacctcttaaattgagcatgtggagtactccttttccatttatagtagaacaattcaaaaagtagctcttttattcttaacaaattaccgcctgcataagccattcccctaatcaaaacaaaagaacagaaaaagtttgcgcatttaggcaagtcgttggccaggagagcagggatactgacaggattgttaagaagcctctcaataattatagaaaatccagaagatattgtaacaactacgaaaagatgaatgaagacaaagacgaaataccaattctggacatcagcttctatttgcgctccagttttcaaccctcgaaggtaactcagccaacggaaaaagtagggtacgatttctattattattattaaggttactattggaatcaaattctttgccacttctcttataaatggagattggaaatgaattatttttgtaaacggtattagtgaggaaatatttggtatttgtgatattaacccaaggaacgcgacaggcaaaatccagcctataatcacaaaaattcgcaatatatttgccgagaaatatttggcacttttccaaaggggtgatgaatcgaggatatttctccaaataatgtcattaacattggggcctattattacttttaaattttgggtgggtagtctatacgaaagcaactcacctataacgtttgacaataatgtggacttgaaggtaatgaacatcttatccatataaatgtctgtgcccgacgataaatcgtcgggcagtgcctgcttggtttctgaagttgctttcaaggaatttacttggaatttaatgagtttttccttgcgtattattttatcaaggattctgtatttcctttctaatattgtttctgtatttacatacagtttagggtaatataacggaaagatgcttgactttttccagcgcagacgaatttttgtgcaatagtatgaaattctaaattgagttaaaaataccaattttttgtactgaaataatagatggtttttcaactttgaaaagaaaaatcttttgtgatttgctatcaaatgcctgtgtattgaaactcttctaaaatatttctctaaaataatctcaaagataatttgttcttttgatttttgtaatttatttaactttatttctaatttgtggactttcttcaaattttttggaatgaaatgcgtcacgccaaagcaatcactgtgtagcggctgaaaaaaagtttctaaagaaatactttgggtaaccaatttacttgagaatccttccaaatatagaatgttttggtatttacttttcgtcaaaacggaatatcctagtcgattaacgaacctcagttccgaagaaagaatgaagtgaaaccagagtacaacaaagatactcaaaaacaagtgacagattaaagtattcgatgaattaggtgatagatttgacatggtccacttgtcaagtttacttgtcgtcctgaaactttgctcataacgttcaccttcattttctttcaaaatatccctggaaaaataatggattggaattagtattggaatgttgataattgataacactgcaaaaaagaatatcaaaagtttgagaaaccgtaaaaatagataattgtctaggccatacctttcgtttcgttcgaatttttccataggatctaacattcttccgggaagttgcttgagaaatgcaaataatgaccaataattttttatttttttcttagcaaaacaaactttagaacctggatggattttcagaacgacattggcctgatatatagtcttgaatcttgatcttaaaataataaagagtgacagctgaaataaaaagtacaaaaaagaaaacaatataccagatatgaacccttttagtgagattccagcatgtctttgcgcagatccaaatctttctttgtcttgaaatttattcagtaaattaaaagtcagttctttagtagcattcatcttcttggtaagtctttttcttgtttttgaaaaagagttcctgaagtttgtctactgtgaatatactttgcacatttgtttaatttttaaacacgctataatttgtgtcataaagaattttttgtagaatagctttttttttaataggaaaaaaaaataaaaaaaggtggaaaagacaatcttttccagaaacttgaaactatactggagatgaagggttgtcgttggttgcgttacgagacaggcttgacaatttcacaagagtaatgtttcattacctgctgttttattatctttatatttagtaagaccagcagaaacgctacacgtgatgataatggaactaagcattctgttagatggtaagaattttttttaccttccattaccactaacgccttttttagtgtctttttgatatttactgacgtatttttccgcaccgtaatttgaagaaaaagaaaagtgacaaaagatggcattgtttacatacagagtcgtagtatcacaagagtagtccaacaggatgagcgaccttaaccaatccaaaaagatgaacgtcagcgagtttgctgacgcccaaaggagccactatacagtataccccagtttgcctcaaagtaacaaaaatgataaacacattccctttgtcaaacttctatcaggcaaagaatcggaagtgaacgtggaaaaaagatgggaattgtatcatcagttacattcccactttcatgatcaagtagatcatattatcgataatattgaagcagacttgaaagcagagatttcagaccttttatatagtgaaactactcagaaaaggcgatgctttaacactattttcctattaggttcagatagtacgacaaaaattgaacttaaagacgaatcttctcgctacaacgttttgattgaattgactccgaaagaatctccgaatgtaagaatgatgcttcgtaggtctatgtacaaactttacagcgcagctgatgcagaagaacatccaactatcaagtatgaagacattaacgatgaagatggcgattttaccgagcaaaacaatgatgtatcatacgatctgtcacttgtggaaaacttcaaaaggctttttggaaaagacttagcaatggtatttaattttaaagatgtagattctattaacttcaacacattggataacttcataattctattgaaaagtgccttcaagtatgaccatgttaaaataagtttaatctttaatattaatacaaacttgtcaaatattgagaaaaatttgagacaatcaaccatacgacttctgaagagaaattatcataaactagacgtgtcgagtaataaaggatttaagtacggaaaccaaatctttcaaagctttttggatacggttgatggcaaactaaatctttcagatcgttttgtggaattcattctcagcaagatggcaaataatactaatcacaacttacaattattgacgaagatgctggattattcgttgatgtcgtactttttccagaatgccttttcagtattcattgaccctgtaaatgttgattttttgaacgacgactacttaaaaatactgagcagatgtcctacattcatgttctttgtcgaaggtcttataaagcagcatgctcctgctgacgaaattctttcattattgacaaacaaaaacagaggcctagaagagttttttgttgagtttttggtaagagagaacccgattaacgggcatgctaagtttgttgctcgattcctcgaagaagaattgaatataaccaattttaatctgatagaattatatcataatttgcttattggcaaactagactcctatctagatcgttggtcagcatgtaaagagtataaggatcggcttcattttgaacccattgatacaatttttcaagagctatttactttggacaacagaagtggattacttacccagtcgattttcccttcttacaagtcaaatatcgaagataacttactaagttgggagcaggtgctgccttcgcttgataaagaaaattatgatactctttctggagatttggataaaataatggctccggtactgggtcagctattcaagctttatcgtgaggcgaatatgactatcaacatttacgatttctacattgcgttcagagaaacattaccaaaagaggaaatattaaatttcataagaaaagatccctccaacaccaaactcttagaactagcagaaacaccggacgcatttgacaaagtagcactaattttattcatgcaagcaatcttcgcctttgaaaacatgggtctcattaagtttcaaagcaccaagagttacgatctggtagaaaaatgtgtctggagaggaatttagataaagaatgcacggataaataagtaaataaataaccatacatatatagaaccatagaaccacgtttttgtaatgaacagtctacctgtatctcatcatttttctgtgttaactattattattattattatcgaatggagggtaatattatgtataggtaaaataaatagatagtgccatgatgcgcgaagattggcaatgggaaactcaagaaggcagcaacaaaaaaataaaggtggcctattaatcacaatctattgcctatatgtgctaggttatgggcaaattcggcacgacaaataaatcaacggagaatcttctgcgtgataaattcgtacccgagacatctccaactaatattcccactgatgtactcatcaagcaagggcaaataacggattccaccgaatcactaattcatggaggcgcagaaaggtatattgttaacgctttaaagcctatagaattaaataaaactgaaggctttttcgaagacccgccgttccatcttccttctccaccggttgattcgacaaatctggagtatgaagacgttaccgatcttcctaagaatggtttacgatatgatttgaatgatatatccgttgaggtaatcgaagatttataccgccagattgaagcttttttggttcatttcaaactatccagaagttttttacaaattttcaaaaactatgtcaatattcttattcaagaaggcatcaatcctttacgcgatgagtacttcacaatattggaagatgaactgaaaggttttttcactttcaattctgttatagaagagattttagaaatatttttaatccaccctcgcaacaaattcattgcattgtcccttgcagaatatacctacgctaagaacaaaatcagaagacattttaatcactggaagactgtatgtgaattgaatgaagaggcaaacaggtttgcaaatcaagcaaagctgagggtacaggaagccgtcttctatatttggagtgataaaacattaaaatactcacagatggccaacgatgaagctgaaagttttaggaatacttggctactatttcgctcgttccaacaatggataactttaacacaaactcttaaggagcagtcaaggttagcagatcaggcctttttgaataagatgtttaggaaaattttaaaggcacaagagcattggaaacacttagaaactgttaacactgacaacattaagaagatatttttacgaacaacatttcatatatggaagctaagacataaagaaataaactaccacgggttggaaagaaggattttcgaaagaataaaacagaaagttataaactatgaatacaataagagcattgcagaaaaagtgaggtcgttttctctacaaagaaaatatctgaataaatgggaaaagaaaaacattgaaaacgaagataaacttggggcactttatgaactggagaataaattcatcaaacaaaagttttttcgcaaattaaaccggtcatttcaacatagtcaacaagaggcaattgcaaagagtaaactaaatcagacacttttgaggtgcgtttttgagaagatgtggctgaaaagattcgaagaccatctgcatttgtattcaattgtaagtctaaaagaggctaacctcgtgaagcgtatttttcattcatggaaaaaacttctatatattgacctcaaagcaagcgattattcgaggactaatttgctcaagtcatcattgcgaagttggaaacttgaagtaaagttaaaaatatttgagcagaaatgtaaaaagagtattcaagcaagcgcgtatcgtacatggaggaaaagaatacagtatgggaaaatatcgagcgaacatgttaaaacggcattttgtgcaaaatatcttggtgtgtggaaaaggaggatgctacaaatgaattctatgaatgacgaagcatccaaattttacgaagagggtctcgtaaatgagtgtctagctatatggaaagaacgcctgattaaaactaaggaattggaggatagatacaatttcttatgtaagacacatgcaattttgactgtaaaacggacgctaatgcatattgataatgttcatttgctatatacgaaactggcgccctctatggatagagtaaagctttctaaggcctttttaaagtggcggaaagccacaaggttcaaagtcaggcataagttaaacgatattttacacgtttatgaaaagagtaaagagcgcgaacttcaaagccaactgttcaacgcttggcgaaatagattttgcttctacacagaagaatgtaacattcaggctatttcaaagagaaactaccagcttgaaaaaatggtgctgaagaaatttagagaaagacttttagagatagtaaaatcagaagaattagcagacgaagttcgcgaagaatttgtgttagtcaagacgttttatatttggaaaactcatctagacgaaatattttatatgagtacattattggaacaatcggaagctaataaacaattcataattacatccaaattcttgaaaatgtggagtcttcgattcctaaaaattaagcgtaatgatgagacagtcgaggtgtttcgtcatcggtgggacagggccactgtaaggggattgttattattatggaaaaatcgttcagacagttctccaaagagaaggaaggacttcaatcttaaacatgaactaaaaactcccataagatcagactctcaaaacgcctcaaccataccaggctcagaaagaataaagcagcacagaatggaagcgatgaagtcgcattatagcagggcaagaagagccataccaagtccggtgaaatcttccagtgttcttgattctacagctaaaaaacagatcaaccttgaaagtacgacaggcttaaacggatctccgacgcgaggaaaacctctaaggtattctcctaggcgtaccactagaaacatgccatccaaagttgaccatattgattttggcagaatacccgctgtaccttttagcctaagcgccaattctcctaaaatcgatcaagatatggattatataagagagcatgataaatccccgttaagtcgtaaacgtcaatagatatatatattatgtacgtatgtatgtgtgcatatgtagtcgtaacctttcttgcttctgagatgcatacaattactaataatattctccaggtctatgaaaacatcacaacatactatacttttcgtgttcgcgttgtaagctataatggaaaatggacgccataacgcattacttaacaaactacagtttgtcaatagagttgtccagtagagttaaaaggtcaattcaaccggtcttcaataagacatgtcactgaatgacttcctaagttccgtgctacctgtcagtgaacaatttgaatacttatcgttgcaatctattccgttagaaacccatgctgtcgtaaccccaaataaggacgacaaaagggtcccaaaaagcacgatcaagactcaacacttctttagtctatttcaccaaggaaaagtttttttttcattagaagtgtatgtgtatgtcacgctttgggatgaagcagatgccgaacggttaatatttgtatcaaaggcagacactaatggttattgtaatacgagggtaagcgttagagatattacaaaaataatattagaatttatattatcaatcgacccgaattactatcttcaaaaagtaaaaccggcaataagatcatataagaagatatcccccgagctgattagcgcagccagtacgccagcaagaactttaaggattttggctagaaggcttaaacagtcaggcagcaccgttttgaaagaaatagaatctccacgttttcaacaagatctttatctctcattcacctgtcctcgtgagattttgaccaaaatttgtttatttactagacctgcatcccagtacctcttcccagattcttcaaaaaacagcaaaaagcatatactaaatggcgaggaactaatgaaatggtggggctttattttggatagattactaattgaatgctttcaaaatgatacacaagcaaaattaaggataccgggcgaagatcctgctcgagtaagatcatacctaagagggatgaaatatccactatggcaagtgggtgatatatttacctctaaagaaaattctcttgcggtatataatattccattattcccagacgatcctaaggctagatttatacaccaattggcagaggaagatcgcctcctcaaagtaagcttatcatccttctggattgaactacaagagcgtcaagagttcaaattaagtgtcacatcatctgtaatgggtatttcgggatactctcttgccactccatctttatttccatctagtgccgatgttattgtaccgaagtcaaggaagcagtttagggcaatcaagaagtacattactggagaggaatacgatacagaggaaggcgcaatagaagctttcaccaatattcgtgattttctattgctcagaatggcaacaaatcttcaatctttaacagggaagagggagcatcgggagagaaatcagccggttcctgcaagcaacatcaacacgttggcgataacaatgctaaaaccgcgtaaaaaagctaaagccttgcctaaaacttgatacatattgatatttattatttagtacacgtatgtagcatcgatcttagaaaatgcatgtttgtatttattgttagtaccttgatcgccacctttctaggtaatgataggtcctcaacttttactacgcggtgcacgcctgtaaggtcgggcaaaacaaagtgtgggaacaataaataagagggtaggatgaaatattacctttactctactgctcaggttggccacaatttgctaaagagtttatcattaagtagctaccagcgaatctaaatacgacggataaagaatggctagtttagaagatcttattcctactgtcaacaagctgcaggatgttatgtacgactccgggatcgatacactcgatttgcccattttagctgttgttgggtcacaatcctccgggaaatcctcgatattggaaacgttagttggaagagattttttacctaggggtactggtattgtcacaagaagaccgttagttcttcaacttaataacatatctccaaattctcctctaatagaggaagatgataactcagttaatccacatgatgaagttacaaaaatatcaggattcgaagctggtacgaagcccttggagtataggggcaaggaaagaaatcatgcagatgagtggggggaattcctgcatataccaggaaaacggttttatgatttcgacgatatcaaaagagaaatcgaaaacgaaacagcgaggatagccggtaaggataagggcatcagtaagattccgattaatttgaaagtgttttcccctcatgttttgaatctaacgctagtagatttgcctgggattacaaaggttcctattggggaacaaccacctgatattgaaaagcaaatcaagaatttgatcctagactatatagccactccaaattgtttaatcttggccgtctctccagctaacgttgatcttgttaattctgaatccttaaagttggccagagaggtagaccctcagggcaaaaggactattggtgtcattaccaaattagatttgatggattctgggactaatgctctagatatcttgtctggaaaaatgtatcctctgaaattggggtttgttggtgtagtgaatcgctcgcaacaggatattcaattgaacaaaaccgttgaagaatcattggacaaagaagaggactatttcaggaaacatccagtctacagaactatttcaacaaagtgtggtacgcgttatttagctaaattgctaaaccagacattattaagccacattagagacaagcttccggatattaaaaccaagttaaataccctgatctctcaaaccgaacaagagctcgctagatacggtggcgtaggagctactactaatgaaagcagagctagccttgttcttcaactaatgaataagttttctacaaacttcatttcatctatagatggtacatcctccgacattaatacgaaggaactctgtggtggtgcccgtatttattacatttacaataatgtttttgggaattctttgaagtcgattgatccaacttctaatttatccgttcttgatgttagaacagcgattagaaattctactggtccccgtcctacattatttgtacctgagttggcttttgacctattggttaaacctcaaattaaacttttactagaaccatctcaacgttgcgtcgagttagtttacgaggagctgatgaaaatatgccataaatgtggctccgctgagctagctagatatcctaaattgaagagtatgttaatagaagttataagcgaactacttagagaaaggttacaacctactcgctcttacgttgaaagcttgattgacatacatcgagcctacatcaatactaatcatcctaattttttaagtgcaacagaagcaatggatgacatcatgaaaacgcgtagaaaacggaatcaagagttattgaaaagtaagttgtctcaacaggagaatggacaaaccaacggtattaatggtacttcatctatctcttcgaatatagatcaagattctgctaaaaacagtgactacgatgatgatggtatcgacgcagaatcgaagcaaacgaaggacaaatttttaaattatttctttggcaaggataaaaagggtcaacctgtgttcgatgcatcagacaagaaaagatccattgccggtgatggaaatattgaagattttagaaatttacaaatatcagatttttcactgggcgatatagatgaccttgaaaacgctgaacctccactgaccgagagagaagaattggagtgcgaattaattaaacgtctgattgtttcatactttgatattataagagaaatgattgaagatcaagtaccaaaggcagttatgtgtttactcgtcaattattgtaaggattctgttcaaaacagattggtaaccaaactctacaaagaaacactgtttgaagaacttttagttgaggatcaaactttagctcaagatagagaactatgtgtgaaatcactcggagtttataaaaaggctgcaacccttattagtaatattctgtaattgcataattcatctcatttttgatcttacttcaacattgcgggcgtgattataggtcagtgtttattcctttactcagttgatgatttcaaatgtgctctcctctccattctttttcttgttaataaaaatccataactaaataaataacaaatattagcaatcgcaaaagtattaactaagctagagaaccttcactagagaagctctacctaaaggtatagaacaggaaaaagtgtttttattttggcggacttcgtggaagattgccttccatcaataataagcgtagtccataggtacgatcatttcctttttaaccgttaagcaagcgacaagatgtattttgtttaccagcgaatgctcttatttatcttctgcgcctttccaataatctaattatcaatgctacgaatgattatagttttaactagatgaacgaaatttctaggttattaaagagtacgttatgcatcaaaagaatatcagtcataataagcagatagaccttctacatggtttgtagacaaccaaactggtgtatgctaatatcaacgagtaaacgcttacttttctaaagttgaatatttgaagtacacacccgcgtaaagagtttttaccccgaaaacaaatttttatgcttgaaaaatagctaataaaatgtttttattgttcggataacaaatacaatagtgttattaaaaaataaaacttatttaaaaatagtaatttaaattattattttattttaataaactttttaataatatttattacacgtgatttaatatatcctgtttttttttcatcattctctttctttcttatgttaacctcgtactacaagttttctccttataaaaagctgactaaaattagagattgataatcataaataaatttagtagccatttccatttttacattttgatttaatcgacactcaaagttcttatttgaaagctagtttagaacttatttgtttgctccttgatgaatataatgagaagaaattccactcagattaaatatgaagattgttaacggcaagacgctaaaagaaaaggaaaggaagtagatgatggcaaataaggtcactttcttgttagttacatatactttcacagaaacttgaaaataaccacaaaacttaaaacgaacgttattttgttcaattgcttaatttgtgaagatattatctactacttaaatgatatattaacacttatgaggtactgacactgcgaccgcccttttgatctgatcccacccttcgtatatctctgggggtttgtatagcgttcacagaatatgaaccttcaaaagtgggttgagaaagtggtgataaatgcgctgttgccgagtaagaagggttgtggattatcggagagtgttgaatcagtggtgttgttgctcgatcatttctccctctttgatttttgtcttttacttttccacccctggtaattattatgcaaaacaataaagaaatggctatggtaacacctattataaccccaaatccaaccgctatccctggcaagcgcagatggtatttctcgctgtttagccaagataaggatatgggtttgtcgatcagaaatatgcatgaacttttcaaattagtagtgcatcctgttttaagaactctaacttccttggtccagtcgccctgtatgctaacaaaaacgttgtccagatgatcttttctgcagtttagttttgtacctagtttagtgctaatggagccattgcagtctagtaggttttgcgttacattagcaggaatcaaatggagttcgaggaattttcttaagtttgtcgagttcgccgtgatgccacttaatggaatagaagaagccgttggaactaaaagcgagtactcttcgttattccaaatgattgaagaaaggtcataaaacaagttaaaaaagtcaaatatttcttttgttccagtagtttctatcagctcttttagggatatctccaaatcgactggaaaatccaattggtctataggatggataactccctggttgaaaaatatatcggaactctcctcaataataatactttcctttatagtactcactgagattttcgtaaggttttggcttcccacaattttttgtacgccaatagatacagaatttccgtataaattcttgacagtagtcgaaatactataattgttggaataaataaggtcttcgaagattaggttcctcataagtaaatttagggcggttttgtttgacctcaaatagtctatagtcaaatcattattgtcccatgaattcatacatggaagaagtatcgtgtaccccttatgatttgatggtagatccaaaaggttaagttccttcaagagcattagggaaatagaacagtggttttctggtgctaatgacaacactaagtcgcccggtaattgaagatcatcgtcaatagaataaatggacgtattaccaatctcataaggttttgtgtttaaaatcttgaagcgaccattgatgtaataacctttattagaccttgtgattttgaacttttggcagtgtccacctagtcttttagctgaagagcaaaaggcggagtcataaatttgggtaggtgcgtattgaatcgggcgcaatgaggaaaagtcctgttcaaggtcaattttaccttctacaaaatggtacagaagtgatggttttgtgtacccacgatcctcattaaaagaggcttgtggtacaaatatggtgattttccttccgttttgaatgaatttttcaaggtctctgaagtataactcctttacgaattctgagcagttcaaaccgtgcaagtacttttcagcatcaaactgtatatgcgttcgtaaaaagtctaagtcagaaaatccatgcacgacgcctatttcaaaaattctgtttgatatgggtgagtaatctgaattatttacacttactgatgtaccttctgaattactcttcataaaaagttttcgattgtttttattttctaaaattagttccttgggtaaaataccaccatacacgtcatcaataatgagttcttgaagaagggaagttctatctgcggcccatttggcctgagaaattgtattagatttacccaatttattatatttgtcaagtagatagtttatttcgattgtattgaagaattttcgaaaattaacatctaagggcactaaaactgtggatgagtttgtatatgcattatagtttgaaaaactgctgataaaatcactaaatatctttaaatcttgggtttcttcatctagttgtaccagcaactcatttatttgaggttgaattagtaaaagattgttaataccttgtaatgaagcattctggaaactaggcagcaaatcgggttcgacaacagcaatttcattgacaaagcaatggcgctcatgctttctcagcaataaaggtgcttttgcagctcttttctccaggtaggtaccgttttcaaggtctctcacttgcaataccctatcatgaataaggaaatcttcaatatggaaatgctcctcaaattggtctgtggtttggtcccccttaataaatgctgaattaatcggagcaaaaagtgtaaagttctgtagctcatttaagtactgtacgtgaccagttttctgaataatccttaaaaaagttgagaattcaacattttctgagaggatatctattactgtgctaaatggaaaatcgtcccctgggttttgtagaagtgcttgtgtaagccctaatatcggcagtagccaaaaaatgtatttaattgtttggattgccatgttcatcaaagggctccgtttgattcagttaatacatgctgtcactcacagcagcttagataagaagccgttttgtcttattttctaggcccttaatatacgcctaatggggaagtccgaccgaacaaaattctcctaccgggttttcacggtaatgttcttccataaaaaaagacaatatagtaagctgttaatattgatttggtgaacttgaatctgatatttgtttctattgcttacgtataatacttttgcggtaattcattcaaatttcatacaatgctaatatttatacaattctactcgacacggcaaaaatgattggctaacgataatcgtggctctttatatacttaatatataggatctagctatttagaacactctttagatctagatgatagagagcgtagcccctttgtaactacaggacaataatgcttttcaagaagagcattatcccataaggttgctgcctctgggttactccttgaaggattatcggcttccattatgaaatgaccgttgcctattctatcctcggaagagtaaaggcctgaaatttctggatatctattcattaatttatcaataaatttaagaatggcaatacttgttttttctggggtatggctgatgcacatgtacaatcttttggtaaacgccgtagccctttctttagtccctgatttagagcggaaaaatacatggtccagagcctttagcagaagttctgctttggtagaaacgttaactgatggttttattatttcgttattgagtgggtcagccaaccttagcgatctataagataattcgatgtctgcatcaagacagatataaggtaatagcgcgtaaagcccatcgacgaatttggacaaatccacattaactttcatatattgtgtatttgaaataagtgagaatgcactaacgatacaaagcaaagccttacggacctcagcagaggaaaggttatcgaattcagtgtcactaataagttctttcattacttcgaggaagtcccctaatagatcaaagttggccatattaccaaacttcgttagaccttccaaaaccgatccaatgagtgtttttgcattgtttttcaagatattcaaatatatagtgaaaacgatttttagaatttcggattggtttctttctctttcctccgcagaaacagcttgctcagcgttacgcatttcttcctcaatttgttgcatctcttttcgagcttttctttgcttcttagaaagatggaccctatctttctttttgagcttaggagcgctaacgttacctttcaatttagtattagggtcatagtcatgtaagacatctaacgataataacatatttaaaacagattcttcgatgttgaagttcctcgtctttagtattttgttgaaaattcttagtatctcgaatgatattgagccctcttcgtcctcatttaatagagtttcaaatgtctggattatttgaatggaagttggatctgttgaaattcttggtttacaaattctacgcaacagtaaagtgaaaatgtctgttctaaagttgaaatgggatgccgttgaaatcaattcttttgcggcttgagtggccaaaatccctaatgaaacctgtataggagcagcattactgggagtttttgaaagactctgtaatcttccgacgtaatttttgtagttataaactaaggcttgctcaaagtttctaagcttggagacttctttagaaactttttccttcttttcagtttcagttagtggtcgaattctatagcctggtatgatactcttaaacacggggaccaaagccaacatggaaaacttacaagtattaggatttttagattccaccattttacatagacgccccaacgcagcagtattttcttcaggctcctccataactttagtgactaaatcggcaatgtcttcttttagttgcagaattttttcctccgtatcaggctcatcctcctttgcctctgcttcttgttcttcattaggtccctcatcatcttctgaagagtcattagagtcttcgtcttcctcatcatcgtcctttggtttttcttgggctttatgcaattttctttcaactttaccgttaacttttataggcaggccttcaacaagatttgatgtatcagaccgattcttccgaggaaccatttcgtaatcctgttcttcttcatcccaggatgagccttttgcgctatatatggtattttcatccatatcttccggtgcattttggaaaacattgccttctaacaaggaatcttcgtgctttcttttctttgcagtcctttcctgaatgcgaaattgagatctatttctcttagccattattactatgatatctccagcttttatcccggaattatactcttatgattgaagacataaaatgccaagtttataccatgaaaatactatatatggcaggcaggtgaatgagatgagataaaattttcagttttcgggcatcgctgaaaaaattcaaaaactaaagtaaaacgacgtcccatggtctactctacggtgaagaaaatgagggaagacattgaatttctgaatctaagtaactacaaaaaagcatacactccatggaaagagtaaaataggataaattggttttatgtagttaaagaaaaaatacattgttatatatggagtttgctgcgcgcctaggcgttctcgaagtttctcctttgattttactttttggaagggctttggacaatttaaagaagataatttgaagtaccccatcaaatgctagaatgaaatatttaatatactaaattaaggctggtatttaaaaacgtaatcttatgtgtagaacctcagtgaaaaagcgctattattaatataacagtattttcacggagctttttttattcaaaaaggttttcaagacttggcagaggacggctgcattctcgaatgataatatagtattatccttaggatctaaataacttgcatcaagaatgatatctaacttttccttaccttggaaaagtaagtcagtagcttctataattttctgcattcttgttggagtggcaataaaatatagtgaatctttatttttgtttgattttttagagctgtcagtaagtaaacgttccacggtggctatgtcatcctttagtttacttttagagaataatttgacgcaatttttgccaccgtttagactacgataaacgtctgctactctaatattagacatagaaaaaacaattttttttggagctacggaaaatttttgaataaaggctgggaaattgcttaatctgcgttcagcgtcaaatttttctgtcgaaagaaaatcatttcttttgaagtaaagttcctctaattctaaaacactcaagtcaggatttttttctcgtatcaaagttgttaggtactcaataattttttctggtgaacttgctggaagtgcttttcgttgtgagacgatatactggctttcctctttctttttctcaattagctttgattttttctgtagctttttctgtcttttcgaaataggtctattcgaatcatcttctgaatttctctcctcttttttcccatctatatcatcaacgtcatcgtcatcttgttctatagacctcttttgtacctttttggttgggggactaccatccttggcgtcaaaaattacttcatgttcggcatcaaaatcataggcgagtccatcatctaaatcatctggattagacattttcagctcaattgtcctgacgatatgtttagaagttagtagcggggatcaaatttcgactttcattgcctcatccatggtcatctcaaaaattttctcttcaattttttggtaaataccaagtgcaatgaatgtttgggtgtctttgaatattgaatattacagactaaaaatattatatattgtaaattaaaagttgattattagtaaatgtacctgaaatttctgttttcgatatcagtcaagtccaaaaattggtacttcttcctttcttgaccttcttgttccttatcacgcttttcgttctccttcttgcaaatgtagccaatgtataattgtaggggaacacaaacacactgagtgaccaataaggcaatctttgctggtatgtaacgtggagcagagtatgccctaaacatctgtggagcaataatacaggagacattgtatacaatcattgtaatagcatttctaaaaactcttttggtgtaaccggaggtgttgcatgaattccagatgtaaatattggtaatgacacaggaaccactgtaaagcaagtacagagaaaataagttaccgatcttatgggataagggtaaactgataagaacgatacaacctataatagctggaatatacatagatgtggttatgagtgtgatatgaccccagcgggacaacatttgagttgttataagaataatcatagccgtaatggcaccaataggcaactgcagtaatgctgtttcgtacttgtcgaaaccaaaagtaccagtgatggtcactgaaaatgtaccaatggcaccagtagaaatttgagaacatgcagttaataaaagcatcggccaagtaaacttatcatgaaggaatagttctttaacttgctgcttcttaaacttctttgtttccaggccagtttggttagctctgatatgctcaacaacttgaattttttcctctttgtttaggaaccaagcattggtgacgttatctggaaggtataagaatgttagaacaccaaacgcaactgtaaccagaccaacgaccaaaaacattatttgccaagaggtgaaagcggtaccatgataatgtaaaaagccaaaagaaattaacccgcccacaatataacctgtaccagcctgtgtggcccagaatccaattcttgcactctgttcagatttagtatagtacataccactaatagcgatacaaccaactgcactcgaggattcaaagagacctaggagagtacgaacgaccatcaacgaggcgtacgtcttacaagcagcatggcaagccaacacgataccccagacggtaataaaagtacctaggattttggaaatggggaatttttgaattaagtaagtgaccacaggttccatgaaaatgtaagcagcagaaaagatagtacccaaattagaaaattcgttacctttcaaatgatctttgatacccatagatgcagcgtagttcagcagagccttatccaaaaacatcagaagatatgtacagcataaaaagggcaggatgaagaggtcaacttttctcaggaccttaggagataattcatgggaaccatagaagttggcttcttcgcctgctacaacatcgtcttcattagccgtggagctttcgtcgagaccgttctgtttcaggaatcttaaagcaacgtccgcatcgtctacattaatgctcgaggtacttacggaacaactatcagcgttagctgccttcttctccacgtccatggatcgttgtgacatgtttttcattgtattgatttgctgacactctcactacttctcagcaacaacaaagtaaactttaatctatcatactttgaactatcttatatacgtgtatatatgcacccgctgagatgctcatcgagattgctcatcacctctgaaaaggctgtctgtcaccaccatgttttccgccggaccaaatgacagttccttaagggaaactcaaagagactatattaactaaggaggatcaaccagatatgcaaaaaaaacaaatagttatgacggcactcgaaccaaccaaacaccaccctataattaatgttgataatgatagcgactcgaaatttgccaataaaacctgtctattacgcgtcatctacttgagagtaatatactggaagttcgagatactccgcacagggtctgggtggtaggtttctttgctattgtatagtttttcaagatacgtaaaaggtcttcatcttatcttatatagatgcaggtgattactagtggggcaagtcggcagctaattgcgtgtgtgcggaaggattgtgcagtagaatggctcctgtagttatttcagaatctgaagaggatgaggatagagttgccattactagaagaactaagagacaagttcattttgatggcgagggagatgatcgtgtagaccaacagcaacagcagcacagttcaagccacagggatagggataaacatgtgcagcgtaagaagaagaaaaggctctcgaatagaaacctgcaaggttcaaatggtgggtacgcttgggaggatgagatcaagagaagttgggatttggtgaaagtggacgatgaaggggatatggcatctcttgtggctagcatagtcgaggccagaaagaaacgtactgctaagaaaaacataacgccataccaaagaggtattatcagaagtttaatattaacactagattgtagtgaagctatgttggaaaaggatttgagaccaaacaggcatgccatgattatccagtacgccatagattttgtccatgaatttttcgaccaaaatccgatatctcaaatgggtattatcataatgagaaacggtttggcacaactggtcagccaagttagcggaaacccgcaggatcacattgatgcgttgaaatccatcaggaaacaagaaccgaaaggaaacccttcattgcaaaatgcattggaaatggcaagaggccttttattgcctgttcctgcgcattgtacaagggaagtactgattgtatttggtagtctttccacaactgatcctggagatattcaccaaactatcgattcgttagtttctgagaaaattagagtgaaggttttggggttatcagctcaagtggccatatgtaaagaattatgcaaggcaacgaattatggtgatgaatccttctataaaattttactcgatgaaactcacttaaaggagctatttaacgaggctgttacccctttacccgttaacaaaattaataagggtttcacactcgtaaagatggggtttccgacaaggatattcgaagatactccaactttttgttcgtgccattccaagttagtttacggcggatacttctgtcccaattgtcatagtaaagtttgttcattgcccacagtctgtccatgttgtgacttgatgctaatcctttctacccacctggccagatcatatcaccatctgatgccgttaaaaacatttgcagaagtacctacaacagaaaaatttcgatcagaagactgctttagttgccagtcaagatttcccatactgaaaaaccataaaaatggtaaactactgacaagttctcgctatcgttgtgaagattgtaaacaagaattttgtgttgactgcgatgtgttcatccatgaaatccttcataactgcccaggctgtgaatccaagcccgtaataacttaacgaaaatctgtcagcgtataacacgatcactcttccatcatataacaaatccaagtagtagagaacgaaatagtttttgatggacatataactacataattattacaaaaataacctcatttaatgtcctattgtttattacgagaaaatcttaatagcacttacggcattaagaatatttattactattttcaatttatcaggcacttattcaactaaaaaaaaaaaaaaaattctttgttttacaataatattaataattattttgaataaatatcgttacattctatcataatgtcctctacacggtacaaccaaactcacaattctatttgagtgggcgagaggtttgaattttttcttactgggctgtgtgtaggggtcatagatgtcgcttgtttgaatgagtgagggttggaaggtgcaataggtttctgtggagatttaaccaaaacactgtcggtcatccggctttctccctgcttccagctgtcaaaatcaatcaaggcttgcatacatccccactctgtaattttcttactaagccagtgtaaattcactggtttagtcaggtagtcgttacaaccagaaagaagtgcttttcttttatccatctgagagttagatgcggtcaatgctacaataatcacgggcgcctgagagaatctctttgaagtacctttttcaagattggagtgtgagttattgagacttttttgaatgccaatgccattttgtttttcgaagtccctaatctgcttggcagcttctataccagacaagacaggcagctgtaaatccataaatattaaatgaagaccgccttccttccaaatattaacagcttcttgaccatttttagccagtttatatgagattttgtgtttcctcagaaaggaacctaagatagcttggttgatgacgttgtcttcaactattaaaacattaattttggggaaaactttttcacttgtggtggtaaaaaggtttggtaaaggatctggtggagaggaaacagcaaaaggtgcgttataaagcgagtttgagtaatgcggcgtttgactacttgttaatattggtgatgcgggcgtaacgtcttcttttcttctttgtacttccgacatgggttgcgttatgcctataccagcttcattaagtgatccgctttcttgcgaaggggatccggtgttcacttctaactctgaatgagtaattgtgtcttcattattgaaagatgaatccgtgtgggccactggtttatttcgaaaatctacccctcctttataaccttttggtaacagcaagattgcttgccaaggagactcggcatccttttcctcatccttcagttcttgtgacgctcttctcaattgctcttcatcagttattaatttaaattcctgagggctgctattgccatctttacctttaagatctgctttatcaccaattgtttgcttaagaccttgttcgcccggagaaatatggtcgtctagatgaaaaacaccaacggccccatggtctgttggttgagttttctgctgcgaaatttcttcattcgtaggaacatagtctacaacatttaagatatctaaaggcggtacatcctggcgtaaattaacattcgaaaatatcagcaaaggctgcgatgcaggttgggaacccatggttccgaatagttccttatatatgttaatagccaattcatccggttcaaagatgattttataagtgcaatcattaactgattctgtggtaaaatttaaaccttttctaatcaacggccttgtgtatttatttttattatgcggtgagacgtatgtaagaccagctgatgccataatttgattatcagaatgaaatttagggtagggtgagactgaggcaaatcgcagtaacggacttttagttgttgctggaaactgtttaggactagtagagtatggtctttgcgggcttagcattggcgcctcgttgggaggaaaatccacattggtagtcgcggccactgtcggcacggcggcaaaggcgtcgtataatgctcctcttttctgcgtaggtttaggatgctggagaacattcctgtcctttgcaaggtcttttgaaagaccaaatgatcctgctgtggggctcactgaactcttggtattgctattaacggaaaggttggcgccacttccagcaccgttactcttacttcgacaactattatcgttagtgttgttactactggtattgtcggcttgattgtcaaatttaggtgcgtagaggcctattgcaatggaagcattatcgttaatttctcgccatcgagtcgaactcagtttctgaaaaaacctgctcttcaaatcatcaacagtatctatttcatcgaactgtacagcaattggttggtttacttcatcagtggagttgtctattcgtagccaaaccttccacagtaacgcagaattgagcatttttacttgtctccccaaaatcgattcgtttttgatttacagcagcctttccaatatttcttatacaaaacggccgaacttgtactcaaaataaacgctattctgaggtctaaaactaacaaaacacgtaatttttctgaataaaacaatgtctccaactagttaaccacagcttggctagtttcaatgtagtcattcctaacaaaaaggcaaccagacctatttataaatatatagccactattaaattcactagaaaaaaagtcaaagattcaatccaggggcgcttttagggcttcggaaagctgaaaaaaatagttaggacactgatatcaataatatagggaatttgaattattggaaaatggaaattaggttaagggataccaaaaaaagaaacgcgataattataggcatggagatgagaataataactatatatgtatgcggttcggtacatattcattgctgactgaagtctgatagtagtcgtggcgaatggaggtacatgaagagcaggtctctgcacctgtaacaggggatgctacagcaaaatatctgctgcaatatatcttgtcagcaagaggcatttgccatgaaaatgctctcattctagccctaatgagattggaaaccgatgcttcaacgcttaacactgaatggtcgatccagcagtgggtcgacaagctaaatgattatataaacgctataaacgtaaaactgaaccttttgggttacaagatcattcggatcaaccacgggattggtagaaacgcagtgactttaaaggccaagcagaattttgagtccttcgaagataatacagcaataagggctcacaataatgattatgcagttttgcaatcgatagtacttccggagagtaacaggtttttcgtatatgttaacttagcatcaacagaagagactaagttagccacaaggtttaaccaaaacgagatcgagtttatgaaatgggccatagaacaattcatgatcagtggagagactatcgttgaagggcctgcactggaaacctcgataattgtgaaggaagtcaaccgtattctagtagcagctacaggagactcaaacctcgcgaaatggcgtaagttcagtacgtttactgtagggtccaccaatcttttccaatttcaagaattaacagcaacggacatcgaagacttactactccgattatgcgaactgaaatggttttacaggactcaggaagggaaattcggtattgatcttcgctgtatagcagaactagaagagtatctaacatccatgtacaatttgaacacttgccaaaattgccacaagctggcaattcaaggtgtcaggtgcggcaacgaatcatgccgagaagagaatgaggaaactggagagaatagtctgtctcaaatttggcatgttgattgtttcaagcattatattacccatgtaagcaagaattgtgatcgttgcggttcatcgctaatcacagagggcgtatacgttatttaaactaaaatacatagctttccgtgttatttacaagacttatctatacaaacatttgattgcccgaagtattttaatctcctaaacggcatgtgattgaacacggttcgaggtttataccacttgtattaggcatatatgcaattgcaataactcattttaggttcccgttttaccttatttgctaataccccttttttccaaaaagtccttagcttcgtttatcttagtggccaaaaatggagaaccacctttgtcaggatgattagctaacataattttcctatgaacctctttcaacttttttttagtcaatgtattttctgtcaaattcaaaatctgtagagcctctttagaattcattttcgggtcaaatccgcctttcaagaaggcagtagtggattttccaccgttaagtcccttcgatattgatttatatgcaccggctgtaaaatataaagttaaaaaggccccaaaacctgttatcacaggatgttctcccatgtagttcaaagcttgatcaaaataaaggtccattccggtcttttgaccctgcgaaccattctggataccgacattaacaccagctccatcaacagtaacgttcgcagagccattagtttgaccaggaatgggtagttgtggtgcctcaatagaattaccagtattactttgagaactcatgatattgtgcgggtggaagtgtttatgcaaccttattaaactgtgctcggccagtggagacgtacaaattccactactattcgtactttgtctagttcaagggtctccgtcgagtgagtcctacgttgattcaaatggctttcacatttggtccgattctcgctctttaaattttttgcccgctcgcctcgaactcagcggagtgaaaaattttcactcgtcttttattaaataatgtatttctaaactcatctcatctcatcccaccctatctccaacttacatcagtttctatcttgatccgtgatataccacttttaagttcttcgacttgtgatttgaaagatattgctattcaagcgtgagttgtccatattgttaccaccacctccccgtgatttacattcagaaactaaaaggaaaaggaagtagaagtttagtaagtataaaaaaatgagaatttatcaatgccatttttgctcatccccatgttatccaggtcatgggatcatgtttgtgcgtaacgatgctaaagagtttaggttctgccgttctaagtgtcacaaggcattcaagcaacgtcgtaacccaagaaaactaaaatggaccaaagctttcagaaaggctgccggaaaagaattggctgtggattctaccttgacttttgcccaaagaagaaatgtccctgttagatacaatagagagttagttgccacaactttgaaggctatggctagaatcgaagaaattagacaaaaacgtgaaagagccttctacaagaatagaatgagaggtaacaaagaaaaggacttcttaagagataagaaattggtcgaatctaacccagaattattgagaatcagagaagttgaaattgccagaaagttggctaaagaacaagaaagagctgaatcagtatccgaacaagaggaatctgaagaagaagaggaggatatggaaatcgacagtgacgaggaagaggaagaacaattggaaaagcaaaagattctgctaaagaacagaagaagaaatacaaagaaaattgctttttagttagaacagaaccgggctaattgcctctttcctttcttttctcatacttatttcatgggataaataagaatcacctgtatactattatttacattacataacattacaataactattttcaagggtcctcttacattcttatcaaaggtattatataatctcagtatatgccaaacgtctgacttaggagttagagatgttcagaaacttctcaccaagtggtgatttgacaaattcacagaaatcacgaacgtcattcctggatagtatcttaaaatcaatgatttcaaaaattggcggactttggtgtattccataccataccccaatgcgaacatccagtacctgcccatttatcaatctcaaatcatctttatgggctgaaaataatctttcgctcatatacaaacgcatctcctctgcgccatttgttgaattgaggcaatgaagatttctaactatcatttgacagaaaaaacctttaatgaattcttcatccgatttacagaacaagaaatctactaatcgaacaacaatcctgaatcttttggacggatgaataatgtttggttccattccgtttccaccgtaaacattgttatgaatatcgtaattcgttgctattttatccttcaaacattttaagtctagaactaactggctcatataacactgtcgtagttctctaaaaagagcaaatagagctgtatgtaaccaatacaatatagtgaattatgtcctagaataagggcattcattattctccatctctgcttcagagaaaaaaaaaagaaaaagaaaaaataacgacaactgcaggactcgaacctgcgcgggcaaagcccaaaagatttctaatctttcgccttaaccactcggccaagttgccatatgactattgatttatatcatattacgagcccaaataatactggggtgttttgacaatcctaatataaacagtcttcgagaagtaaccagttgtcaaaacggattatcagcttgattcaaggaatgttaactgtcctatatcatataaaatatgaatcatactaaatggtggaagcacggatcttggatctaaactaattgttcaggcatttatatgtttgggtagtttggctaagggaggccgggttttatctcatgttgttcgttttgttataggattgtttcatatgtattttatgaacgtttaggataatgtattgtcaggctgacgtatctcattttgagatacaataatttaacctattttatgttaaatattacacaagatgataaatatgtcaactaaaaactttaacgccgagcttggccattacaatatagagcacatgctatgatcaaatgaattagatgaatacaagccaagaaagcatttttttaattacacttcatgcttttgttggaatgaaactgtaaaataccatctgtttagtagtatttgtgttaccagtataccgtcacatgcggtgtaacgtgaggacataaaaaagtcatcaaaattaatgtccccacgttacactgtatatgacagtatatactactgacatgaatactagtcgatagttaatacatgattcttattacaacatgatgattacagtctcgtcttggtctgttgtttgaccctactattttatgctattttttgtatctgatttgaattcaaggcaattgttgtaattccattcttggcataaccctgtgtagattctacagataagctgcttttttctttgagtggtgcccccgttgtttattacccgtcagtatcataacatttgagcatctcacatggttacgaatgtaaatatgaatcaaagaaggtgcaaaatcaaaaaaaatcgaaagatttgacatgcctattgaaaagggaaagttgtatatctatcaattgttaattagttacttggtcatctccattaccagctgaggtgcttagtcgacaaccgcattaaacatgaaagtgggtattataatgggttctgtgagggcaaagagggtatgcccagaaattgcagcatacgtaaaacgtacaattgaaaatagcgaagaattaatagaccagaagctgaaaatacaagtagtagatttacaacagattgctcttcccttatatgaagatgatgacgaactgatccctgcgcaaataaagagcgtggatgagtatgcagacagcaaaactcgatcgtggagtcgcatcgtaaatgcattagatattattgtattcgttacacctcaatataattgggggtatccagcagccttaaaaaatgcaattgatcgtctttaccatgaatggcacggaaaacctgccctggtggtaagctacggcggtcatggcggtagtaagtgtaatgaccaacttcaagaggtactacatggtttgaagatgaatgttataggtggagtggcggtgaaaataccggtaggtacgataccgttacccgaggacattgtaccacaactcagcgtgcacaatgaagagatcctgcaattactcgcatcgtgcatcgaaacaacgaggaataaataaaccataaaatttaactgtagtcgcaataaaagatgaaaagctaacacaattatcataggacactgtaatccagactttaattagtattaagtattgagtacaaagtacaaagtattatactaacggtagtttgggctcttcgattacccatacacttttaatggactaatttcatcaagtttcattcgaaaattttcttaaaatatatatatgcgtagtggtatagtattcatatttcatgaacttatttcataaaaaaagataaagcaaacctaatatttggatcggcgctcgaaattattctcagtattcttcagcattagacatctttaacatatcaatctttaaaaggtttcttcttcttctgtagctcggaatataagcattcatatatgaccatgttgtaacgcgatcgaaccaagcaacttcttcttgtgcaaatttcctagcaataccaggcacacctccttgacgatcaaatgcaattctttcagtctcttgttcaaaatctttttgacataaagccaggtatttttcctgttgttcaggttgcagttgaagatactgctggtaggtgatttctttgtaatagacagtcttcatttgaatatgttcgagactttttctcttaatctctatgaatattttctgtcttgaagctgccgtcttcatagaatgttgttctattatccacctcgaacatggcctttttatacgtttttacattaaacatccccttcatattagtttgttctcgacttaattctactcatgcttctgacattttttcatgccaagaccggccctgaaaaagggtccggatatacggatagcgccacacattcaattaggggaagtattatttgatacattgtcagcacacagcgatttaacccattatttggcatgacaagcaagctattcgacagtgaaaaatgcacagaacattcaaaattatacttataatatgactcttttcttttattgcagttggtattatatacatatatatatatatatatatatgtatatgttccccgagacaatggttttatttccaaaaaaagtgtaagtaagttattttctgtgtataaaaaaataaaagaagccagatgaagtgccaggtggcgtaccaggacttcagctttctttagtttgcataatgaaagtatcacttacagctcccttgaaggattagacgctattaaccccgatgaaaacgcatcaacaaaacctttaacacagtacttatttggtgcaatacatactcacacaaacacctgtagaaaatccccttatatgaaaatcccttttttttcttggcaagtatttctgataaaatgcggacaacattacctgcttagccgcctgccacagaaaataagtaggcttctctgtaaaatggaataataggctagaggtcaaaaacctcctcttcagtcatatctatgtttttaagggtctagggtccaatttgatggaaaagaacaaatggtcgagcatgttaattaatatttgttgctctgtttgaagagtatattataagacgagaggttctttgagggagcttatcttaccttttcttgatttgaaacaatttcattaaatgtaaacaattatcaactagaagcaaatataaagccagaaggaagaatttgctatgaacattaagactttgtgtcatccagaatataaaagaatctccgttgaatcgttattgaatccggtagaggagacaatagactgcgaaaaacctcactctcaaacaaaaatcaatactgctaaacccattagtgcatctttgtatgtcacaacgaataatactgctgttgttcagcacaatgtccaaaagaggaaaggcgtcaccaggagatgtccacagtgtgcggtgataaaaacttctccgcaatggagagagggtcctgatggagaggtgacattgtgtaatgcctgtggattattttatagaaaaatatttttggtttttggcaaggatctggcaaaacggtactttaacgaaataaaaggtgtgagcgtcaaacgaaaagttccaaagagcctctatggagttacaagaacgcgttaagagaatttatttctgctcggaatgttatatacttatgtcaaagcagtgattatacatttatcgactttaaacagttgataacgaacattatgtgttattcgaaagtcaaagtgccatacaaaacaagtggtttctcagttcttgcaatttttctttatcagcgtagtcccagaaaaaaaaatcatcactggaaatgtaagatgaattcaagtatcaagtgccgttggtattatagtttatcaattaatacgtaaatatatatatatatatatatatatatatatatgactatagtggcatacttctcaatggactgttgcttctatcattttatacatgcgttcaactttgaagattatcacaaaaacctcaaacttttcaattaatctgccccggtcatttaagttagctcttttaggactctcatgttttcaaaaaatagattgaaaagagcattggtggccctactttcaatccattgatcatgattcttcgagctatcgctaaaatattccaccggattcagagttctttcctttactgatatcgtaagaagactcgccttcgtttccgttaccagacctgacaaaaaactcatcccatacagatcccgaagtaacctggaaaaggatatccatgatatcttgattattggtatacgactggcaattcaatgcagaagacgtatttgtagaagcactttcatttatcacttgattaccttcgcttacatctaaagtattaaactgggaaacattgctgtgtttttccagttcggtaaaaaattcatctagaggtatatcaaaaggtgctttttcttcaaaattggttctattaaaaaccttgttatcaaaagtaccgtcgtcaaaaccaagtacgttcgtttttttatcataacttgacatgcggtttgcctgagaggttaggggatttgaatccgaaaatatccctttggcatcatttatttgcataaattttaactttattacaactgatgataaaattttgtaactcgtgtaacaggttttcgcagattcgcaaaaacctatcagattcttcagtactatcaacactttttcagtgtactctgacactttttcttgacaatcatttatgttgttttttgagtaaaaatttacgtaaaggtaagtcatacctgtcatgaacatgttatgaactgctacccacgtgtaaccaatttttttattgacacaaagattgtaaaatacgtctatggtgcccttcgtactgtccaggacaattttaaaagcggtatcattcaaagtagggaattttggagaaagtccataaagaatgctcttcgagtaatgatagttcagatcaaaccagatgctgttaaatttgcaattcatcatctcaaagtttttgggaacgtccacttggaaccaacgctcaagctcattgtaggtttcaatccgccagctctcgagatccataaacctcctcggcaattctgcaccgggcgcgtagagtattctcactatactagcttggattcttctgattttatacatggccaatgcgataacttttgaagacggatttgggcttggtaagtctgagtagtcgtcaatttctcggttagttaatgtgatgaaggaatcgtccaaaaggctaggatacctggtggtgatgctttcttcaggtataccaaaaggtcgaccaaaatacgagcaaatttgccgatctaaggagtaaacgcaccaaaatagacgcctgcgtatttctctggtaaaggcgtcataatttttattaattttttccgaatgtagtcctaggtcaaccgttagtcttagtacagaacccatagtataccaaacaccggggacattaggtctcattattgaatagattaccatgagcaaagtgcctgccaatgcctccaacctgtctgaagatgaaaataaagatgcaatatatttagtagcgcgtctcttatatgtcgcgacagtagtaatatctgacttaagtacctgcgtagcatggccaatagcaaatataatgtttaaaaaaaaataaggtatgtgaaattttgtcggtagttcaactatcggacgcatgttgactttttgagatgtctcccaagtgtcataccatggaacatccacggaagagcatacgtcaatcttctcagtaacgttctccctttttggttcagtatgcgcactaaaagcactggtaattggaatttcgaacgcgctatttatgcctgtctgatcagatgccaatgcaatattgggattccagggaccataaataggttcaaagtattttttcaggaaaagttctctatgcagcaaaggtaactgggaattagtatctacaaaaaacctggatatcataacttcagcggcatgtcgaggtggtagttccaatggatcaaagtgtggattgttttcagcctctgcatatccattgtatttctgttccctttgtttaatatcttcatccagaacgtcatctccggaatcttgacgaaaattagttgccgtgaagactaatttcgcaaaggaaatacccgatgaatctcctaaaaaagagttaaaactactttctctcatcgtgcccagcgcactgatctccttattacatcggcgtagctcttccgctcttgcatctgaagtcatagggctgcctgtctcgggtaataaagcgctaccatcttgtttttttgagtttaccagaaattccttgcgttgtacatttatagtctgtgggcttgccatagacttgctcgttatagctgaggatgccatagaattccctttctgaaccaaataatccgccaataagccattatgtggcaatattccctcttctcccaaagatgaaactgaactgtactttttcaaatcaaaaggttcatcatcacttgtagcaggtatatttcctcgtattttcgtgggatctactccatattctttcaacacacgcatcatgacagccaatctatcttccagaaaaaagacgtaagatcttggaacgtcctttccggtggctgggtccaaagaaacacatggtacctctaattttgcacacctcttacagctaggaaactcctgatcacatttaatttttttcaatcgacatcgtttacatgcagttctagatttggaaattcctatattaggagaatctcctctttttgataaatctgttctattactttttttggagttaaattttttctgcttcatgatttaatcatcatcttcgtatgttttatgtactctaaagggttactcctgtgcgaataaagcaaaccactttacgttactaaaatttttcacatttggtattgtgagtattttatgaagctcatcgcggtaaaagaaaaaaatagagaatctgtgattatagtttaaaaaggatgtagacaaaggatatcagcgataaaggtggccataattggacgaagacaaataattcacttccttaataatgaagttgggtattataccttaccaggaaggtactgatattgtttacaagaatgctctccagggtcagcaagaagggaagagacctaatttaccacagatggaagcaacgcaccaaatcaagtcatcggttcagggtacaagttatgagtttgtccgcacagaagatattccattgaatcgaagacattttgtgtacagaccgtgttccgcaaatccctttttcactattttggggtatggctgtacagaatacccatttgaccactctggaatgagcgtcatggacagatctgaagggttgtcaattagtcgagatggaaatgatctggtaagtgtcccggatcaatacggttggagaactgcaagaagcgatgtgtgtattaaagaaggaatgacgtattgggaagtggaggtaattcgtggaggaaacaagaaattcgcagacggtgttaataataaggaaaatgctgatgattcagtagacgaagtacaaagtggcatatacgaaaaaatgcacaaacaagtgaatgacaccccgcatctacgatttggagtttgcagaagagaggccagtttagaggctcccgtagggtttgatgtgtacgggtatggtattagagacatttcgttagaatctatccacgaaggaaaattgaattgcgtcctagaaaatggttcgccattgaaagagggtgataaaatcggatttctactgagtcttcctagcattcatacacaaatcaaacaagctaaggagtttaccaaaagaagaatttttgcactgaactcccatatggatacgatgaatgaaccatggagagaagatgctgagaatgggccttcaaggaaaaaattaaaacaagagacaacgaacaaagaatttcaaagggcgctattagaagatattgaatataacgacgtcgtccgcgatcaaatcgccatcaggtataagaaccagttgttctttgaggcaacggactatgtaaagacaacgaaaccggaatattattcttctgataagagggaaaggcaagactattaccagttagaggattcatatcttgctatctttcaaaatggtaagtacctaggcaaagcatttgaaaatttaaagccgttgttaccaccgttcagtgagttacaatacaatgaaaagttctatcttggatattggcaacatggtgaagctcgtgatgagtccaatgataaaaacacaaccagtgccaaaaagaaaaagcagcaacaaaagaaaaagaagggattgatactcagaaacaaatacgtaaataataacaaactgggttactatccaacaatcagctgttttaacggtggaacagcgaggataattagtgaagaagataaattggagtacctcgatcaaatccgatcagcttactgtgttgacgggaattcaaaagttaacacactggatacattgtacaaagaacagatagctgaagacatagtatgggatataatcgatgagttggagcaaattgccctacagcaataaagcagcattcaaagaagaataattaaaacacactgaaagtgtgtttcttatatatggttatacattcatgaagatgagttcgtaatcgttatcttcttcaaattctgaaagtgtaaggacgtcaccacttcgtagctctatatatctcgctccaggaattacaacgttgttcaaacatgtcccattggacgaatccaaatccattacataacatttcaaaatgccacgaacgttcctgaactggatgacgcagtgctgctttgaggatgtttcttcgggtataccaatgtctgcgacaacgatctccgttctatcgtcgagatctgtatccagactgtggcccagttcacgaccgactaaataacagctcctgccgttcaaatcgtatcttttccacggtcctttatccttgtcattctttctgtatatcactagttcatacatagtcctatctcgcgcctccagtcctagcatatccatgtagttatctggagaaatagcgtcctgcggctccacatgttttaaagctataccttctttgttattcgactccagctctaacagaccggaagggctgaagtctggcataatatcgatgtactgcgatttgaatttcttgtcatcatggccataatttctggtgttataaggtcttttgcgtctgtgaaacatgtctatacgcaaatggagtcggaaatgaagtacaccatgcttgctgtggcttttacgttataccaaggcttctattgtaggacgcctttattgtcaattatgtgaaaagaaagcaaaaaaaagaaaaagaaaaatgaaaaaagatgaacgtgtgaatgaaaaaaaactatttcgagatgagatgagattaaatgaacaggattaagaatacattttctgttgctaagagattaaaactaagcaaagttatgacgaactcagaattaccgagcatattcgaaggaactgttgatttagggattattggtggtacaggtttatataaccttgactgtctggagcccatcgctttgcttccacccatggtaacaccatggggtaccacatcgtctcctgtcacaatctctcagttcgtaggaactaacagccactttcacgttgcgttcatagccagacacggtattaaccacgaatacccacccactaaagtcccatttagagcaaacatggcggccttaaagaacttaaattgtaaagccgttctttcttttagtgccgtggggtctttacaaccccatataaagcctagagattttgtgttaccacagcaaataatcgacagaactaaaggcataagacattcttcatatttcaacgatgaaggcttggtaggtcacgttggtttcggacagccgttctctcaaaaattcgcagagtatatctatcaattcaagaacgagataacaaatcctgaatccgaagaaccgtgccatttgcattacgacaaggatatgaccgttgtgtgtatggaaggcccacaattctccacgcgcgctgaatccaagatgtacagaatgtttggtggccatgttattaacatgagtgttattccagaagccaaattggcgcgtgagtgtgagctgccttaccagatgatttgtatgtctaccgattacgacgcatggagagatgaggcagaacctgttaccgtagaaaccgttattggtaatttgacgaataatgggcgcaatgcaaatattttagcttctaagatcatcgtctcaatggccaaggaaatcccagagttcatgcatactggcgatgggctgcgcggttccatcaagaaatctatctctaccaaaccagaggctatgtccaaggaaaccttagaaagactaagatacttatttccaaactattggtaatggttgccgctaatcatatgtaaaatataaataggagagaaaacatatatagctatggaaagtattaaatgtttttttgctgtttttatattttcccccttggggactgtgagttcatcatatatgcatatttgctacttggaatgtagcccttcctagttacaggggtatgcggcgagttattgtcattgttagcgctcactaatgtgctactgataccgctatgcctctgcagtgtgccaaatacattctttgtgtgtaaggattgagattgtagtttcgtctgttcctccgccatttccctttgtcttgctttcaaaggcgtctctaagcctttgaagagatatgctggatgatttttgagatttgtttgaggaatatgtgttttgttctgtgccatttggctgatcttagaagtggatacgtagtgggggtgttgtggctgcaacccagtatcgacagatgattgcatgtctacccccaggagcttcttttgcctgtcagtgagattcaaatcacttactttgacggtggataagagcttccaaagagaaaacagtatattgagcgagattaataggtggaacaagtagtcaagaagttctgcattcaaccaactgaacgtggtgtgatatatgatgttagccttctttaacgtgtgaaatgtcaacatgtacagatggattctggatagccggttgcaaaactgtctcccaacatgagtgttgttccaaaagaacttgatgaacttcaccagcaggttccagaacgcaaacgcaattacgtttgtcataattctctgcgtctccatttccttgtttaccgttcgccgtgatagctccttgagcacaggactttcaaagttgcccaatttaaacattggtgtgtcattttgtgattgtgatgagggtttgctgtctgtgtccggcaatggtcccggcacgtcattatcgtccaggcccaattggcccgcctgaatcttcatagttccctctattatttttttgcctctgcggatatattaaaagtctgtatattgtcaagttcttataatataaatctttttgttcatcataaccatcttattaattgttattatttctatcattattactattagcacaaatttcattttttttttttttcatttttctttagactttagccctaattagacctgagaaatattattataacctgagaaaggtttataaaaagaacattataacctacaaaaaagatacttaaaccctgaagttaataggtttggaccctctttttttttttttgcttttttttagaaaacctcagtattcacagtctaaggaacagataaagagaagctttatgaaagcagtccacagtgccacgaactttgacatatataattgacttgtgggggctaccgactggcttatatttctaaaatttagagatttgattatctttttcgcagcgcgtaaaagaaacccacgaagcatcgcttaatttacacatattcttcgttctccccttttggagaggatttaagctaagatatatctttcttcgagcgcagtgctgcttttgagttctttcgttttaattttccacttatttggcaataaaaactgagtgaagagtgcttctctgtctgttttagggagctttttcagatcatcatcagatgggatttatagcaaatatactgtgctgttcttcagatacttccaaaacacatcgtcaacgccaaccaccagaaactaatcacaaccgcaaccgcaaccgtaagcacagttcaaacaaagctcaaactcagggtcgtaagcagaaggctactccaaacggcgacaagatgcaatattccacaccggagatccttttgtctagttccgattcaggcagcaatgcgggttccaagacaatgcaggagaatgggaatagcggcaatggaaaactagcacctttatcaagagatcactccaacaactcgtacgatgaggagaaagaatatgaagattataatgaaggagacgtagaaatgacggaggttaacaatgccggagaagaagaagaagaagatgacgaagcaaaagaaaagcaagaccatgtcgttcatgaatataacgttgacgcagatagaaattccagtattaatgacgaggcgccaccacaacagggtctgtatcaggtgggtcaagaagatatgaatccacaatatgtcgccagcagtcctgataatgatttaaacttgatacctacaacggaggaggacttctctgacctgacgcatttgcaaccagaccagtaccatgcccccggatacgacactctgctaccacccaagttgcaagaatttcaacagaaaaaatgtctgatattggatctagacgaaactttggtacattcttcctttaaatatatgcattcagctgatttcgttttgcccgtcgaaatcgatgatcaagttcacaatgtctatgttattaagaggccaggcgtcgatgagttcttgaacagggtgagtcaactatacgaagttgttgtgttcacggcaagtgtttcgaggtatgcaaacccccttttagatacgttggaccctaatggaaccatccatcatcgattattcagagaagcttgttataactacgaaggtaactacatcaagaacttatcgcagatcggaagaccattgtccgaaacaatcatcttagataattcgccggcctcttacatctttcatccgcaacatgctgttccgatatcttcttggttctctgatactcatgataatgagttactagatattatcccacttttggaggacctttcatcaggaaacgtgttggatgtggggagcgtgttggatgtgacgatatagatttctcagtaacataaaaagcaggctctttttattaccccccccttcggttatatgtttggacgaactcatgtttctctttttatacagaagacttcaccggatatttataaacttaatgaattaatttgcttattacatgtatcaattgtactttacgtgtaacatctacagatacatatatccgtatatactagcatatatataaatatatactctatacatatatctatttattatgcttttctttcctctttttatggcatattatattttacaaagaaaccacaaagaaaaaacttttacctcaccttgcattaggaaacctcaaattttctatcattggcttaccaattctatctataacatcatgcgcccataaaacgtccagatgggaatactcatcaatataccagattttgtacactgcatttgcttcatgattaatgaagtgattaattaatcgttcaccatctactaatctatcttgctttggaataaacattataatgtgtggaaattcttcactattttgtcttttcggatttaagtgtagtttgttgttatccaaattattgccactgtcatcatcattcttggcaataggaaaccatgtctttttatctggaaaaattttctctgcacccttcttaaaacttagcttattaggaagaggtgacaaccaccattgcattagtttgacggaaatatggactggtgaaaataagaaatttcggtcccttaaaactctatcccataagacatcgttccaatcaaataggtagttaaacatgatgtatgagaggaacgaaaaaatcttggtcccaaccattagttttctcattgtcatcataagaggtataaacgatcttctaccaaagtaccacggagaatcaataccttttgccattagcctcacaaatgctttttcatccaataaaggtccagggtacactgcaggtgccaaagcaacaaagttttccagcttatcgactaatttaaaatcacttgcgtatagtttctcaccgttgacaagccccataaacccttgtgttgtaccttgtgaatgcgccacgagcgatagtttagcatatccggtactatcaagtacataatttataagtgcttttaaatcgtattgaaccatctggtgcatatcccaatcccattttttggaatgatcattacctaattttttcatgttccacttggcatttaagccacatctgttattccccaaccaaacatcaaatccagattcataaaggaagtatgccagagattttctacctgaagatgcgaaggccccgcaactttgcaaaagaccgtgtaatagcaaaatgggttcacgtttcacttcctctacgccatcgtttaacctggacttgaagtgccacaaatcaatgataaaaccgtcgtctgtctccacctcaaattcttcaatatcaataccatactctttataatagtactttaagtcaggtaccagcttggtatcctccgcaagcgcaatgttttggaagggattctctgcagcatatggggcttggttcacattcgtttccattttaatattagcatttccatcaccgttctctgataaagaggcattactagtcatggacagcttgctagtcacagtacggtcatattcaatattattttcctgatcccgctgtaaatctaagggcgttgtggaagatattgacaaaggtctagagtgacgtgctggtcgtttcttcttcttgtcatttggctggatcttggttctcgaacttcttgtatctcttggatcatttttatgttggaaatgaactgtcacgtaattcttccatagtgacaaaatgaataaccccgtcataaacgaagtgagaattattgcgctcaccaaccgctgaacctcatcaaccaccttatttaccatgcttatcgtaaaggtgccacggggatcccaatgatagttgagtatttcccaacaattttaattatacctttgatgagaaacatttgcgtactatttgtgtgaaaaaaaatgaagaacttaatgcgcgaattattgggataacaacgccaatggtgaatcaaaatattaacaatgacaaaaagaatgggctatttttgtacaaaatactgttgcaaatatgatatcatatgaattccaaactcatctaccgaaaggaaaagatagctcattgaacgcttcatccgaaaacaaagaattgtatgtacaagccacgcactttaataacacaattctattgcaaatcagactaaatggggaaatggattccacctatgaggtatcttcaaaaggactaaacccaattctcgatatcaacgtaccactggcaggaaacctaggaaacacgggtggcgattatgacgatgaggaagaagaatttgtaagagaccatttatctgattatcaagtggttaccaagttgggagatagtgccgatcctaaagtacccgtggtatgcgtacagattgccgaactatataggagagttattctaccagaagtgagcggtacgatggcccaagacaacatgcaattcagcttgctgatatccatgagcagtaagatatggagagcaacgaaggaacaaagcgctgacgataatgattttggcaaattagtttttgtgttaaagtgtatcaaagatatgtatgcaaagtgattctatataaattagttatgcgttgtattatctatgactgccatatccaagacttgcacagttccctttttatcacatagggtcatcaaatctctataattgacaggatcgataagacctgtacatgtccaaggatccaattccggcttcgttgactctccaggcgatgaagctatcaatttactaatcttctcaataagttcgggttgtctagatggctcacttatggccactttgactttcatcttcgcccttactattggaataatttgcttagaaaccaataatttgatagcctctaaagcttgcaatttggcaggtttgttaataacagggctgaacttcagttcctgtaaagctttgtggatcattgtgggcggatatcttttctttgacacaggatttatacatttagcgctaactattgtaagcatttcgttattaactttattaagcattaattgtctttctttttccgataattgaatctctcccttatgcatgatctcctcgatgacatcatcaacatttgtagtcccgaaacacttttgtagatcttccttattagcaaccaagcctttcgaaacattcatgaaaacttgatgtatctgcagcacttcatccagatctttttcaattccttttcgatagtcttggaccttattttggtagcacgcgacttcaaatctcttgcgagccttttttaatctcactaatgaaacattagttaacttaatctgtcccgacggttgattgataggcattgcgtgttttaccttttctttctcagaactattttagtaaaaattttaaaaacttttactactgcatgaaatcacttaagttcggcctagaaaaattttttcatgaacattattatatatacaaggcactgagcaggacaatacacgctaagttttgttctttcatgaggtcataataagttaaataacagtcaatacataaatgcaaaactaaaagtacacagttttattattttcttttcgtcgtaatgtagtttttataatcagtcaactttttttttgcttttagatttcgtttgttccttttgtctttggatccaaagtttcttgaaaatgtagccaaaacaatgccagcaggaatatcgaaaaagatgggtataatataagtaaaaaaaaaattttaacaatgaaataatacaggagaattcgtggtttacaatttctggtttttttcgaaattgctatgtggcttctccaacaatgtaattgtaggcttttctttcttttaagtccgtttatcgtatacagaaaaagtgcaggatgttgtaagtaaaggtagtcagtcataccatcatgacaaaatccacctcttggcaaacatatctaaaatagctctataatggccgatgacacccaacactacgaagaaatgccaaaaagtgtgcgaacaaccaaaatagtcaacccaccatagagatttaaatgatttggcatgagacggacaggaactgcatttggaatgggctgttggcacctctctaaaatgaatttccctttgctttgtgatgatttctaaatcagtagataattcgtagtttgttggaatggtcttatcaacctgaacgtcagatctgaaccgttcaggaatgaacgaaccgtaaaataccacaccaaccaaataccaaacaacagatttgtatgtgacggggctaaatagcgttgcagcataatgaagatcagtcaaaaatatcaaatgtaaaaacgacaatacacccatagtagccagcaaaatgaagaatctaattcttaatggccttgcttcaggtctatcaaagcgaggcgaccaattcataaacacaccaaatacacccagcgccagagaaatactcatgtaagtgtacatcgcccagtaacatgaatacatggtaacaaactccgttgtcaatatcgaagctgtaattaagatcgtaataccgctatagtcgacacacgcaaatttagaacgtagcttcaagaaggacgttccgttgaaagtatgccaaaacacggagcttagcatacatttcaacgcagctgccaaaaacatgaaaacaatccatctagcctgtggtggaacctgggaattccgccaaacttcagactgagggaaatcgtaaattgccaagtagattatataaatggctcctaacaaatgagaccaaatatttgaagtttcattatgccagccgtaccagttaaagatagacaacaaagatttggaatgggtattgtaaaacctatagccatggattatgtatctgttttccctccatgggaatggcaactgataataatgtaaatgttgagtttcacctagactatacgctttgccatggttgtatgagtttataaaagacttgatatcggtagtaggattcaaaggttcttcaatgaggatttccgtctttaccatggattttctcattggaccgcaatagtctttcacgctggaaatataattgttttcctctttgatttttgtatcattgagacgacttgttggggaacgtaacgaggacttcgcttgagaacatacagttgaagatgaagacaccagtgaagtggatgtagaagcattgttaagcttgaaagtagcgactgaattcaccaaagtggctgcatctgaatctcccagtgaaaactgagattctgtattcagagacttgccactgtttcttttgtacacagaacttgttacttccttttcttttgttggacgaattatctccaaatcatcataccgcccactttcagagtgtttaacactttcatcaatagttgaaaatggatgaggaacgaattttgagtagttgtaattatagatggatttaccggattttttcaccttctgaaaattgtccacacccttctgctttagccttgatagagatcccatgggtgagggtatatactgagttaagcttttgcttgacgagtccatcatgtacttaatttgattgtctgttgggatgtgaactatttttcagcttatctgcgttgcagcttcttctttgtccactttacaatggctaaactttaccagacgacaaaacaagtgtagaatttgaatcaactgtgtcctaaagaaaaaataatgtccaaaaactcttattataaaacgagtaaaccaccacttcgctcgaatcgccaagctttctagatgtacacccacgctgtgtcaccttatgactatataccttatccatcaaacactttctccatttcctgcagggtaaaaaagaaaagtgaagtcaccctgcactatacgagcttcagcccataccccacactaaaacatttctttttctgcggcatttctttttttttcggtccgtccctgtcccttcccacgagaaagcgtaatgatcctcgaccctaccccacttccccacgccaattaaaacagataaaatttcttttgatttttcggatacgctaatttcgtagcaattttgaatgactagacatttgttggataactacatagtctcccacccaccaagatctgcactgccgtccgttagtcggaacactatgtgcggaatcatgttgccaaaaacaatctcattcgctagattcgcgtatctcgcccgattcaaatagacgggagtaccgaatttgtagtcttcgttggtctctccgtatttacttagataaggtgcagcataaaatgtacctcttttgccgtatgacagatatatcgcatttgtgccggtcattaagaaaactccgtaagcggaggtgatttcgcatccatttctcatatgatcagtacattccccctgtaaataaccttgcagtgctatgcttttttgaatatggcatttttggccacacaacaagcatactgcgatttcgtatttatcacatttattcgatatttcatcattatcaagggaaaatttggaaaggttcaatggtagttcgataagctggatatgctctggtgaaggatatgctcttgtgtttatgttctgcaccatgtcatatattacttgctgaattctcaaattatcattaccatcattatacctttctatattttgtgttagttcgttgtagaaaaaatccttcaaaaagtgagttaaattgggtaatttaaaataccggaaaataagctctatttcacgctgtttgacgtccatgaaattattgctgcggttattattattatcaccatcaccatcatcatcatactgaatgttgaataataagaaggttcttctacaaaaaatggacaatgactctagtaatagagagcatataaagtctttaattttctctaaacttgtaaaatcaaaccgaacgtcgtctggtttaaagagatcaacatactttttaaaagtattgaatagatatgaaaagcttgtcgatggttcctcagatccgtttgatgatattttgattttatttcgacagtctttgtaaaagtttactctcatcatatctcttgcaagcaacagtagtagttgatggaaccttcttttgaacatttcatagatacataggttaggcggttgcggggtttttcctccatcaatattatcaaaattttgactcatatacaaaagtagattcacattattaccctttattagaaactcattccaattccatattttacgagagatttcgctgctgaatgtttttgaattaacaaattttttgtaaataaacgactttagctcacaaactaaatgtaaggttaaaatgcactgactggatattctttccatattcactatttttccttcctttttgtgcgatcttaatctgagctcagtatttgaaatagtattaataaaaacactattaacaactttatatgcatcttcgatagtcgtgacttttttaccctgaagatcacctagaatcatcgctgctttaatacaaatagagctcattgggtcaaggttttcttccgcttcacttcgcttttcaatacacataaaaaactggctcgaagttctcttatctatatcatttgtttttggtagaaatgaattacttaaggaattgcatacgggacaatatatcaaccctgaaccatacgataatggaatattttttgtagtttggttttgtattccgcgaatcgacttcatatggccacttaaacatttggtatgagacccatgcccgcatgctcttaatactggttcacagctagtaaatttcaatctcgttccatcatcatcctgggggttttcttggattgcactgtcttttgtttgcttaccactgaacagcgaatttattctattaacatctgtaggattcgtaaaatcaattccatgatcacatatgttccgttcttggtatgaaaaataaacaaatacatcgtcatccttcggcatcttgcaaaatacgcaatcatcatcgcagcaactgttgattgtgttactactattctctgcatttattctagtgggagataaactaggtgatgtggttctgggtgtactaatatcggaagtatctacactattgttttccatgaatttcatttgctgttgagccaacttcttcattaattttttctttctcaatcgagcaagatgttttttcctttcaaattctttatccttgtggcttttatcttcctttgtaggccacaatattcctggtgtatatgacgtggtttgctccctcaaataactgtttacatttacgtgaggcgctgtttccattaaatacctgaaaatttccctaatcttaccatgagattccgaaaaattatccttcaacaaacagtaatacaggatagaaccaatgctgtggtaatgacagaattctgtgtccacaattgcgtattcatgccacagtatccccataaattcattcagattattaaccacgcataaatgaatcaaatgaaccactctcggcaataaattgtcataatcatattttataatgtgatctaaagtatttttcaaaaataaaccaaaagtattcactgatgatattgaatacagcccagaaaataatgtattcttcaacaaatctttaaccttttttgctggtacaaaagtatcttcatatttcattttcttcaaatttgccatattcagcctgatatttttctctacatcatacctcctactggaagacaaccctatataataaggatcaatctcatctttatacttttctttcaacacgaaaatgccattgtcagtcaagcttacaggagaagtgtaattggcgtatttttcgagatatatatcaaatgaagggtgcttggtgatatgttctggaatacagttaacaatttgtgcgtaagagcatgtatcaaagcaaagggcatgaattatttctgatttgaacgttctctcgaagccttcctttgatgatttcatgaccaatgatctcacttcagtaagcaattgaatcaataacagaatgcattcattaacaacggctacagttgtttctgtatcaggataatcatacataggtacaccatttgcccagtgcttcaaaccccaccttgagaggtaagtaaccatcagttcatcaggattgcacattgccatactaaattgcacattgaaaatgtcactaatataagtaaattctcgcatactgtattttgtatacatccgggcctggtgagtaattggagttccgtttcttacccagaaaccgacgtttatttgcccgattaggactagggttgacaaagcagattctgatatatataaagccttctgcttatcttgaaaaacttcgaagagattaatgtagtttgtcaaagaagcaggaattggctcatatctaccacattgactccattgaataacaaatttgaacaaatatgacattggattgaaaaaatactgtgtatttacacctacctggaaattaatagtctctgcgacataattgcatatcgtctctctgactgtagacaaagtcgctttgttcgaatcattttcattcgttgatgcgttatcaggtgatatagcttttctagaattggttagtgattcaaattccctggtttgagcaacatcaagtagtttaaggacgatttgcttacggaaagccgcatctttgaccaaagatatactacgtgtgtatccatctgtcattattagtattgatgagaaaaaaaaataaaatgcagaaaaatcaaagttttcaacctccacgtgttctttagtttcccttttcaatggcagcacgttactgaattcagagaaggactcaattattgcgttaaaaattgcctcatttgaaagtagttcttccggaacagtgttcgctgacattatcgtacaaaggtctttaaagcaaataattgtccttcgatttcgtattgtttcggtgggcaacttaaagccattgtataaagagatgggcaaatatgacatcaagtcttctggattgaatgccatgagagtaaaagcaaatctaatagttcgttcaatgaatcccgagcttatagtcatatttgctatgctggggtcttggaaagtgtattgccctaatatactcataagagttacctgacattctttagcatctgatgcaactgcatcatacaagaccgatagataaacatcaatatattgtgcggcaagaaactttctgctttcatcccttaacgagaataatgacgccatgatctttaacattttgaatttagatttttttgagaggatattaatagaattgatgataatatattggaatctagatccatagaaattgtagaaatggcttactgtgttcggcgaatgggctctgatcaacctttcattgtaattagtgagtatttttgaaattctttcgtcttcaatgttctctaatgaccaaggtttaaaccatgattcatcactatcttcgttagatattaagaatccacctaataagttaatcttagaaaagtcaggattggtatttgtgggagatactctcattttagaaaaatgggaataccaaacatctagcatggaaattctaagagcatatttattttgcaaagacgtggccgccttaaagcacagagaatataaccaatctgttaaatcatctgttaactttctcttgaatatatcatccgcttttcttacatgaactactatgttttccttttgaaactccttggctatttgatctatttcgaaaaaattctcactttgtagcacagtcactacatcgtgtgaatcttctaaagccttcgttattgagattgcatattcaaccggtgtattcaaaattctcgttattgtagatgctaaatccatgtagtgtacgttacactcttcttcttcgatttgaatagcccactccatatgtgcttcttttctcgtattggaccaattgttatcaaagaaaacaaaattttcatcattgaccaatggttcacattcgtgtttttccattatatcatcagtaatgctgttttgattaggatgcattagggaggatgcttttctctcgcttgaatgggcttctgcctcctctttgtatgaaacagttacatcaattaaaaaatccagaacataattcaatagggagattacgttttcatcatcggttacgttactattgtcgttagaaataggaatattatttaattcgttcttgcacttgaacgcgtcgcttgggtcattaaaggcaaaggggtcaccacaatggcatattctgccttctgggcgcattaccactttagcaacataagaatgatttacatgtttttctttatcgaaacaaagctcacatatttcatacaatggatttgtggagcacgtaaaacagtaataaattgtctcagaggggaagcataaacgcgtacacgctgttccaatatgcatattacccacagagtggtggtcattctcgaactccagggtcctccactttcttccatttagtatgtctctgtacttttcgttttcccaggcttcagaattgagtattgaaacgagagagcgccagtttatatcgttatcactatgcttaaggcgtagatttaaggttttccatagtaaataactagtggtttcgctatattcgcatttcgcgagtttggggagctcggtaagaaaatctcttatattggttatagacaggtcagaatcttccatgcgtgcttgttaagtagctattaatttagttaacgaatcttacctttactatcagagacgagtaaatgataataattagaaaaaaaagccggctcttttttttaaaaagcttgagcaactttttttttttatagagttgttagtaatatgccaagcaattgaaagtatgaatgcgttgattattgggtttctccccacagatgtacattgacgatgctctttattgatatcgcctaaaagttcaacaaacgccactggaaattgccgccgttgtcaccacaacgtgataagtgatggtgtgctttttgcacatctagtgaagaaacgggcaattaggatctaggaccagtaacacttgccccgcaaatattataacatgggccttatgattgctcggtttgttacatctaacatcctaagaagtgagtggcatgaatacgtagctatatgtagattgaaaattgatgagtcgagtcatcaccttcctctaaacgggggataaattttggcggtattttccctaattttattcttcgttatgtcagccatgtgagactaattaattcaagttttgacttacaattgcggcttcgtcggaaatcagtattacgtataaactgtgtaccataaaattggcgtactcggtattgtttatactaagccggccattctagtgatttcgcctctataaatggttgttattcgagtataatatttcaaccgcatcaaagaaagaggtagatagcttgcgttcaacaccgttcttttctttcccccttaatttagcgcttggcggttatgctatggtgacagttaacttttttaattataggatgacttgtcatattgttatatgccgcatacttatgtaaagtagttattgaggtgggggtgagcagagtaacgacaacgatggagttccgtaactaaccaatgcttaatgttggtaagtaatagcaaatatatatactacatagcttttgttatatgcatcattttatacgattcatgttcgacccttttgataaaagatgggatttttaaataagtcggtgggtgatttcgaatcatgaatagttggcagagcaggggaagtacgagcttctaaagggtaagatattgtatttcggacggaagcagcagaaacataacagtattgataaataaggcatgtggtcatcactttttggttggacatcaagtaatgccaagaataaagagtcaccaacaaaggccatagtgcggttgagggagcatatcaaccttctatccaaaaagcaatcgcatttacgtactcaaattacaaatcaagagaatgaagctagaatctttttgacgaagggcaataaagtaatggcgaagaatgcacttaaaaagaagaagacaatcgaacaacttttaagtaaggtagaaggcacaatggagtctatggaacagcagctattctctatagaaagtgcaaacttaaatctagagacaatgagggctatgcaggaaggtgctaaggcaatgaaaactattcacagtggccttgacatagataaagtggatgaaactatggacgagataagggagcaagtcgaattaggagatgaaataagcgacgctatatccaggcctttaattactggggcaaacgaggtggatgaagatgagctggacgaggaattggacatgctggctcaagaaaatgctaaccaagaaacgtccaagatcgttaataataatgttaatgcggcgcctatctcagagaacaaagtctcactacctagtgttccaagtaataaaattaaacaaagtgagaactctgtgaaggacggggaagaggaagaggatgaagaagatgaagatgaaaaagcattaagagaactacaagcagaaatggggctttgaacgtgttctatgcggtttagatgaaagaaaaaaaaaaggtgttcttactttccatgttctgtatacgctcttttatatacatgaagttcataatgctaagtcataattaatagtttttatttttttgttgtcttttttttttgcgttcataggtatagaagggaatgtgcattcattatttttatctgttattgctatattattgtacagaaaagatgagagaaggaaaaaaaataaataatcaaatatgtatctttttttcttttactttgcttttaattgactaaaacccaaataacgaaaaatacaaagattataaaaaaaacctttgcggctaaccatctattactctttatcctgtcgaagtatttcaaaagttccctttgagcaccactaatgtttaaatcgatgtcgtctacgtttgcatcaatcctttggattacttcgccctgttcttgaaccatggaggccagttgttggaagagatttcccacttcctggattgtggattctattgtctccaccgccctatttctttcttgtaagtagacgttattggataactgtccctcttccattaacattagttgagagtcgttttgagggaaagacagttctccttggttggacgagttgttattcttttctgaggattcatctagtagtgaggtcatgaatgggttggagttgttatacgtggtcaagtccgcggcgtgattgctttgcgtttggtcatcagctggtgcatgtccagtgtcggtggttagtttttgccatctgtctttgttagccatttctagtcgttgcctttcctccaatacgtctttaaaacttcctgatatgtttttcatttgcgtgtttaaaagatttacgacatttttggagtgctgtacggcactaggttgcttagaagattgatttgatgtgttgccattcacgtcggttttcttgagctgacttaattgcactaaactttgttcgatggcataaatcttccttttgatcaaaaatgatagctcggcaatctctacagggttgtcattgaacatcggtttccttttggccagcactgctaatttcgataataattgtgcggtggatgaaatttcgtgagctatgccagaagcctttttttgaaactcagagacacttttcccattgccggttgtgttgttggcaaagttttcactttctttctcttgtagacgttccctctgctgttctctaaagtttttgtttcttttcttgtaactcaacacactttgttgaaattctgaagttctatcctttatgttcatgggagttgtgtggtatggtgaaatggtcgttggaaacagaggtggaataaaatatatacagtaaagagtgggtgatttccgttcaaaggtctaacaggagcgtcgatgcggcggtaggatttttttttttttttcaatttctatattgacattattatcataatgattgtttcgaatatgccctttcgcctcgcctcgatcaataaacctacccggatattacaacaacataataatacacctgtgaaggtaaagaaagagcatttctcttttttttatttttttttttttttactttctttacattaaaaaaaatatgaagagtgtaataggtaagtataagtattatttaatcattacaatttagcttcaatagtatagaagcgcaccacttcatcaatggctttagccacgtattccacgtttccttgattcaatccagcaatagaagctctacctgaggcaaccaagtaaactgcgtgggtttcttcaagtcgtttaaccatttgaggagtcaatcctgtaaaggagaacatcccgcattgatttactatatgatcccagttgccaggagtgcccaacttgactaaatggtctcttaatgcgtgcctcattttcgtaattctggaggacatggtaaccatatccttgtgccactgttccgttaattctggcgtttccaacagtttagcgacaatcttagcgccgtaggcgggtgggttggacacttcactacgaatgattttggccaattgagatgtaacagcaggctttatagttttgttttgagcttgttttgtaagtgctagatggaaacaacctacacgctcaccgtacataccggcgttcttggcaaaggactgacagacaaagacgggagagaccgttgaaagcttctccacacctagacgcacagcataggcatccttgtccaaatctccagtggcaaacccttggtaggcggtgtcaaataaggcgatgtggttctttgaggcgatagcatcaacgatttgaacccattgttcactagtagggtccagaccagttgggttatgggcgcaagagtgcagaacgaaaatggagccctctggagctttttgaatagcatttagaaagccgtttaggtccaaagacttagtttcgttggcccagtaagggtaagtcgccgttttcaagccttgattctcaaaaatggccatgtggttggcccaagtaggcttagacaaatagaccagtttatctgggaagaattttgaaaaaaacttcgcagatatatgaagagcacccgtaccagacagtgattgtactgagattactctgtcttcctgaaaggcatcggattgcgtaccgaagatgatcttggcggcgttagatgtcaaacttggcagaccggtaataccgaggtattcatggttgtaggagctgtcgttatgaattagcttttcggcggctttaacacttggcaagacccatggtttaccgttgtcgtctctgtaggccccgatacccaagtcgaccttggtagcacgttgatcttgcccgtacctttgcttaataccaaaaagggcatcagggggcagcaattcgatgttattgaacagagtggcagacattatcgctcttgtgttcttgtattcctgtgttcttttgttcattagaatttggacggttgcgctttcccttcttaaagtatccacatacgtttatataccgacgtgcaaggcgacaaggtaaatgaggccgatcacgctgactcactcggtccgactctcggcgatcgttattcacgaagacgaaagatagccatttccagtggtgaccattagtattgacaatatgtacatcgcattaaacagtaagaaaacattaatattccgtcaggaattcctgtaaattgctcttactacaaacctgcaatgcccatatcatcatattcaaagtaaaaatttcattttccgtaattattcttatctttgggtgctttgtggcagctactggagtaattgtgtataatagatgccactagtgcagttaaatgaaatatcctacattgagagtttaaaaaattgcctccttgtatgtttcttgtaaataatgattttatgtccttctagcgtagtaaccctaaaccatcagcggctattattaacattgttaccctgacagtgcttttttatttcaagaaaaattttcctttagattctctcgcctatataaacactttgaaactctcatcgtcgtgcatttaacttctatggtaaacttcttttcccattcaagtttctctttgcttatttgtaaaaaaaaaagtaaccatagtctcgtgctagttcggtactatacagggaagggaagtcactcgcatacgtgtgtgtgcatttcttgctattgctgcttagcttctctaaaacactgggctagcgtttttcaacgctcgagaggcagagtctcaaggagcctccaatgggcctcacgtattcatctagatggcgcttcggacaacggcatcacataagagatgcagctcctgacttctcctctgatcttcgtgatcagagttttgagtcgtcagactacgagcagtttctcttagtcgttgcatcgggtgctgttgccttaacgatgtgtatatggggttcgggggctgttgccatgatatatatggatgagacagaagtggccccgttgacgagtttaacttagattaagtaggacgcatgatcttgagctcttttcctatactttgtcctatggccagctttctccttattacgaagagattgcgggatgtgggtgcagagtgggaaaatctgagttcggtcatctttgttgttcgtcctaccgcagtatattcctaaacactatgaaatgaccctagttggtccatgatcatttgggtaaaaccatactgcagacatctctataattcacatattcacatcttgtcctctcgcagaagaggaaggcctttgacgtagaaaattaagtaaatcgtatacgtttacgtatatacacttgtattcagctatatatgttgtttctgttcttctcataaaatgtaccctacttagtggtggaataaacgaattgggttctccacgtagacgatatcaaatgaatccgccgcttggaagacaactttgtccatgacagaccccgaaggagccgtgatgaactttacaccagactgcacagctctataaacgtgtctgggaagggaaagaacgcatcggatgataacgatacattgtttaatttgcttaaccattctagtctttcttctttggtgaaaggttcagggacttcttcaaatttgctttcgtaatccaccttttccgggccttctattctttgccctgtaacaaaaagatcaatcgcattcgacttgtccgctctcttaattcccttggcccacttcatgttcaaaacctttggatgttgtctcaaccaccagttgtccgtcttgtcaccagctaatctggtacagtgtatacgcgattgttggccggccccaagccccacaaccataccattctttgcgtagcaaacagaatttgattgtgtgtattttaaaaccagcgtagcaacagttagatcgataacggcttgctcggtaagtgctttgtttttggagacaatttctttgaaagtggattggtttatgatcgcatcgtttctcttttgttgtaacgttacgccaaaaacctctcgggattccatttggccaggaacatagtttggatcgatttgtaaaatacagtattttccgtttttcttcttagatagtatattcaatgcctctggttcataccctggagcaataacaccatcggaaacttctttagagatgatttttgcagtggcgacatctacaatattggacaatgcaatgaaatcaccaaaggatgacatcctatctgcaccacgggccctagcgtatgcgcatgccaatggtgataaatcctccatatcattcacaaaataaacttgtctttccacatcggataatggaagtcccacagcagcacctgctggagaaacgtgcttgaacgatgctgccgcaggcaagttcaatgatgcagataactctttcactaagggccatgagttcaaggcatccaaaagatttatatatcctggtgtaccgcagagcactttgaagggcaactcctcctgctgagtgatataagcttgtgcaggtctttggtggggattacaaccatatcttagcggtaattgggctttcccttcggagtactgtttcctgaaaaagtcagaaatggccgcatcataatcggccgtatgttcaaacgccttaagtgcaaatctatttcttaaatcctgagaaatttcaccgtccttagacaggtcttgcagaaagatagaatagtcattagggtctgaaagaatagtcactctggaatggttctttgcggctgctctcaacaaagtcacaccgccaatgtcgatctcctctacagcttcttgaactgtaacaccaattttagccacagtttctttgaacggatatagattacatacaacaaaatccaccttatcaatgtgctgctcttttaaatctttttcatcgccctctaaatttctggcaagaatacctgcatgcacagcagggtgaagagtcttgactctaccccctagcatttctggtgcatgcgtaattgaagaaacatcgtcgaccggaaaaccagcttctctgaccatgttggccgtaccaccggatgctaggatacgaacattgttctctaccaatcccttggctaagtctaataaacctgtcttatcataaactgacaagatcgcagtcttggtatatttgcccatttttagctcttttgttttttgtccctatttatggtatatttggattctttgtttggaatggggtattgattagatcttgaatgttatctaatcgctaaaaagagcaagaaaaaaacacaaatgctgaaaactggaaaaaaggacgatctatttgccaattattaaggcttattcttaaagtggaaatagccctctcttttgcttttcttgagttttatctaatggctctaataaggaaaaacgggaagaaaaggaaagaaaaaaaatacaagaaaataaggtgcgactaaaaagaacatggtgttaatttatgcggcggagaaatttacttgagcgtaaagatattatatataagtattatggtagtgccaccacctatgtaagctgctagcattggtatacgtagaacaattaggactccctcgtccgctccttgatacaggtagataagttctgcctgaggggaggattgagaagagggggtaggggtttgcttgatagcagaataaaagtacagctctaggtctataaaaaaaaaaattggttaaagaaaaaatatacaggtttgtatatagaatcattaattaaaaagataatagtataaaacacatcagataaacaaaagtttgcccaataaaattatattttccatcaaccagcttattttctgtatctccacaaggacaaagtgttttgtctcttccaggtctttcttctaccagccttggtgttgttgaatttgtgacccttgttgatacctctggatttcttaccagtggcagtcaaacctctagcttcacggtgcttgtgaactgggtcacagatccagttgtaacgagcatctcttctgatagccttgtgttgagggtcgaccaagataacttcgaagtacttgtaagtagaatcttggttaacccagtaggagttcaagactctcaagttagcggcacgacgaccaactctttcttcagcggtagctctcaaggatctttggtatttcaattcattgacaccttggttagttggcttaccgtaagtagcaccctttggaacaggtctctttctgttaccacgtctaactctgacacggtagataacgaaaccttgcttagctttgtaacccaatcttctagccttgtctggtctagttggtctagcggctctgtgaatgacattcttttgtctgtattcccagactctgactctttgcaagaatctcaaaacatcagattgcttctttctttgcaattcttccaaatatttgtaggcacccattgctgatttatttgtttgatcgtggttttcttagattgtaaaagaattacttaaggatagggaaagaaacgtgagaaatagcagttaaatgtaccggtggtaaaaatgcaatgccatcattctttgttaccaagcaaaagtgagaaatcttgaaaaattttagcacctttgaaaattttgcgtcagctccaagaaatttcagaaaatatattcgacagctttaaatccgtacatttatcaaaaaaagaatataatatcatgtttgacgatgtatgctatgtaaatcatgtcataatacgcatcaattgatactacaaatgcatctcggatagagacattgtcatgataatcgcaacacatgtcgcacctggtgcatgttctgaaccttaacactaaatatttaaacgtcatgtagggtgcgagtccatctcattcttgcccaataaattttagaaacaccctcttatgaagggcggcaaaacatattaagtaagtgtcgattgttaaacacttcccctttttttatgcatagtaaaaggtacaaagaaaatagcgtaccgtccttaaatcaatatagaaatataatgaaaaaataagtgctttgataagaatatcttgaatacaaattaagaagtgtatatttatagatattttcgtttcagcttgtgtctgtgtgtggccttatatgtaatatatgagatggaaggtgaacaaattatggagtatgttcaagagacaccgatcattccaaaaaggattatccattattcgattccaaaacaaatgatcacaaagcccgctccccatgtcgagatgacgttggtagctaatacttttcgggacatggacttgccgcagcatccggttatccatgattgttggcaaaataaagagtactcaactcaaagatattcaggaaatgtggctcaacagagattaagttttgaggaacatccaaatgaagagtgtcaaaattctgttgggttaatcaagagagtgagtactttctttaaaaagaggccattgtctcgaaagaatagcataaagtcaatcggtgacgtaaaatcggaggcacgtaaccggggagaaggcctcctgggtgaagttgataatcttaacgagcagaatgtccgagaaaacctgactagtgaacatgaaaagagtcctgaaggagattccaaaaggtatggcctgttctcctttgaagagaccccccctatacaagtgttggagcagggcaatatcaattctgagctttcttcatttaaaaacacttctttggcggaaaacaaacgctcttctgacagcttcgtttcgttaaaaccgggtgaagatgaacatagccctttagagattagtacgtgtggtaatttgactgaaagagaggatttgcaatctggcgaagaacggtttgactcagcagcccaaaatataaaggtagcttcgatgaaggaaaaaaaaaaaatcttcaaagggaacaaaacagattaatcactgagattatacgcctcgaaaacatactaaataagcataggaaggctgaagctaagaataatattaacaaacttgaaaagaagttgagtgaaacagatggttttacatctgtaaacacatcagttccagtaactcctattatgccggtcttaaatacgagaacttcttatcccaatatcgactttcatggtactaaggtttctgatgttctagatgcctttgaatttgaaaagcatgatgatcccttaagggataaatggaacactttacagtttttggaaaagagctttgaatctaaatttgaatctgcatcagagttaatccaaggaggcgagctagctgctattaaagaaagaaattttcaattagccaaactaaataatctttgctttcgggtacgagagtccatcaaaagaagacaagacctggagaaaaagttaagaactttatcgcaggacactgacaacgaattgctttttctgatgttggaaaatgagagaagaaagaaaagttcagtgataatagagtttctttctgagataatcagagagaaatccaaaagattaactgcagaagagcaaggctttgtaaatcaaaatgaagtaaaacccctcattctggacctttctgcacggataaatagattgaattctattctagaaacaaaaaatacttgtattagaagattaagtaatcaataagtagttaaattttcataaattattactttcttacatgttagttggcgcgtcgtctggctgaaaattttacgcgtcataaacccttaacttttccacacattattccttactgctaagcgcattgctcacttgaaagtaaattatctacaaagttacattatcaaaaggccttagaaacacacctaaagtcttacagtatcacaatatgagtcatattgaacaggaagaaaggaagaggttttttaacgatgaccttgacacttcagaaacatcgttaaacttcaaatctgagaataaagagtcgtttttatttgcaaatagtcataatgatgatgatgatgatgttgttgtatcagtgagtgatacaacagaaggagagggagaccgatctattgtgccagtcaggcgagaaatagaagaagaaggccagaatcagtttattacagagcttttaaggattattccagaaatgccaaaggatcttgtgatggaacttaatgaaaaattcggcagtcaggaggaagggctctctttagcattatcacattactttgatcacaatagcgggacgtctatcagcaaaataccgtcttccccgaatcaactaaatacactctcagatacctcaaattcaaccttgtccccatcttcattccatcctaaaagaagaagaatatacgggttcagaaaccaaacacgattagaagataaagttacttggaaaagatttataggtgctttgcaagtcactggtatggctaccagacccaccgtcaggcccttgaagtacggctctcagatgaagctaaagagatcaagtgaagagatttctgctactaaagtatatgactcacgtggtagaaagaaagcgtccatggctagtttggtaagaatttttgatatccaatatgatagagaaattggcagagtttcggaagacattgctcaaatactataccctcttttaagttcacacgaaataagttttgaagttacattgattttttgtgataataaacggttgagtataggtgatagctttattctacaattggattgctttttaacatctctcatttttgaggaacgtaatgatggagaatccttgatgaaaagaagacgtacagagggaggaaataaaagagagaaagacaatggaaattttggaagaacattgactgaaactgatgaagagctagaaagccgctcgaaaagactggctctactaaagttatttgataaattgaggctaaagcctattttggacgagcagaaggcattagaaaagcataaaatagagcttaatagtgaccccgaaatcattgatttagataacgacgagatttgctctaatcaagtgactgaagtccataacaatctccgagatactcagcacgaagaagaaacaatgaacttgaatcaattgaaaacattttataaggccgcacaatcatcagaatctttaaaaagtttgcctgaaacagaaccttctcgcgatgtcttcaagctagaactaagaaattatcaaaagcaaggtcttacttggatgctaaggagggagcaagagtttgccaaagcagcctctgatggtgaggcttcagaaacgggtgctaatatgataaacccattatggaagcagttcaaatggccaaatgatatgtcgtgggcagctcaaaatttgcagcaggaccatgtaaacgttgaagatggcatattcttttatgcgaacttacattctggtgaattttcgctagcaaaacctatattaaaaactatgataaagggtggcatattatcagatgaaatggggttgggtaaaacagtggcagcgtattctttagttttatcttgtcctcacgatagtgatgttgttgacaagaaactgtttgatattgagaacacagcagtctcagataatcttccaagcacttggcaagataataagaaaccatatgcttcaaaaacaacgctaatcgtggtcccaatgtctttgttaacgcagtggagtaacgagtttacaaaagctaataattcccccgatatgtatcatgaggtgtattatggtgggaatgtttccagtttgaaaaccctattaaccaagacaaaaacccctccaactgtagtccttactacatatggtattgttcaaaatgaatggactaaacattccaagggaaggatgacagatgaggacgtcaatatatcttcaggcttattttctgtcaatttttatcgcataataatcgacgagggtcataacattagaaacagaacgacagttacatctaaagcagtcatggctttacaaggcaaatgtaaatgggttttaacaggaacaccaattattaacaggcttgacgatttatacagtctggttaagtttttagagttagatccctggcggcaaattaattactggaagacctttgtatcaacgccttttgagagtaaaaattacaaacaagcatttgatgtggtgaatgcaattctggaacccgtattgttaagaaggacaaaacaaatgaaagataaagatggtaagccattagtagagttgccaccaaaggaggtcgttattaaaagacttcccttcagtaaatctcaagatcttctatacaagtttctgttggataaggctgaagtttctgttaaatcgggtattgcacgcggtgatttattgaaaaagtactccactatccttgtccatattttaagattgaggcaagtctgttgccatcccggtcttattgggagtcaagatgagaacgatgaggatttatctaaaaataataaattggttacggaacaaacggtggagcttgactctttaatgcgtgttgtttccgagagattcgataactcattttctaaggaggaattagatgcaatgatacaaagattaaaagttaaatatccagacaataaatcgtttcagtccttagagtgctccatctgcacaacggaacctatggatttggacaaggctttatttacagaatgcggccacagtttttgtgagaaatgtttatttgaatatattgagtttcagaacagtaagaatttgggtttaaagtgccccaattgccgtaaccaaatagacgcttgtcggttgttggcattggtacaaacgaatagcaactcgaaaaatttggaattcaaaccatattcaccagcctccaaatcaagcaaaatcactgctttattgaaggagcttcaattgctacaggatagttcggcaggcgaacaagttgtcattttttcccaattttctacatacttggatatcctggagaaagagctaactcatactttctcaaaagatgttgcaaaaatttataaattcgatggacgtctctcattaaaagaaagaactagtgtattagcagattttgccgttaaagactatagcaggcaaaaaatcctattactctcgctgaaggctggtggcgtgggtttgaatctaacgtgtgcttcccacgcttatatgatggacccatggtggtcgcccagtatggaagatcaggcaatcgatagactgcatagaattggccagacaaacagcgtcaaagttatgagatttatcatacaagatagcatagaagaaaaaatgctacgcattcaagaaaagaagagaaccatcggtgaggccatggacacagacgaagacgagagaagaaaaaggagaattgaagaaatccagatgctgtttgaatagtcataccacatactcatatataaagactttatttattattattttcaacccgaaagaactaattattcttcagctacttcatgcaacttctattatcttccttttccgttacccgtatttttaagttgcaattattaaaaaaacaattaagaaaataaaacagcgccataaggcatggacgatagaaatacgaagacgaagaaaatcatcatcagtcgggatcaaataagagataattttgaaaatcgaaagttttcattatgacagaaagtgtaggtggaaataaactagtagattttttggtaaatgttcaatccattttgaatgctgcctctgtgaaatgtcatgtagtagatgaaagttttccagccaagttctttgagaaaaatccggataagatatatgaatcatattgtaaattcattaaaaatagaagtaactctgaaggtttgatacgtaatgaagataaattagttttgacaactatcaataagaggtttgaaaatggagagtacgaacccatacaaggtgggttttataagctgtatcacgacattaagctggtttgtacaatcctcattcacttttatcctcagggtacaagaaactaccaattagtcgacaagttctacaaattttcttcagagcttttattacgagaatgttgtaggataggaattgctctaacgcaaactaataatattaaatcaagaagtggtaagttgttgagcggaaacgagatggatgaatacgacgatgacgatgcaacagaactagacaaaataatctcttatgattttattaagatttctatgaattacacagtgccgatttctcaaacatatcagataagaacgaaggatatggaccttttttcttcgataatttctaaatctaatcttgacaaaagacctcatgaacttcctaatacaaacttcaaaataaacaacgtcttacctcaaactgatatagaaaacgaagctccaagattaggatttgtaggcgctaatactagtaatattccggaccctacgttaccaccaactgaaatgatgactagatttttgcatccaaattggtatgctttacctacaaccgtctggctaaaatatggtaattataattcttgggcaccttcctttaatgaaaacggcaccgttgtggattcgacaacaaggggtcttatttggcttgaaagaattggttatatggacttgtatgaaaaaaatgaaaagaaagtaaaacaagaagaattactgaacacgaatgaagaaggcataaacaggaagcagaacgatgaaaacaacaaaaatgttgacggcaaaagcaatggcgttcaggacgatggtggtgataatgataatgatgcgactatcgcttctgcaaattcagagagtactgagaataaggaacaattcataatcaagcttcaaaacttatataattggacaccatctaattacattggagatgacgaaattgagaactttcgaaatggcacaccagataagttggtttcagactctctcttaaaacttaaaagacttagaaaggagaggattttaaataaagttttgaagcctactacggaggaacgagaattatacttcaaagtgaaaagaatactaaaggaggttatcttagcaaagaaggtttccaaggttcctataaacaatgtaagggcctttccagtattacaaacaaactataatggtagcatacctgtggtaagggcgcaaccaggtcgtaaacggaaacacaagaaataaatagtgtcagcggtagtggaatcaaagataaataatgaattatctttgttttagtttcatgaaagctcatcaagtcttttttgactaatgtatgtttatattttgatattagataaagtatgcatttgttctgaaggctatgcatacgtaagtatatacttgggttgtattatgcagaataaagaaatgagagaaaacaagaatcgagagaaaacgacacacttgacaataaataggttccattaaaaatggatgtcggcacctaagagataggaaatcaccaaatagcaattcaagctcccgattaaagcccatacgaaaacagaggtataggtcaacaaacgactgttagtaaaatcaactattttactgtgcttggagttcaatggagtggtttcatcagcaatggcgttaacatcggcaggtgctcttaccacaccattttcgtcatgaacaaccatcaactttctatttgcggtaaaataaattaaaggagcggaaacgattggtaaaattaaggacaagaccacttgagaaaaattcaaaatatctgaaattcccttttcccccatggttaaagtaacaaataaacatggtacaatggcaatcaatctggtgcacaatcttgtggcccaaggtggtaaagaccactgtaaaaatccctcagaaacgatttgcccggcaagtgtacagatgataccggcagattgaccagaacataacatggccaatgcaaagattaaccctgccgcaggagatatgtagtggaccagtaatttgtaaatagataacaaatcagcatcctctgcctcaggttggcctgataaagtagcacctgcaacaattaaaatagcggaattaacaaaggtggcaattaagaacaaagaaatgattagttcagcgtacgcatagtttaacgtatattttatagcgcttaaacttgggcgggcattaaccttaccgtatttcttcaaatcgtaatcgtgcaatcttggtttaacaatggatgagcccaagtataatgaatgaggcatcacagtggcacctaagatacccaatgaaatgtaaagagcttgttgttccttaaaaatgatatttgaaggcaaaaaccctttaaacaattcagctttgtctgggattgaaactttaaacagctccaaaacaaagcaaatgcaagttccaatgaccaaaatcccaacgccaaattcgaaaaccctaactttttttaaggactggccgtttggtgtgtagaacattaaaattaccaaaacatctagcaccgttaataagacaccccaagttagtggtattttgaaaagaatttgtaaagcgatggcagtgcctacaacctcggccagatcagtagcaatgattgccacttcagcgaaaaggtaaagggtatagtttagctttttaggcaaattatgacgacagttttcagccaaatcatagccagtgatagtacccagcttcacacagagacattgcaaaagtacggcaaaaatgttggatataaaaatagagaataataaggtatatttgtattgagcaccaccggaaacactagtggcataatttcctgggtccatataagccacactgactaatatccctggcccaataaatttggcaaatttttgaagaatctgcatataagatcgcattttttttctcttgtgatgctactactgttatcaattagcttggaagaacgatatatttaaaggagttcagaaggaaataatagtttgggtatgacaactgaaaaaaaaaatgaactaatatataaaggaaccccgtatatttatgtggagtgatctttgtcttctagctcctttgaaataaatattcaattatgcaacctcacagaatcagatgaatgagatatatacagtataaatacctttagtcgcatgacaacaggatgtcgtaacaatgcaatattagagcatttttaagttgacccaaaacggaaatttcaaggtgcggaaactggaagagaggcagggcgggcaacagggtgcggttaccatgagttacaaacaatggtctattatgaagtaatctattgtgctgagtggtgatagtgcacccgatcatcaggggctgtctggcgtgaagaggcaccattcatttgtcgtggcttcaatgtgtcccggtttcttcacatgcgctcgcaaggcttgcaaaagactggaagaagggcttgtggcatcgtccctcgatcgtaaccacagagtttctttggcaaagttatcgctgtcatgcttaacaattttttcattcttcagggtatagacgtagttgttggtatactcggaaaaatgcatgagtttcggccttgttttgtgcatgcaggatgctttctttatataattatcagttactttttttttcgaatttcgtggaatggtcatgtccacggtattgtttcttttaccgtaggtttgctgaagctttattagttcctttttttctgtatttgaaagctgtctttcgttgggcattccccttttattggcatctccacagctagtacgtttggcctcaagtaagttttcgctcagtttcttgttgacgtttcttatttttgtgatcataaaaggattagaaatagaagcgtccttagaaagttctaaatcctcgttctctggaatagtttctatatagttataagttaatgacgagggtaatgttgaggatccagctcctgctacttcactattttcgcttagttcttgttggaaattatgtcgccaattagtactgtcctcggaagccatagacccggaactcgagcttctataacttgaaatggtcagctgagtttgttcgtcaagagctttatcctcgctaaattttgtaggtgaaggagtagcagcgacaatggtcgtattctctaagtttgcttcatcgtaaaaagttggtactatcaaatctgagtttttttgtgggatgtcagtcttgtctttaccactaacagcaccacagccctttgatatttcattctctgcgtcgggtgtaggtatcaccagtgcgggagaagttttttcgttgatagaaggctgaacatgtttatctcccagcatatttgtttcgatgccaattctctcctccaataacaactttaacttattctctatcttcttaaatatcacttcaaaacttttgatcatcacgtcatttttctctggttcgatatttacgtcaagaagctttgtatcgcaatttaaattaataaaccaaaccataggatctagtaaagagaaatctctatagattgacgatagtaacttagaaatagtcttccccgtctccaagttcaaagatagcgctctctcattaacagataaaaatttaaatcgtctctttatattaataacgtcagattctggcaccatcctcggtaagatcaaatctaaatttattttttcgtcgataacaaagttttcttctacaataaagttcagcggcacaggcttttttagtctagctagtagggacaaacttctagctctagaaatcttagggtctaacgtttcttgcatttgtttacgctctatggcaccatttttttgtaatgacaccaacgaaaaataaaaccgaatatttctatgaattagagaataatggtttattaaatagattagttcatcgaatgtttttcttggcctcgaagaaatttcgagataccttgctcgtaaccctcccagaagtttccttaatattactgtagtccccacgggacaagataccttgtacctttttccattggtaataccacccttactatcaactaaccatttttctccaatgacatcatctgcagtttttgtttcaacctgcattgagcctttctggttacacaagtttgacaaaagaaacaatgcttcacctctgaatccaagagtagtcagaatcgaaatatctccgagactactcatctttgatgtggtgtattccaagcacatagaaggtctgtcgataatatccacacctgatccatcgtccttgactgatatatattcacatcctcccgtagtggaatctacatcgatgaatacttttttagcacccgaatcgatgctattatctaataattcccttacagcagctaccggaccgtaaataaaggaactagaaacaatcttccattgggattctggagataactgatgtatagtcatccaaaactatgaaaaggcgtctgttcctcaaaccgagatgatgggatgtgaaataactttatatgtttataaaagtgattactttttcttgtatgggcgccaaaaaagggccatgtatatgagggatatggacgacagtgagattatttaaatagcaaagactacagtaaaagcaaaaaagcattgtgccagggcaatatagcgagcactacttaaacccaaattaggtgacaagtgaaaggtttgttatgcgcaaaacttatagataatgcagaaggtaatcttttctgctgtactatatgttcacattgcagtgttacgaataaatataaggatatatagctctgcttaaggggttttcttggaatcgagtcgagttattctagaaattgttaaaaataaaggagaataaaagtaaaaaataaatggacgcaaccggaatcgaaccgatgacctcttccttgcaagggaagcgcgctaccaactgcgccatgtgccctaaaacgcgtacaaaggagaggaaattatttgactacttagtactgttttcataggtaaaccctccactgtggctaagatgagtgttattcttcaacctcatagaaagcacgcatgttactttctgagatatatgtgggtaattagataattgttgggattccattgttgataaaggctataatattaggtatacagaatatactagaagttctcctcgaggatataggaatcctcaaaatggaatctatatttctacatactaatattacgattattcctcattccgttttatatgtttatattcattgatcctattacattatcaatccttgcgtttcagcttcctctaacatcgatgacagcttctcataacttatgtcatcatcttaacaccgtatatgataatatattgataatataactattagttgatagacgatagtggatttttattccaacataccacccataatgtaatagatctaatgaatccatttgtttgttaatagtttgaatgtttttatcggaagaggtttggtcattacgtctgcaatattctttttggtttcgatatagcatacgtgcagatgatttcctgatacttcatctcttagtctcattgctttagtaccaaaaaatctgtttctaaatttctcttcattattggatataattatactgattgtagatttactgtcggttagtaatcctttagtaattggtttcttgttaagttcttgcacaaggtgactgaggttatttaataatgggacagattcacttatcgcgtgtatttctgcttccgtagttgaagtacatgttaatgaagccttggtggactttcctccaattacttttccattaagtaaatatatgttgccaatttgtgatttataatacggttggttaccatacgatgcatcgcttataacaactaatttatttgttggcttaacaggtttgcttttgtgccatattaattgcttatctctcgtattccatatgaactgtatcaattcatatgtcatatctaacacttgcttggacggaaatagtatatgttgtgcaagtgtgttgatgtagtataataggtcaaatctaaatttatatccaacatatgatgctagacctatcagcttttgcatttcatgtaccttcattttgtaatcatcttcttctagctctagttcttgctggtctatatatagacctggttgacctggagcgctaagtttccttccttttgggttcaaaggtacgtttagtttgggtattttttcagttaatgagttttccatacctaatttcatgtatttacctctttgatatttgatttctaagccaagtatgtcgtactgaatttcgttatcactttcacccagatttattatctttgtatcgtattgtttcttgagtgttgttatgattttcttatttgcatttaagtctttgctgaacaatatcatatcatcaacgaataagcaaattgttacttgactattcttaaatacgcatgaccatccacgaacttcttccataccacactgttttatcaggtatgatttgatagtttcgtaccagttcgctccactttgtttcaatccataaagtgatttcttcaaacgtattaacttatcattcattcctaaatgtggtggaggtcttatgtatagttcttctttgatgtctgcatacaaatatgccgaagatatgtctaattgtgtaatatagtagttattgtctgatgcaagtgacagggatgtcattaatgcatagtgatgtacggtattggattgcatgcctgggtcgtaagtgtcaggatgttgaatatcacctcttgcaacaaatctagctttatgagtaccgccacgtttcctgttaaagataaacattgaatttattactcttttggggtctatttcttttctgtcataatatctgtcagtgtcccaagttttcatcttcaacagttgattgacttctttgtggtatgcctggatatatttttctttttctttaatatctttattataggtgattgcctcatcgtatcgtaaggtagttcgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgatgagaatttatcggtgggagttctttaaaggagtctgataattcggtaggaggttctggaggcagatcggggagtggaagatcagcgataatagattcctctgtattctccttaggacaggtatctgacgttttgataggaacgacgtggtgtagtgaattactttctgatgaggaagtatcgatcgaaggtgaacggtgtatgatccttttctcagtctcctgttcgcttgtctgcggaacagttttattattggtaccacccgtactggatattggtacgtttgtatgattagtctcattgtcactgtacgagtctgagtgtctgaaatctttagatttactggcgtgcgacgactcatgtgtgttagattgggacatgggagcaagtaaaggaacatctaatctatgcataccacccgaaccggtactctcgatatcggaaatttggggggtgctagatctcttcttagatggaagaatattagattcagatatgttggggtcaacttctctgggtgcgcgaatattggttttggaaacacgtttcgaatcttcagtatgagttgacggaggtgtggaatcggttggactcacagcttttgaaaggacatttctcggttgctcaggatgtagttcgatgtcagattggaagtcatggtcagattctatgttaagatcatcggattgttggatctcatttgacgcaatgaacgattgatatgaagcagttaaacggtttaagtcttcatcgaaagtgagtgcgtcgtaattgaattgatctaatctggattccttgccctgaagaataacatagttagttgtatctactgtcttctttaaggatggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggttgagccgttcagcgactccatgtgctcgggaatccgctgtggttgtatagcatggagttataccatttttttcaaggaatttatggagagttctgttagtatactcagaaccacggtccatttgtataaccaagacactggcctgaaactggtttttaataaaagctagtatcgtagtaaaaacatcgaggatagagtcctcgcgacggtcgtgtaatggataaacccaacggaattttgttgtctcatcagtaaatgagatgaaataggatggtgcactttttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgcgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagaccgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgtcaggattagatgatgctgagtgtatgtgatgagcagatcttataagggttcgtgatgctcctgaatcgagaaggaggtgtccagggagttcatcatcagaatgattagtatgatttactgtagattcagtaagtttctggcctaagatgaaggtcgtgcttattgttcaattgaatcggttcagtagttgatttactgatggaatcgttgtccgtgctgggagagttattagatgtggatacattgtgagccctggctgttttcgatttcgaattatttgttttttgaggattccgagctataactttgggtttggttgtattcgtatagctgcgagaatcattcttctcatcactcggatttctcctgtaattaggtttgctgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaaatcattaggtgaggttaacattggtggtggtctgacatattttttagtggatgtcatatcagagtccgctgaggatgaatcagtaaatgtattacctgactcaggtgatggagtgctcagaggcgttccaactgatgatggatactgcggaaactgtgattgtggcccaggtggaaagtacataggcgacatttgataaggtgtatacggaatcatagatgggtgtccgtaaaatgaccaaccagatggattggcttggttttgggtcatcatgcactgctgtgggtacggcccattctgtggaggtggtactgaagcaggttgaggagaggcatgatgggggttctctggaacagctgatgaagcaggtgttgttgtctgttgagagttagccttagtggaagccttatcatattcttgaattttggaagctgaaacgtctaacggatcttgatttgtgtggacttccttagaagtaaccgaagcacaggcgctaccatgagatatatgtgggtaattagataattgttgggattccattgttgatagaggctataatattaggtatacagaatatactagaagttctcctcgaggatataggaatcctcaaaatggaatctatatttctacatactaatattacgattattcctcattccgttttatatgtttatattcattgatcctattacattatcaatccttgcgtttcagcttcctctaacatcgatgacagcttctcataacttatgtcatcatcttaacaccgtatatgataatatattgataatataactattagttgatagacgatagtggatttttattccaacactttcatacgtaacgggggtaatattactagctgttagaataagagtcaacgatcataattgactagtaacgcaaatactactaaacagatgatgttttagagtttcattctaacaaattgataatgtagtagaataatgaatgacaaagtataaaagaaaggaagacaaagtgattttattatcagaactatcaactccctttcgtgaattccaagactgttgaggagaacttctagtatattttgtatacctaatatcaacaacgaaatcccaacaattaatacgaagttcacccattttctgataattgttacgtgcaaataatagaactacttttgtcgaggtgtaatctcgtattcaaactatatagtaaattattctcaatggtcgagtaatgcaagaagatgatattgaatactttgcgtaactttaccaattatccaatatgcaacagtaaaatgataccttcacatttcaagctaattccaaaataatacatattaggtaaaatcctcaatttaattgcccggttttaccttcagacatcgctccctttccattgacacatctatacccttcaatgaacccgctatgtaatatcaacgcatcgtaaaaatagaataataatgcagtagtacatatccagcctagctgcaatctaaatagctgtgatagtcggtgtaaattaatagtttggtcagttttaaaaaaaaacctaattttggtacaaaagtagaagctgaaagcagtcattgataccaataacaaatactttagctgaaaccatttaggatacttttttctggcagcacagctgggacatactaccttcgaacatctctttggctttgttttattttcatttttaaaatgaccgttctttcgatataaaaagaaaactataataacgagggaaattgttaccgcccccagaatcatatctatgatcttaatgatgattgcttttgggtacttttcaatcaaattatctactgatggcaccataaaacaatttataaaataaaggctacaaacggcctttgttaatttttctataattaataaggaattagactttgggatctcatcttggctttctgtcgcactaagttctgcctctttcattatttcctatactttgaaggagaaagtaaactttaacggcaagttcctgtcttaactaccttttagttctcgtgtgttgtgaagggcctttgaggaaaaactcgaaagtttgttccgtacttttaaactttcaattttttaccaaaaaggctatttaccgctttatgggaagatcatggcaagtcaaatccacgttaaatggaacaagattaacttgccacagatcaaatgctgaattgaagagaagttttaagcattaagattcttaatatgatcattaatatatcagtacgtgtctcaactggaatcgtataaggttcttgtaagtacaaattgtatgcagaaatttaaatgcgagaacaaaacttgaatctccccccgcatttaaaaaatatctttttgaacacagtgcaactgattaaaagtacctgtaatacatatatatgtttgtatacgtatgtatatctaattatttcttaccgtcaaatcataattatttttatccgttcgtaaagcaatccagtgctaaataccaattgtgaggccatcggcttagtttggaacagcagtgtagataccgtccttggatagagcgctggagatagctggtctcaatctggtggagtaccatgggacaccagtgatgactctagtgacttgatcagcgggaataccagtcaacatagtggtgaaatcaccgtagttgaaaacagcttcagcaatttcaactgggtaagtttcagttggatgagcagcttggaacatatagtattcagccaaatgagctctgatatctgagacgtagacacctaattcgaccaggttaactctttcgtcagagggagataaagtagtggtggctggggcagcagcgacaccagcagcaatagcagcgacaccagcaacaattgaagttagtttgaccatttttttcgattgaacttttgtagatctttttagtgaagatgtgagctcactcgaatgtaaataacaatgccaaattgtcggaaagagttaatcaaagctgctctatttatatgccgttttttaataagcgacggacgaacagataaattgttgaatagctatttcactgctgatatttctcttacttgggctcccctatcccatactcttcaccactacaaatatgcagttgccctttcttcaacaatgctttttttatagatctcgtatacggatccgcgcctttgtactacctatatcttattatgatatatacaggagcacaggaatgttcggtacagggatgatacctttaaaggaagttttggcatgccttgacaacttcaattaatctttggccaagaaaatgaaccagaaatcaaattttattctgtgccctctgaacgagggcaatatccaatgtttgacactaaacggttgtcaggagaaaaattgaatgtttcccaaatcagaaacattaaaatccctctatatgatcagaggagtcgtacctgttagggtatgagcgaggaaacgtgattgagagttataaactgaccatacgaagagttacggccattgattgggttcatgacacccagggaagtttcttttggattaaaatcacaagtcttgcaattgctgtatgtattgcatgagtgaagtagttggcatctaatggatacccacttagggagtttatggatgaatcttgtcttcatagggtagctcgagagtgttttttaatctagtgatatccacttagctaagcgcggctggagatacaatatttacaaaggcaatttcaaaagtaggagcgttttcaaaggcctgctccattctccgttgaggtagtagaagcaaatataaacggttaatcttgctgttttccttgttttgtctgttggttttcacttgctgaagcctgtggttcaacagtactcggagaatcggccttatctagtctccttctgacctgtaatgcgtaaaattacgacaaacgtatttcgtgaaacaattgataggaaaattgtcatttgcttgttaaggcagtgcattgaggctctttaaaggtactttagaagtttatgttactatccttctagcctgatagaacaataagtaaagaattgacattcagaaatcagccatcatttcgtttagtagtagcaatcgcaagtagtgactgtaagagatagaaatgtgtacttcagtctggaactggggcgcttgtgaaggatgtgtgccgatctcaggctgttgatgaaggtctcttcaaatactatattattatcttttagtaggtcccaggaagtgccttattctcaacatgttcagcgtttatctttctcagcctgaatgtatttcaaacgatgactagaagagattagtaccccttatataatcctcgaaaatgttgctatctcagtgaattgaaagttcatgctgacgtctttatcagcgttatccattgccttgttcttttcagtgcagtggcagatgttacgagggtcaaataatttttgaatatatatagaaatggctacttactataattaaaaataaatatgaaaaataaaacttcagtaccccacatcattctcatttttttctgtttgtttgatttttaggaatttggctccatcatgaacattcgttagcgtatgatatcactttttcattatctcctattgttactttacttttcatatagatatccttcatcccgtgtaggtctactacgcaaaaatgaattctagtaattaataataatgatataaaaaaggctaagtgcacattactaaaaacgaaactaagatccttagtctgagttgatatcacctgcgaaaatacctttttctctttgatcatcccatttttcgatccagtctaggggacataaggcgttataggtcttccaaaagaccttgcacggagcaaaatcttcgcccttcatattaacacacttgtgataatccacataagattgccaacaatgctttgtttggttttgttggggaaatctagcatcgaaaccaactgtatgtagtggagagttttcttgatcagccatgtctattatactgtatttatgtgcttgttcctatttgtgaaagcaaagatactttatgtattcttactaaaatatttgtatatctctgctaatcattttaatgcaacttttctatctggtgcatctttcatcaccttttaaagatcctgaagggatggggatatcgggcaaaactacgcgcgacgcatttctgaaaattgattggtcaatgttatgaagctatatggtaaagaatacatggtgtcatatagatttatttgaatctctcgagtgctttttgaaccaattgtgtgttgttttctctgtctaattccttgagtaagcgtattaattggaaacacatgtcccacgaatcggtagctttaattgggtctgtggcgtttgcagcacttgtcaccaaaagctctaagactttaagcattaattcttcatccttcaataaattagtgacagatttctctgacttttttgtagagttatcatttagagctttgctttcctcagtccctaaatctgatttcttaaaatgtagatcatctcccaaatctttctcatcgtaatttaaaaacactaacagaagtacgccaagcattttagcctcattttcttcgatacagagtgctaataaatctcttggtgtcatctttagattagtgaatagatggttccagtatttagtttcgatcttccttaaacaattactaataatttctaacataccactgtgggttggtggtgaaatattatgctcaggatcggtgttgtcatacatcttaattaatttcaggatatcatccaaagagtcgcttcgcagtattttagtagacaaaatcttttcgagtgcaaatttgtaaggctttaaaaaacgataattgtgtgaaatatcctccaaatctgtgttgtcttctaatttggctaagattaattggtcgaggtatatttggtgtttcaccaccaatttggaaaatcgcgcgttaaaaatgcagtgaagtgtatgtgttgtagctgtttctggggtggttgatattggatacaaatcttcttcgattggaatggaaactagtggctttttatcatcccataaatcttccaaagagtatacgacgtaattatggccttgaactacaaatatttcgtccctgataacatcgattattttttctatgttatccaacaaagttaaggtttgccagccccctccatccactttgccaagctttataaatttcctatcggcaaaaaataacaagccctccttcatgttaattatccactcaattttgttgggtaaaacatcaattggaatgttaattttgagatactggtagaattttttgatgatgtttaatccacatggatgtacagtagaaattacatcgaagacaattgtctgtgtatcagtaactaaaataatctcggcagttttaagcaatgcatcaggttgtttttcagaagcattgtgattcttggatttcattttcaacaacttataccgggataaagtattaacatgtaaactgaaaacaatcgtattctctggaacattgtattcccacatgacataatctgatagttccacgtccggattcgcttcttgcagtggaatctgcagacatttcagatttgttgagccatcatcattcttcatatgacaaaccaaataattatcacctagccaatgtaaatccaacacgttttggtcagcaaaactagaccacatattggtctctagattgtggataagcagtatgtttttgttcgacacataagtagcaaataacctcaaggaagaattaatttttacaaaagcaatatgattattgaaagtctttgtaggaagttttatgacttgtaaattatcattattgattgaagaacttgtcacaggtgaatatatgattacatcattgttcgtattggttaatacgtaacattttgggtttctgaaatcaaattgtgtttgttttatttcttcccataatttccaaacttgatattttccggaatgagacactgttattagtgatttatccaagcatacaaaatcagaaattttatattcagccgcctttttctcatttttatccttgctgttgtcattattgttatcaccattataatcatcttcgtcaaaatatgtagcgaatagcagattcccaaattctgtgtaaaaatgaatgttaacactatcctcagaaaccaaaagtaatattttatcattaattttatcgcaaagttttatcacaaatggtggtttccaagaatggcttacttttttaattcttgtatcaaagcagattattttttctttgtaaacgaccaccaggtatccattaacttctaggcaagtcaaaagttcatctggtgtgtccgttaacggtattgcttcaacagcttgcttttcaatgtctataatgcttacaatagtctgcttttcgacggaatcatgagataaaaccattaattgtttattacacacaattgtcttggatcccttcttcacttcaaccaacgagctcttgctaactttaaaatccgatattgtaagtatttgtaatccatgagggaataaaactatcaaaacttcttcataacgcccatccccgactttggaaaatgtcttgatgccaatcatgtctatgatttcatagtcaaatttaagaactacttttaaacgaagttctagttttttcacggggagttcatcaatgttttcttgattagaaagaaagtgtaaaaaccctttttccttagttatgccaaatccattctgtataattcttgaagaactatttttatcaaataccgtgagagtatcatcatcgttgttatagtcatattcagcactgttcgcttcttcttcactcattaaaagaggctctatgacgggtatgccgtattctttgaaaattatttcatttgtgcagttttttaaaatttggtatgttaaaaggaagtttttatcagtcattacgtaaaatatcagctttccctggtgccacaataagtattgcgagtccttttttgaaataagcccttcgatgatatcattatatggagctgatcgtttcattgatctgttatcgccaaattccttaagagaagccattgttcgttcatggctagctactagtgccattggtttgaagttgtaaatgagcactcttgttggggttagcatgataagaacattggcctggggtagtgtcattgattgaagaatattgcaatcatctattttagtaccctcacctaattcggcgttgcggggtggaattctaagcaattggggcggactgactggccataagtgcattttccacgtgttcagtttcttacagcttccggtcaataacactcttaccttacctttttttttgtagaggcatttaggtgtatttttttcagactgtttgatgaacatcaaaggcgtcggtattgccgaattaacatcaaagaacaaaagcctgccataaaacgacagaaaagacaagattttggccaagatggcaacgccattcagaagttataataatatgttaaaaataaatcgtttgatactgtacaaagttgatgttcatcgttgtcactaaaaacgctcttaaaatcgaattgtccattgaaaaagtacatacttatatacatatttgtataaataatacacatattataaaaaaagcgaaaagggatggcggacctcccatggaattaaattgtcaaatttggttgaggcacttaaagggcaactgcaaagattccgaacaacgccatggggaaatataagcttttggcatgggcaccattctgtgattgactagttctggatgttgaagaagagtttgatgcggatataagtgctgttgtactgttttcttcattagccatggaaatcatggactggcctgcgttcgctgtcgagaaaggaacagaattggaaacggagtttttttggctggcataagatgagttagtcatggtagcttctgtctcacctgttatgaagtgttggggaaggtatatggtggtggcggaggctttgtttagcaaagaggtataccatggaaaggccgtaatgaatgtttggaattgagtgaacggaaaactctgagcaatatcagattgtaaatctgctgttgaggccaaatcaaccatgtgatagtagtagtcagcaacaggttgaggtagggttaaatggttttgcatcatgtatgaggtatactgtggaaaagcggtgtcgaaatcgtttaaaaactccatgaagaatgccatgtctgcatctgcagctgcggacctggcaagtgtatcgtcattggaactagacgttaaagttttggcagcaaaactgtggctgattagaaagcttaccaggagaatatttttaatgagggagaaagaaggagcaaatatcattgatacgcaatattttcaggaatgttgtaaatggttcgtaactggatatcgaaatcacttgattagaaacaatacgccggaatatgatcaggtaaagcagaataacaaagaataaactttctcgattgagagtgtctttttaaatcatccaagctcttgaattttctagcatagccttggatgacagcaataaaaaatttgccaggatttttccctatttgggcgttcaatgaagataacgtttgaaatattaaaaactaaaaaaagaaaaaggtttgaagcaattaataatttattaagtttttttttatttatcatacttaagaatatggagaccacgggttttcttacacctgcgaagaccttgaacctaatatatttgtttaagaaaacaaataagcgattgtttctaacattaaaacgaagtaaagacatggcttgactgaacctacacctcctgtgcttgtacttgaacttatagtattagttgtttgagagctttttgtttcatttctcgacgaagaaggcaatggcgtgaactgggtgactaccgtagaatttgaggattggtaatttatagatgttatgacgctggaagtgacttttggtatagacgacgatgatgaagaaccggtgaaattagcagcagctaatgaaccagtaataatgctggaagaggtggtgcttggaagatgaagtagttgatcgttagaatttccagtgtcaagaaaggtgtattgcactttctgtccaagggcagtattcaaatcctgagcatttgaatctgtgagaagttgcgcttgaacaatgaacagttgtagtagcacaattggggcgaaagctaaagagccaaattgactgatcttcatattttttttgatttgttgacgagctataggatgatgaaacggagggatatcaaagtacgttcttcaagcttacaatttctcaaggtgctttactggtcaagatattcaatatatagctaaatatttatacaaaatgtttgttgacggtttgtttatagtgttttcaaaacaccacgaaaagacttcattcttgcattcttttttctacaagatgagtctatacatctgaaactgcgacgccattttttccgctgttcggggcattcttggccaaatcctcgaaagaaataaaacgtcaaaagtaaaaaaggtgggctagacgaaacgttattatacgtcataattgtagccgtgtatgagtgggtggaacttgtataaataaacaagttcttacttatcatattctcgcatgcaatgaaattctccagattatgacgcttaggtctggccagacggctaatgaggtccagaggaaatagaaggattgtaagcggcctccactaaattttgacccctcatacatgcttgttcaaacacaaaagattgaggttgaaaacttggcaagaattgggctaggagaaagtggccaggtgcttcttgttcagaaccaagcagatatgctagcacaatgtgcaccgttctatttttttctatagtgtgtttacatttcttggcacattgcgttcggtttcaaatttgtataattattattggagcgagacaggcgtttctgtaccgctgttatttttaacatccactgcgttttatgtatctctaaaattgtgcgttgcctttcttttgtttatatttttgttcaaaaaatgagttaataatgatttttcatcttcggcttaccggtcttgaaaatatttgttaagacaacagtggataaaataaaactaaacaactcaagcaaaagtattccacttcttaaacaaagcccaactgaaaggttgcgaaatactatgtcattttgatttaatcatctaatgctcgagaaaatttcagagccgtaatacttaagtaatcggaagaaaagtatctcattcttcatttttctccaaatatatacctcttgtgtgaaaaattaattgtttcctccacctcctttgtgtggtgggcaattgtgtgcttccgagtaaataacaaaacataaggataatatataattctgtttttttgtctaaaaaaggtaaactatatataacaaacacagtatagaaacacaatatatcggtcattgggtgagtttaagcattagcagcaatggcttgcttaatagccgctgggttggcaccaacaacctttgcaacttccttaccgttcttgaatagaagcaaagttggcatagcggaaacttcattcttttgtgcaacatcacccaattcatcgacatccaatttatagaaatcagcttgtgggtattgttcagagaatttttcaatcattggagcaatcattttacatggaccgcaccaagtggcgtagaaatctacgacaactagcttgtcttgagcaattgcagagtcgaattcgctggcagttttgaattgagtaaccattatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcttattgcttagcgttggtagcagcagtcaacttagcttgttcaaccaagttttgtggagcatcgaagactggcaacatgatttcaatcattctgatcttagagttgtcgttgaaagacttgtcttgggtcaacttgtcccattcaccggtggtagcgactctgtgggtttcatagtccttagcaccgaaagttggcaacaaggataggtggtcccaaccttgaatttcgttgtattgagcctttggaccgtgaatcaacttttcaatggtgtaaccatcgttgttcaagacgaacaagtatggcttcaagccccatctgatcatggtggagatttcttgaacagtcaattgcaaagaaccgtcaccaatgaataagataactctcttctttggatcaatttcttcagcagcgaaagcagcacccaaggtagcaccagtggtgaaaccaatggaaccccataagacttgagagataccgtaggtgttgtttgggaaagtggtttggttgataccgaaagcggaggtaccggtttcagcaatgacaacatcaccttcttgcaagaagttacccaattggttccacatccattcttgcttcaatggggtagaagctgggacagcagcgttagctggagttctagctgggacagcaactggcttgtaacccttagcggcgtcagcaatagtggtcaacaacttttgcaaaacgaatttcatttggacacctgggaaagtggcgtttctgatcttcatgtggtcggagtggaattcgacaatgttcttggtcttgtaagagtaagagaaagaaccggtgttgaaatcagacaacaaagcaccgacagacaaaatcaagtcagcagattcaacggcttccttaacttctggcttggacaaggtaccgacgtaaacaccaccgtatcttgggtgttgttcgtcaatggaacccttacccattggggtgacgaaagctgggaattgagtcaagtcaatcaacttcttagtttcagccttgacgtcgtgtctggaacaacaagcatcagccaagataactgggttcttagcatccttgaccaaagccaagatggtgtcaatgacttccttttcggattcagcatcgtttggcttcaaagacatgtcaattggagtttgcaacaacttagctgggacgttcaagtcgaccaagttagctggcaaacctaagtagactggtctttgggtgacgtaagtggttctgatacatctgtcaatttcagctggggcggtagcaatgtcagtgatcatagcagtggtttcagaaatgttggcagacattctgtggaaaacagtgaagtcaccgttacccaaggtgtggtgcaacaacaattgcttagcttgagcagagatggatgggacaccaacaacgtgcaaaacaccgacgtgttcagcgtaagaaccggcaataccgttcaaagcagacaattcaccgacaccgaaggtggtgatgatacaagacatacccttgatacgagcgtaaccatcagcggcgtaagcagcgttcaattcgttggcgttaccagcccatctcataccttcaacttcgtagatcttgtccaacaaggacaagttgaagtcacctggcaaaccgaaaacggtgttaacgttgacttgctttaatctttcgaacaaatatttacccaaagtaatttcagacattttgattgatttgactgtgttattttgcgtgaggttatgagtagaaaataataattgagaaaggaatatgacaagaaatatgaaaataaagggaacaaacccaaatctgattgcaaggagagtgaaagagccttgtttatatatttttttttcctatgttcaacgaggacagctaggtttatgcaaaaatgtgccatcaccataagctgattcaaatgagctaaaaaaaaaatagttagaaaataaggtggtgttgaacgatagcaagtagatcaagacaccgtctaacagaaaaaggggcagcggacaatattatgcaattatgaagaaaagtactcaaagggtcggaaaaatattcaaacgatatttgcataaaatcctcaattgattgattattccatagtaaaataccgtaacaacacaaaattgttctcaaattcataaattattcattttttccacgagcctcatcacacgaaaagtcagaagagcatacataatcttttaaatgcataggttatgcattttgcaaatgccaccaggcaacaaaaatatgcgtttagcgggcggaatcgggaaggaagccggaaccaccaaaaactggaagctacgtttttaaggaaggtatgggtgcagtgtgcttatctcaagaaatattagttatgatataaggtgttgaagtttagagataggtaaataaacgcggggtgtgtttattacatgaagaagaagttagtttctgccttgcttgtttatcttgcacatcacatcagcggaacatatgctcacccagtcgcatgttgttaccctcatgaaacatgtatgagatattactttgaataggttacttgcatgcatttcggcgtgcgggtaccacctctttgcatgagcttgttcctttttcaagttgaagactatatattttattgagtttatgttatggggaggctaccctttacgtcctggttgtcccttcccgccttgatttggccttcattttttcaattctggcctttagggtagatgtcactgcagcggcacgtttataactttcttctgaggcaaaactatcgttgaaatcgatatccaaatcgtcggagacactgctcactccagtgccgttttttctgtacggccgtatgttaagagagtttacgcggtgcggcaggtcgccgatggactcgcttgatcttctttcatagttgacgtcctctttccttctgacatcttcctcctccttaaatggcaaagcggaagataaagattttaccccatagttgcttgacacggtggaagaaggtatggagtatgatgaaatcgtacccatcgattgcaagtttgtatcatttcttttcttatttctatccaattcgatctccatgtttctaagctcgttttctagtgacagtactctatcagacagcttattgacatcaatctccttggatcttaattgaatgttcttttcgttcaatttagactgcgcttcctttagttgctctcttagcatttcgttttctttaatcatttcgatcttataattttctgtattattcatcttttccaataggctttgtctttctttggtccatatcatctcatcattttgtagtttttgcagtctgtacttgtattcttcaatcaacttttcattcttgtcagtgctattagctactacgttttttggcgttgccaaagacttagacgtcaacaggaccctcgatttattgttagcagctaccattgatggttttgatgcggaggctactgaccctattgggttcactttacttttgttatcatttctcagcggtgaagatgccactctcttggagggaagtacagaactttttttcaggagaaatttattctccattggcccagtttgtttattcgtttcaatagtgctatgggtactaccacttgcaatactgaaattaggtagagttttgaccgtttcttcaatttttttccttttcaaattatccaagtgctctaatgttttcacaaaggtattcatgccaaatattttaattagaatggcgaaactctcaaatccaatagttcttatagcaggttgggtgtcgttgacgatctgaatcacaattggtaccacttcatccttcaagtatctttgcagggtcgagtatccatctttttcttctttcatgcttgcattaaacaattgcgtacactccattctgatttgaggtgtcttgtgcttcatatgctccaaaatatctttcaacatatcttcattgcgtccactggaggctaatggatcgtaatacttgcagatggttaataatgccttcctaatggcctctatcacagaaggtttcttttcctttgtcctgtctaacaagggagtgaagactagtgaaacataatccttggaaaagcctggtgtttttagtttgtcgcagattaattctactgattgagcggctagtgcaacagcttgaatgtttgcatctttctggataatatggccatatatccccaataagttggaataattttgcgaggtgctttttaacttcttagtctgcgatagaacactatcccaaaattcttccagcgcttccactctatctttccatttggacgacgttatcctttcctggaagtccttaggcagtttatcgaggatcgtctcctccggtagcatactgaaggtgtctatttgaactccactttgctgttttgatggtggcatatccgtttccatccccatcaatgtatctccatccttatctatctgatattccccctcatcattcgataatatggactttcttttcctggcttcctcctcttggcttcttttcttttccaattctcttttctcccactcgaataacattttcgatgacgatggctcgtcaccaacttttgcaaacaatttatgaagatctttcacttgaattggttttaattttttaaacagtatctcctctaacaagtcgctattgttgcccgtaaccttatagatctcgacaatcaaattcatcgtttgtgatcgaacgtttctatcaccatgaccggctagttgaggtacgtgctttaataattctggtagaaacgtttgaacgttcacattagtgagcccgaatgcagccatcaactcataaacacaattggctgccgcagcaattaattttggcagttttttctcgaaaaagggtattaccaattccaccgattgcgtaatagatgtatcaagaccacatagtgagagtatacagctcatcgactgcgtcttcgttgtagcccttgaggacgttaagcccttttccacaagcaatggtgtccatgttgatattaaagtaatattatgtgcatttttcaaagacgatgacgcaaaggcatctattaaactattcaaggcaacaatggcttgttcttgagcgaccacattagaatcagttatatattgtgcaaataatgtaggatccctccagtaaatttgtatgttgtcatccctactgatgtcgccaacggagtttctaaaaagctggtttaactccttataagcttctaaacgtgccttccataacttgtacgttaatcgctcttctaggggtaacgttgtataatctacttcttcttctcctgacatagtcaacttcaaactctttaataaaaactcaaaaatactttacactgtaaagatagctgtttctttgtagtttagtaatgctatttggtccctaggtctggtaggttcttcatttactcttcctatggagtgtcaagcagacaaaacaaaaacaaaaacaaaaacaaaaacgacacgaaaaaaaatagattcgttaaccatgataatctttgcaccatataaaggaaaagacaagattgacttctaatgcccagcacaaatattatccaactatttaattaataaatttttgactacttaatcttcagacacagattccttgtctaataatttgtttaattgaatattgacagatttatcctgcagcttgaacaaatttcttgcgcgaaaggttgctaggaaaatcaaaggtagtaaaaacattagaactgtatcgaaaacgtaaaggcaccattcgtgctgacctatatagctttgtaagcccattagaaattgtactactctgacaatggttctaccattaaccagcaatatcccagctaaaagtataaaattgtactggaaccattcattactatcccgcacaattttactaggcgttgccttcattttatagtgaagaaaaagttgactgaacgttaaaaaggtataacaaaatatctgaatgaaaagacccacaataattaggatacgcccagtattcctgctgttccatgaggataacaacccacctcctacagcctgtaggacacgcccaatcatatctgccactacgaaagaaactgtactaaatttcgcaggaattaacatatatgcctccataagaattagacgtgccattttgctgaacaacataaaaatactaagggcgtaaagtgaaggtgctatcaatagaagcaccgattgagcaatgaaagtcgaaatcgaggggctattgataaagactattttcaacacataacccacgaactctaaacaaatccctaaaacgaaaggaaaatgtgtccacatcaaaccgcgggcaggaaagtatattattgtggaattttcctctgacaactcattgttttcccagcgatgaatacgtctcttgctcgtgtgtgttgccattatgatctgcaccaaggcagaaaggattaaaatgccaaacagaacgacaaatgcaatcgctgcacctttgtgaggattgtatgcataaaaaccttcataatcagtgattgctttagtaaaaaaattcctattgaggcagttgagttcttttatcgacaataagtctctagtacagtagtgagagtgtcatgtattcagtaccaagaagaacttatatgccttttataattcatcttataagttgctagacatacaaataatcaatatggaaatgtgcttattcccgctaatatccattaatatccgctgtcatttttcgcaactatcaccaagtggagagaggcttgacaaccaccagaaaaaaactaaatcagcctgcggaacttttctcggaaaaaatcagttagaaaagatcgtacatagggcccttttttgacagtaagattaaagagcaaaacgggacattatagatatgccaccatcaaatacgtgaattttccaagcctcataaactaatagccaacttgcaactcttataatgcaaaactttctccgtgaaagtgtaaaccaccatctgtcgcccatcttttggtgctttcaattaagcctctagggcctgcagcgagaacccatacttgtgacaaatattcagcatggtctctgccttgattcgcccacctgcaacattgaatagaatccgtctctgcatcacattcggtttgcagacaccattcataatccttatctccaagtgtaggcctgccaaagaacactttaacacctgcgggaattctgatctttttaggcgccgcctctaaacaaggatcttgggcaggtggctcaatgatctttggttgtctgaaaacgctcgatccgttaaacgaagaatgtgtagttagagttccttgtgcagtatttttccttgatttggatctgctaaaagcatatgtaaaatctatctcgtcatcagcattgatgtcaggtatatcacttgtttttggtgggtgatggtttctcaaggtagatttcttacttagaagggctgtgttctcattgggctccgtaggttggggatttccatctgataacatggaattatctcccagttctgaaactcggccgctcgaagaaatactcctgacttcatcattaatatcagcagcgcagtcatgatagtcaatataatcaatttctatgtcctgttcgttgccttcggtgccactaatatatatctccataccttcaaaattgtttttgaagtggttcaatacttccagatccttataatctctagaaacccaaaggagcctaacgtttacaccgttgaagtttagaatacgaagtagtggtaagccaaaggaaattcctgaacctccaacacacataaacactctttgcgctttaattagaaaatttaaaggcgaatttattagtgcagaagaattgtttcgaaatggattcttggaagatttcgtggtaatattaaaaggaacagtaggtttagaaatgaaactcaactcaggttcaaaagcccctgtaatgtaatacttttcatttgtacgcaatggaaaatgcccgtttctaataattaacctgaccaaattatcacttggaatactagcaatagtaaaaggatgttggaagggtatcaaatgggagaaaaacctccttaaaaaatttctatggtaaatgttgatccttagatgccctcctggtaggatgggctttttgggtaaatcggttaatgggaactccaaaagagacaatgatgaagaaatgggtactatcgtaactctcgtaacattggtgatatggagcctatagacgatttgtcccgttaatatgagcacatttaaagtggtataatatgaaattcctgggcgagcgtgataatgtagaaacaccaaaataagccatgtgcttacatagtgaacatagtaaaaaactctgtagctccatcgtctggcatatctcacagaggtgatggcaatcagtaggaaaaggccgagggcaataaccccataaatgttgggtagttttctcattttcacgtataacgtatcattaatgtacatgtaatagagatagaaccacgtgtgtagaatagattcaagcacaacaattctggaaatccatttgtggagaggtaacaatgctaagtataacgtgtgaggtaacggtgatggcctcaacgttagaaatagtaaaggtggcatcaaagcaacggaaattctccccattcgcttagtaatttctaacagatctccgttagcgccttgtataacaaaaaacgaggtgaaaacaaagcatattaaacatagttgtagtgactgtttgtgatacatatgtgttttgtgaacccatgatcttctgttgaaaacatgatgctttaaatggtgacatattttgaagaatttgtcagttagcaacaaataattcattaagggtataataacacatattataatgaaagaaattaaaagacatatctgagaatatttgcggactcttaaagttctaaaatgcttgtccacgtcgacatcaaaactgggaagatgttccttgaaccagctaacgatggactttaaattcatgctgaaaataacaataaataaaatacagtaaacttttttagcggaacttctattgtaatttaacgatttaatctgaagagatgtagatgtaataaaactgttaaagtggcaacgtgataattaaaagcttggcaaaaataagagatcaacactagctttttctttttccacctaaatttgaagggaaataaaaaagaaattgaggctgtacagagtgttaatcttccataacggataccaccaaacgtttttaccctaaacttaaattttattacttattttacatgcataatggctgccatgcgtagttcatacatgttatttgcaccctttttctttttcaataacaaaaaagagcttgggcattacgttttcaacacttttaatatttccctttttacatccgtacatataaaatgtaaacccatgcattcatgacaattttacctatttcttaaaggcctttgtcacttctttatgggaatggcgctactttaattttccgcctactttgaaaaatttaccaaggcgaaattgagtgcgctaggcggaagttccagggcacggtcaccgaacctttgtgctgtttcgaacgagggtcccgctggaggttgacggacgcgggaggagctggaaagatggaatggaaggactgcaacactcagtaagaaggttcgtggtagggaacatcaccttctctagttcctgtaaaaataatatgatcaagtttgaatcctcgtattgaaaaatcgcgagttattaagtgtgtaatttagaataccgaaatagcacaagaagagataagataagatactgataggataatgtctttaccagctacttttgatttgactccagaggatgcccaacttttgttggccgctaacacccatttaggtgctagaaacgttcaagtatgtacacatatcccatacgattatgttctatagatgataataggtctcgaaaagaatatgtccccgatttaatcatatttggaggtcagaggaccaaaggtaatttcagaggaattttgaacacgccgggtttagaagagttagaatttcacttcttagtgagggtaaggagaagaaactcaataagaatatacatcctcgactgtgtcaaagattatgaactccgatgaaacagtaaaacgtcaaaaaattccacgggatataattcggtactttattggatatggaagaaaacattatatatgcacaaatgaacgctcttactaacataatttatctttcctctctttttttaggtccaccaagaaccatacgttttcaatgctagaccagatggtgttcacgttatcaatgttggtaagacctgggaaaagttggttttggctgctagaattattgctgccattccaaacccagaagatgttgttgccatctcttccagaacctacggtcaaagagctgtcttgaaatttgctgctcacactggtgctactccaatcgccggtagattcactccaggttctttcactaattacatcacccgttctttcaaggaaccaagattggttattgttaccgacccaagattagacgctcaggccattaaggaagcttcttacgttaacattccagtcattgctttgactgatttggactccccatctgaatttgttgatgtcgccatcccatgtaacaacagaggtaagcactccatcggtttaatctggtacttgttggctagagaagttttgagactaagaggtgctttggtcgacagaactcaaccatggtccatcatgccagatttgtacttctacagaaacccagaagaagttgagcaagttgctgaagaagctgctgccgctgaagaaggtgaagaagaagaagttaaggaagaagtcactgaaggtcaagctgaagctactgaatgggctgaagaaaatgcagacaacgttgaatggtaatcatttgaaaaccttgcaatgtgtgtgaatattgtaaggaattgagaaagagagataaaaaaagagacagaagtatcacttccttttctaatttttctttttcattttttttttaaattcatctatcgtttatctttatctcatatatatttgcttctctctgaagcgtcatcatctatctgtatttttaatgcaatcatagtataaaaatttttaaccaaattcaaaaattataatattttaaaagtttatgcttttgtccttttatattcaagtcatttggccattattacgcttttttttttattaggtaagtggtttcaataattaaattctttagcgggaaggctgactatctatagtattgaagataagttaaattaatgtttagttctgatatttcatttttattattaattaaatttgcactattcgccatgacgggttcacccgagtatttattttgctttcgttatacatatatatatatatatattcttccaggagaaatacctgccttctctcttaccccttgctcaatctaaatcaatccgtgaccttaaatcttctagcagaatgactaagtcacaatcgattttagaaatttgaataaccagctcagagatattactgacaaaaaacttgtaatggcactgttttagcaagtttaagataaatgtatccattaagaaagcattgattttattcggaccataataggtagtcactattagaatatctaaaagttctagaccaataccatctaatttgtgcttattcaatgcgttggtcataaaatttcttattacaggcttgatgaaatccattatcacatttaatttcaacttgtcctttaaatggtagtataagttaggaaagtcctgatagaacttcccctcagtaaccgtgtaagaattcttgttgtccttattgtcatcgaaacgactattcaaccaggtaacgtttttcgtcaaattgatgaaaatagaccgggatagagtttcctgctcttcgttgttacaacatttccttattgctagatacaatgagttgttcgcatactgactgaaaaatccggcttcgtctagttcgctatagtgatataaacatctcttgtatattggaagacgaaaatcgttcggtatcccaaaccaatataagttatgcttacttatcaccaacagcaggtccgtctcatcgccagatgtatgacaacttctcaaattgctccaaaacttttccaattttagttctcttcgaaataagtttctattttgaaactttaaatttaagatgttcctctttgtttccgatttaatgaggttttgtatggatggatcagtatgagtgcacaaggtttcatcgttattattggcaattaatgataacgattctttttcactattgattttccttttattttcctgaatcaaagaatctacactcaaatttttttgtggtctaatgactaatgaagatgatcctgatgagttcctgttgttgtttggagtaaacaaaccatcagaaaacacagaagacgcagaagaagatgaagaagagtacatcgttgatctgtgattcggcgaaggggccacaggactcccctgagagtttgctcgaggaatggcaaagttgtctattatggggacagcataactaatgagattagtatctttatctattgttgtgtccagaattgttgtccaatctgtggtcccggaatgtagggcctcttctttcaaatcgtttcttgttattctatgcctgctatggaatagccgctgactgggtggtacgtactcgtgcatgatattattaaccatgagttgtagctgttttgttatatccaaagaatttggctaacgtatccttgtacgcgtgatttatttatatatacgtgcagcacaatatatatatatatatatatgtatgcgtgcgcttggttatggctcagtaaagcgaaagtaacggaataagcgagggaagggggatctagcgatgagggaatggcagtaacagactgttcccttacaatacactcttgctaaattacatcaaggataatatactattttaaaacaaaaaccagccatttccctaaggacgcgaaacttttgtgacgcgtttcaaataaaaaagaatactgcaaaacgcagcacaataattagataaaactagtggcatatgtcactaattaactatatagtcactaatactgtatatatagccgacacaggctacacaaaacacaaacgcaaaggaattaggaatgtaggtaggtacaccgaggctaactgacacttctgggtcatggacaagcttgtttttagcacatcgtaaggaatgtaaccacgcttgaaaataacaacgatacatatcaaggtagttagagaggcattccagccatagatacgcaaccactttttcaatctgctatttgtattaacttgtaattcgcttgaattccagaatttattgacgaaatagacgaaaaggggtagttgcagaactagctcaaggactacaaaccagtatagccattctggtttctctgatagcaggaaatcgtgttgctttgcgatgtgatcactaacaaccttttgcgcaatccctagttgccatttagcgggaataaccactgatgagtcgatgaatatggtgatgggaatgtgaacgatgaagtaccacaagtagaattgttgctcacgatgtcctagcttcattatctccggtcgcttttctctatatgttttcacgtgagtggctcgtttctcgtacttatttgctgcggttgttccttttatacctactaattcgtatcctgtacaaaagccgataattctttactatgttttcaaaggttttttttttttaaacgatatgcaaattattaattcttttgaatatttctatgtaatctaaaccactttacaatatactatatggaatacgtggcgaagaaaattccattatctcacctccgcttctttctcatctctttcattttcttgtaatgtgccttcctaccgctcgtagatttctcctgaatttcgttgtatttacgcttgaaatacttattagaagcttcatcacccatgagtgtttccaaaatagtcgactttctttccttcctgttcatacgactactataaaactcactcttgtcttcaattatggtaccaatagcaaacctctctggcacctcccaacgttgcttcttataatgtctctttggatcaagagcagctctatgtttaatcagcaataaatctcgttgaacttcacgacgcatgttatcatctggctttggtaaggtaaaccagtcattatcgtttttgtcgctcttgttgggttttcttttatcttctgtctccacactaggcaagacgttcttcttcttcttcttgtttgctaaagcatcaaatccggtttctaacttaggaagcttcttaagattagtttcgatctcttgaaatttactttcaatttctacttcatcatcattattgcctatctgcaaaacatcctcttgttgaagagaaacttgttccttcgctgaattttttacttctagactggcactagcatctcttagtgctccaaataagtcttccacactttgatccatgtttaacagctcctttctcacgtcctctttaattggaaaacttgacgtctcatcgcattttctatttcttttctatcttctgttttaatatgctgaaaaatttttaggccggcactaaccacgaattatgataaaagagaaggatgtttagagaaaaggttttcgtgtgaaagggggaattgcgttgttaactgacatagctgtcttcaatggaatcataacaatgaagttcgaagacctcttggcaaccaataaacaggtgcagtttgctcatgcagctactcaacattacaaaagtgtcaaaactccagatttcttggagaaagacccacatcacaaaaaatttcataacgcagatggcttgaatcaacaaggttcttcgaccccatctacagctaccgatgcaaatgccgcctcaactgcttccactcacacaaacaccacgacattcaaaagacacattgttgccgtggatgacatatcgaaaatgaactatgaaatgataaagaattctccagggaatgtaataacgaacgctaaccaagatgagatagatataagcaccctcaagacaaggttgtacaaggacaatctttacgctatgaatgacaactttttacaagctgtcaatgaccaaattgtaacattaaatgcagcggagcaggaccaagaaactgaggaccctgacttatcagatgatgaaaaaattgatatactgaccaaaatccaagagaacttgcttgaagagtaccaaaaactttcacagaaagaaagaaagtggtttatattgaaagaactactgttggatgcaaatgtagaactcgatttgttcagtaatcgtggcaggaaggcaagccatccaatcgcattcggagcagtagccataccaacgaacgtcaatgcgaattcactagcatttaacagaaccaagagaagaaaaattaataagaacggccttttggaaaacattctttaagccaagattaacataagacaagtttgcaaaatccccaacttcacttccatatgcatattcatttaggtatatatcgtatatttgagaaaaattcatatatgaaacgttattaaaacatgaaaaatagaatgtgttatcgggcttaactatattctgccattcaatgcgtgtttcttgaccatctctcgcactacctctgacggtacatagaatgggttatgcttctttgtctttttcgtgtgctcatattgtctttggttctcgaactcaacctcctgggttaaatttatattaaagaacaagaaatcctctatgctatcattattatcttgagattccatctcaaatagttcagaaaatccggtgttcccgaggtcatcgtattgcaatttttgtttgtctacctcattactcaaattgctattggaggtgcttttgatagcatcactacatttattatgaagcatatccattaactccgtcctgagttgttccgacgtgtgtcaacaaaaggatttactaagaatgttgtattttgagttttaaaaggacgtgcatatgcacatacatatatatatacatatatgcgtatttatcatcactccgtgctgtttagaagctgcacatattatgcatctatcgcgatagtattgtgagttggagataaagatttaatcatttgtgcaacaaccgctttctactgtaggcatagaatttcgcgcatcccaccccttattaacaatcacattttttttttttaatattaatgactccggtggtcgtgattgtaatcttgataacaatcgcgatcatgatcacgttctttagcctcattatcgaacagtactggaggtgaataggcacaccgtttatctaaaagttccatgatcgtggattggtccctcaagatggaatcatacgtatctacaccaccgtatctactagtggtaaatctcaaaatatccccagtgttgccacggttcaaaacatcaatgtggtccagtaatagctcatacggattcgttcgtggacgaggcagtgctcctctatgaatattgaaccgatgtttaattttccacatctgagattctaattcagaatagtttcgacgtcttgcgtccaattctgattgcgtccttggtttaacttcgtaatataattgtctatgtaagtcttggtattctttggcgaacataaagtgatttgaccttaattgcaactccaagctgcttgtagtatatggtcttttcatatcatttgatttatccttactcgaccttttaatagaaaacctcctgatgaagtgtggcacagcaaccactccaaatttttctagaggctttgtgggctttgttgagcttcttttgtcaattccaaggcaagaaaagtcgtcttcatcggccaaatattcatcttcaaatgtatgtatcgtatcatcaggcaagtgtttatcatcgtagcctgtatctgctttagttggagattttactcgtttttgaccaccagatgtatttgcgtcgcaattgctaatgtattctgcacctaaatacaacttttctaagtccgctggtaaagctggatcattgacacccagtggacttgtcatcgtgaatcgttgtgttaaactaatgaaagaaccttcctttacatttttgtccactctgtttttgcctttatcttgatcctcgttatcaccatcggtaaaatcttggccgctattaattcctgaagcaacgttaataccaccaccaatcctgctgtccaacatcgacaaggcatgctcacaccttccaccatttattgatagcccacttagtgtcagtaacctcgtatagaatccatataggaaatttaaatttgaacacgaaacaccatactttttggccaaaatgatgggctgatgcaaaagaatttgagcaggatattcaaatcggtggtagaaacaataaggctcaaacggtaaggataaatattccggatgttcgtttgccgtagagttgataagttgcagttttttacctttgcaatattctacgattttcccaaaattaatctcttcttcaccttgtgattttactagcaaaaaccttgcaattttgcttccacattgtgcaaagcaaattccaagtaactctttcaccagatctttaaaaataatttctgtggatttgttttctaacattttctcataatcaaattgttcatagatgatagaaaggatgttaagtgagattttaggaataagcaattcccacattttcaatgccatttgttttgggtccaaaattaatttagatttcatccatttcgcaacggtcaatccaagaaggaacctgcgaacatttgaacccttaatcccttgcaattctaacgaagctgctttcgtgttttccagaatggttggacttgcttcaaaattagcatcacaataagttaatcccaaagttattacacattgatcgtcgttgaccaatgcatatgatccaagcgataactgtctgcattcaacctcacacgaaatggaaataacacacttgcacttccctccaaaataacttatggctatgggctccagttcgcaaccaaaatcagtgctaataagcacagtcgtattgtcgttcgtgtaatctgacaacaatcgacaagttgtttcgaaagactgtaaggaaattgcagacactaacacaatgtcaattgaatacgtatttgcaccgttatgttttaatttgtggtgcagctctttaatatccttagtgagaatgtttggcgtgtagaaattggcgcctagttttgtcgatttccaggcaactaactcgtcactagacacatattgcgagaccagtattataaaagagttgctcaaacttagtctccatcctagaaattgtgctgctggtgtttctccaactgtaaaaaaaaggaaatttaaatttacatttatatgttagtaaatttttgttcgaatgtctgttttcttaaacttctttgccatacctattaagcacgttaattggttttcttccataactaatgcgagttcttgccttcaaaaaaagaaagaaaggcttaggaatacaatttgaactagtatttgtatcgtgcgtctatgtgcttttgttaatatgaagcgtattattaactccattcattttacttttcattcaaattttgatagtataatatgcctttgtctgcccggaccctgaattactgacacaaaatgaagggatcagtggccctgaaaaaaaaaaaaaaaaaataaacggcgcgcggagtaattatgattatgattatggttatgattattattacaactcactattctaagtctatatcgtaaataagggtcgtgtccgtagaattcccctgccagcctctgttgccacttgtgcttattataaatcttgaagtggggtcgaggtataagtttgatataataccaccgtgatggcccggcacgatgaggaacggcactttagaactctttgtagtcgaattcgaagcatctactgcaatttcaacgttgtacaatctgatattatcccgcgatgcacatagtaaatgcttgttattaggcatggctttaacacaagagacaggccctgaaatagaaggcagtttcaaattatggataggtttcgagggcatcttcaagtcaaactgctccacacaggcattccttctccctgcatacacatgatcaccatctacaccccaacatgcggacaaacaccacggtgggacgcctgcacctctctccagagacaatgctggcgactgcgtcatgcgtcggtcccaaatatgcacggaaccgttcaaccctgaggtcataaaaacggattcatcatagactatgttcaaagattcttcagatatctgttctttgttctcttcaccattagaaccatcccccgtctcgacgggttcgttgccagcatcttgcttttcgtcttcgtcttcatcaccaaacagagaatccatatcgtcatctgcattttcattctctttaccactgttgacgttaccggacacatccacggacgagtacagcggccgcatttccaaagatgacaattcagaccttgattttttaaactcattaactatgtcacccgtctgcaaatcccattccaaaagacgcttatcccaggaaccactcaaaaacctgtcctcttgaccgtttaatctcagtatgttaacgatttgggtatgtccattcctgcccttaaaatagtgcgcaatgctcccctccatgtagcgaacgccctgcatggtaatcccaccattctgtagcccgctcagtataaagaggcattcgctttggacttccaaagaatgaacggggctaactttgggctcgtaatctgtcttattagcggagagtttcatttctgattttttctgcgggatctcattttcccagtacgactgcaagatacccgcgttctgaatagactcagccaacgaatgcttctgcaggatagttagagaaagtttcccctcaagcgtgttcagcaagtcgtacttccttatgtatccatcgctaccgcccaaaaacaggtacttgagacccctggacacggccaacgcattgacgtgcgtctggatgggtatggctgccgtggggtagatattgtacgaatccgcaatctgtgcggcattcaacatgtgcttatagtactcataaacctctccattagcagaggcttcgtgtgtagaggaagatgcttccctggaccccactcctccatcaacatcgctcaatttcacatcctcggatccaatcttagtaacagcatcgccactatcgcctgcaccgccagcaccagcagcagcagccttttgctcatcatgctggtgctcattcgtcggtgtagcagtcttatccattcttgcggcgtcgtcctcaccatcgtcgtcctcctgttcatcgtcgtcctctcgttcgtcctcgtcatcatcatcgtcctcatcatcatcatcgtcatcctcttcatcttcaccaccgtcatcattcccctcgaggtcctgctttgagtcgttttccagcccactcagcatctcttcgtcatcctcctcgtcatccaccacctggttgttaattagaatatcgtcaacctcgtccattacgtaaaagaagaaaaaaaaaaaaactgagcctttagtacactacagttactgctacagccttttacagcccagcatctggcaccactacgctataatatatgatgcgtctattatgctagaatccttcctgaaagggcattctggaagccctacgtacagagtgacaatatattagggcatccataaaaatagattagggcagctctgccatttttttcatagccgaaagaagaaaaactgaaaaaaaaaatgatacgaaaaaaccgcgaaacgacgccttttgttgcgattgtcgggcatcgcaagttacgacgcgttgtcccttgcatcgctgccgtgtggcacgacccactgcggcctaaacgaccgagatcggtgcccggggcagaccacccgaaaactcccgggcattatttcggtcgtttagttgcgccccagggcaaccggggtgtatacgaggccgatggctgcgataaacgaaaaattcaggctcgtataagtggcacaatagaaggtgaagaagaacagcaggtgcattgaaacaagaggttcagcagcgatcgggtattgttgttgctgctattatgtaacggtcgaaagaaacatcgcggtatatattagaggcggatttctatctttcttatcaattcgttttttcattcacttgttcattcattctttacatttgtcttgttctttgaagtggttgcagaggaggtcagtttgttgcatttgtaaaaaaagataataagaaaaatattcgtctagatttgagatatggatttggtcttagaagtcgctgaccattatgtcttagacgacttgtacgctaaagttctgcccgcttcgttggcagctaatattcctgtcaagtggcagaaattgctagggttgaacagtgggttcagcaattctacgattttgcaggagactttgaactccaagaatgccgtcaaagaatgtagaaggttctacgggcaggtgccattcctgtttgatatgtcgacgacgtcttttgcatcgctattgcctcgttccagcatcttgagagaattcctctcactatgggttattgttacgatctttggtttactactttacttattcacggctagtctcagctacgtgtttgtgtttgacaagtcgattttcaaccatcctcgttacttgaaaaaccaaatggcaatggaaatcaagttggcagtcagtgctatcccatggatgtcgatgttgaccgttccatggtttgttatggaattgaacggccattctaaactatacatgaagattgattatgaaaaccacggtgtaaggaagctcattatcgagtacttcactttcatctttttcactgattgcggtgtgtatttagcgcacagatggttgcattggccaagggtctaccgtgctctgcacaagcctcatcacaagtggctggtctgcacacctttcgcatctcattctttccatcctgtagacgggtttttgcaatccatctcgtaccacatctacccattgattctgccattacacaaggtttcttatttgattctgttcacttttgttaacttttggactgttatgattcatgacggtcaatacctatcaaacaatcctgccgtcaacggtactgcctgccacacggttcaccatctatatttcaactacaactacggtcaattcaccactctgtgggacagactagggggttcttaccgtagaccagatgactcattgtttgatcctaagttaagagatgctaaggagacctgggacgctcaagttaaggaagttgaacatttcatcaaggaggtcgaaggtgatgataatgatagaatctatgaaaacgacccaaataccaagaagaacaactgaatacggttgccttgtttgtctcatcttttttctttctttcacgttcaagaactttcacacaacgaataacgtttatatatttatatacacatacatgttttaagatacgcatatcattatgatgtacacctcacgttagtgcaatatgcgctattcgtatattaaatttttgcgttcatttaatggctctttttcctattctagtgaaaaaaaaaacagaaaatcgaagagctggaaaatttaagaacaggcaaataggaagctggaagctttaaaatgcccaagatttcggtgaagcgcaagtgttaactagaaaaaggccgccactactctataagcaaaaccttatgtccatagcgcgattagtatactctcttttcagaagagtacgatcggttctcttacttttcattaccatatcgctattgttttactatacgttccagaatgaaatcgatatcttgaattcgtacgctttaaacgactcactaccgtccataaacaactatgagcacaatacagaaggttcttcgaaactggatcctccagacctatcgtcaaccggttctgaccgaatagccaccgacaaggaaaatggcaacgttgcagtggatttgtcagatccagctacattgagagaaaaaaacaagtactttcccttgctgttaaagggatcgtctcaccagattggttcgaatttaccaatttcgtctcttttgacatataaggaaaagtatcccgtcttgttcgaatactcatcaccttccttaacttctataagccagaatgacgttcataagatacagccggcaatgcaattgccaccagatgttgatatgataaaacagataaaggacattttcatgaaatcatggaaccaagagcagttgctgctgaaaagtaacctcagaagggaatctacttggcccatagatctaattgattctctagatacattgtatctatgtggcgagacgaaactttttcaagattctgttaatataatagaagattttgactttcgagtacctccgttagcaatggaagttattgatattcctgacatcactacccgtgtcctagaagggttactgtctgcatacgaattatctatggataaacgattacttaacaaagcaaaacatgttgcagatttcatattaagatcatttgatacccctaatagaattcctattttgaaatatttttggaaatctgatctgagaaatcgatttccagaccgtactgttccatcaggtcaattgactactatggcactcgcgtttatcagattgtcacagttaacccgtttgaataagtattttgatgctgttgaaagagttttcaccactatacgtcaatcatataacgaatttgatatggagtttatgctgcctgacgtcgttgatgcctctggttgccagttattaactcaagaggaaattgagaatggtgcacacctaaagggatccagcatcatgaaaagtatcaatgaaaatttcaagttcgtacactgtcagcagttagggaaattcttaaatcctccaatagatgataatagcctccaagaacaatctcaataccaggcttatagaattaatgaaaaaacagtacccattctagaaaatctattcaaaatcaatgacctcttccaatcttcttatgatatcctggacggctcaagtaaaaatgctaatgctgcaacgatggaccccagtattggttcagaggtagaagcagtcgacgaaataattgagaaaagaaactttaaagacggtactaaaaaagattcgacaaaaaacaccgtaggtgataaatcattaatagactcgcaaacgtttttaacaaattccatcagtaacatttttaaattcatgacttttcgacccatgttgcccaagcaaacggaaaacaaaaagtttaattttctgaattccattctaacaaaatctcaattcatgcccacgactaatgagctagatgtcacgataagaaaatcttacgatgtctcgttatactcatgcagacttggcggcattctaggtttaagttcacgtgttccccaccgaggcggtgtcaacacgaaatatattttaccatcgtcactattggaaatgagcgaaataataacagaaagttgttttatgctaatggaggagttcgacgggctgctccctcaaaaattcgagttggacccttgcactgatgagactaatgggaattgcgagtttaacggcgaaactaaatcacgaatgattgccaacggcgaatatgaaacttttgaaaatgacctagatgtcgggatcaaagtttcgaattatgggaaaggtgggaatgaccagaaagctaagagaaatgtactaagcaaagatgggataacagagactcaaaacataaaaggtgatactgttggaagctcgaaatcgattgctgaaatagacggcgacgaagtaacgcaaatacgtagagtttttacgcttggtaaggatatcaaaccgcatattacaacggacgataccatgggttctcagtggaaaaaccatccagactggccattttgggtcaacaaggtagaatccagaagattgttggattcgaatatcattgaatctatattttatatgtacagaatcagtggagaacaaaaatggagaagcatgggtaagcagtcttttggaatcttaatgcaagaattaatggaactaaacagtggtgccaaaggattgtggcaaataaaggaattttatgaaaacggtgaaaaagtgaacaatgatttacctagctattggttctccagaacattaaaatactatttgctactattcagcgatggtgacaaggtttccctggacaaacacatcttaactcaaggagggcacataatcaaaaagaaatgaagttaacgttagaaaaatcgtacgcacatacatacatacatataggtacatatatacataatgagaagaggagaaaatgaatacttatacagtaatgtttatttttttgggattaagtgtcgttgtggtgatttctttacacagccaatgggtattcgccagcccagtcgtaaatttcctttttccaggtgttcaaaacatcagagccttcgtcgaccttggctttgaagtcctttaatctacaagcatcctttggcaagctttgttgaacttgttgagcgaattctacagccttgttaatgtattgaacaattctgtggaaatcttcttcacccattcctctagtggtcatggctggagccccaatacggacaccacctggaaccaaagcagatttgtcacctggaatagagtttttgttcaaagcaatgttaatcttttcacaaatgtattcaacacgagcaccatcaacacccttttctctcaaggatactagaaccatgtgagaatcggtaccgttggaaactaatctgtagcccaagttcttaaattcactttccaaagccttagcattcttcaagacttgagtttggtattccttgaattctggagtggcagcttgcttcaaagcagtggccaaagcagcaatggtatggttgtgtggaccaccttggtgacctgggaaaacagagaagttaattgggttttccaagtcgtatagaacttccttaccggtcttagggttgatagatctcacacctcttctgaagaaaatcatagcaccacgtggacctctcaaagacttgtgagtggtggtggtaacgatatcagcgtattcgaaaggagatgggatgacacctgcggcgatcaaaccagaaatgtgggccatgtctaccatcaagtaagcaccacatttgtcggcgatttctctcattctcttgtagtcaattaaacgacagtatgctgaagtaccagcaacaagaacctttggtctatataggatggcgttcttttctaaagtatcgtagtcgataataccggtttctgggttaactctgtatgggaaagattcgaagtatgtggaaacagcagaaatttttctgttttcagtagcgtaaccgtgagacaaatgaccaccatctggtaggtatagacccatcaatctttcatgaggcttcataatagcttgataaacctgcaagttagcaggagaaccagataaagtttggacgttaacaccccatttgtctggagtaacatggaaagctttcaaagctctttgttgacatagaatttccattctgtcaatgtgttcattaccaccgtagtaacgagcacctggataaccttcagagtatttgttggacaatggagttccaagggcatcgaaaacggaggttgaggtgaaattttcagaagcaatcaaatcgatggagtgcttttgtctttcaatttcatccttgataatggagtccacttcagggtcggtgtccaccaaatgagaggtgatcaacttatgatgagcgtcggatagagtgtaaggcatgttaaggaggattcggtttaagctgttatgctttgctatggggtagtatctttcgtaaaggttacactagaagaaggaaagattactgaacgcaaactaagggaagcaagttctgcattatatataaaacaagatgaagaagactcatggttcggtctaagatgattatgaatttaaaaattatacagagtaaaaagcgaacatgagaaacccaagagatagagtcaaacctttatggtcaaagcaacctgaaagggtcatttctcaccaggagtcatgtttcgtgtgtgaaatatttgaaaaatttcacttcttttttctttttttttttctacattaaaaatcggtgcgttgtcttttcaaagatgaggtagatgaagatggtgactccggctgttcagatccgattgactcgaccgactctgtttcctgtggtggcttcaagtagttgtccatgtaccattgcaattgagctatgctctctttgatatcactataagcagtgtgggcagcttctttttttggattacgtgcttgtaaagcgggattgtgtctgcgggcaacttccatgatgctactgacgtcaactattctgtaaaagagatgatcaatgaccttgggaaactcgcggaccatgaacaagcggtccatatgtacactattgcctgccaagacgccaacgttcttgtctgggatgtagcgctggatgtactcgagcagctcatcttctacctgggccaaagtcttctcacttgccaaaactttggcggtgagaccgctattaccgtggtgctcaatacaccactcgttcattttgttcatcacctcgggaccataatggatgacgctctcataatgcgagtctccttggccatcggccgctttgacgggtgccaggtgtccatcggtgatgatgcagcaaatctcgataattctgtcattcacgtggtctaaaccggtcatctcgcagtcgatccagaccaagggtttgaacagcttggttttaagttcgggtgtttgcgccattgattgcaggttttggatggttcgaggacgtaagtactgtgaaacggatcttctgtacagcgagaagaggtttgggcgagtgcgagctacgattcttgccggaaacaacaaccacttcatcttgatctcttctgtttatttgtgaaagctccttttcttttttttcattttctttgcaaatcgaaaagttcacactgattttttattagttcttttaagtgcccaacttgacaggaaaaagaaacaccccaaagggaataccagtgtatgtaaggcttgaattatacgtatgagcatgcgtttgatggttgtcgtcagagccagtgctctgagagtgtcccagatgactacaacccttgtataaaagtacatcttcttgattatttatcacgacacacgaggtgaccgattattcagaatcggtaccaaaaaagaaagaaaattgaaggaaatgaaaaattttcaatgtatttctcgaaagcctggagttgatcaaatgttcaaaaaatagggcagaatagcataacacacatcaataacaccgagccagcatgcctaccgtctccgtgaacaagcagcaattatttgatcttctaggcaaaaactacacttcccaagagttcgatgaattatgttttgaattcggtatggaaatggacgaagacaccacagaggaggccttgaaaaccggggaggagccggaattgaagcttgatatcagtgccaatcgttacgatttgctttgtatcgaaggtatttcacagtcgctgaacgaatacttggaacgtaaagaaagacctgactataaattaagcaagccaaccactaagttgatcatcgacaaatcaacggagcaaattagaccttttgctaccgctgctgtattgagaaatatcaagcttaacgaaaaatcttacgcttcttttattgccttgcaagataaattacatgccaatctatgtagaaacagaagcttggttgccatgggtactcacgatttagattcaattgaaggtccattccattacagagctctaccaccaaaggacatcaagttcgtaccattgaatcaaacccaagagtttactggtgacaaattgatcgagttttataaatctccagaacagaaaaacaacatagggagatacgttcacattattgaggattctccagtcttcccagttattatggacagcaaagatcgtgtttgctccctgccaccattaatcaatagtgaacattcgaagatctctgtgaacacccgtaacattttgattgatataaccgccaccgataagaccaaagccgagatcgttttgaacatattaactacaatgttctcacgttattgtgacgaaccattcacggttgagcctgtagaaattgtctctgaacacaatggccaatcccgtttggcgccaaacttcaacgatagaattatggatgtctccattaagtacatcaactcctgtcttggcctagatcaatccgctgatgaaattgctcattgtctaaagaagatgtcgttgcatgccgttcaatcaaaggaagacaaggacatcttgcacgttgacattccggtaactagacctgatattttgcacgcttgtgatataatggaagatgccgctgtcggttatggtttcaataatttgccaaagggtgagaaattatccaatgccaacttcattgccaaaccattaccaatcaacaaggtttctgatattttcagagttgcatcctctcaagccacgtgggttgaggttttaccattgaccttatgttcgcacgatgaaaactttaaatttctaagacaatccgacaatggtgatttagctgtcaaattggccaacccaaagactttggaataccaagttgttagaaccactttattgcctggtatcttaaagacagtcaaggaaaacagaaaacattccttgccaatcaaagtctttgaaaccggtgacgttgtatttaaagacgacaaactagaaaggaaggcgtacaatgaacgtcactgggctgccatctacgtgggtaagaattctgggtttgaaatcattcaagggttattgggtaaaatcatgcaaacttttagaacagagtggattgcagactacggtgctgctgcttctggcagaggttactggattgaagaagacgattctgtgaaaacctacttcccaggtagaggtgccaaggtcatgttcagatccaaagaaggcgctgagccaaagcaaatcggccacttgggtgtcttgcatcctgaagtcatgatgaatttcgacgttccattcgctgcatcctttgtagaggttaatgccgaagtcttcctataatgtaatgttctaacaaaaatttttactgatttataaaacttatatagatagatagacacatatatatatctatatatagaaacacaactaaagtttaccatgttttatataatattactaccgctactgagtaaatgtttagcttgtacttaactttcaaagacagtttttttgataaacatcagtacatttaataatacatccatacatttatgttaatttgtttttcctttccacctcagtgcgcttctcttttgaaaaaatcctcaacaggccacgcgaacaaatcttaccgagaatttcctaaaatgtttcaaactatcatttagctgcatacaatatgtacattattaattgagattaacaactttacctgtactttaccgttatcaaattataaaccaccaaaacaacagattaagaaacaatggccccaaacgtatgatactttaaaaggaatccacgcccgattacgaagtctatgttttactgttattgtaatgattgattgtacgcgaataacaaggaagatagtaaaaccaaaaaaaaaaaaataaaaatgtacgaaacgaagaagcgtctatgtgtttagttgcttttctgtattttaaaaattcactacttgaacattgaactctatatcgactcccttctttttatccgtttctgaatgtttttttgtttgagattgtcatatgtgattgttaatagcagtaggcaactttgtggtttcgggattgaaagaaaatcgtgaaatattcgttttttactaacattactgttctgaaaatttttactaattttcaatctttaatttttttgatatagacttccagaaagcaaaagattgccaagacctttaccgtcgatgtctcttctccaactgaaaacggtgtcttcgacccagcttcctacgctaagtacttgatcgaccacatcaaggtcgaaggtgctgtcggtaacttgggtaacgctgtcactgtcactgaagatggtaccgttgttactgttgtttccactgccaagttctctggtaagtacttgaagtacttgacaaagaagtacttgaagaagaaccaattgagagactggatcagatttgtctctaccaagaccaacgaatacagattggccttctaccaagtcactccagaagaagacgaagaagaagacgaagaataaattcattaatattattttaaatagagcataagttttgtataattaaaatcttctaaacctaataaatatgtttaatgaatgattcaatatcaaaaaaagaaatccattgggcccttagtgcatttttattttttttttttttttttttttttttctctttctgaattagagtacatctcatcgcagggtctctttttgcacgtttttgatgttgcttatgagacgctttgcctttttaacttcttcagtatattttaaatatataccaatttattcacaatatcattactcttctcagtttccaattaacatgaatcctaaaaaagtggcccaattgcccgttcacaataaatcaacgcttccaccacaggaaataatcgatctttttaaaataacattcttagaagagctatatccaaaagatcaagacaatgaaaagtcaccgttaactgaacaaatacaggcggtaaaatctgacctttataacagagattacaatgctgctttcaataacgactcgaaaagaatagcatattgttgtcgttggtcaccgtccagagcaacaagttacgcatcagtatttgcacatttccctgagcttctaaagattatcagatgcgaaattgatgacaaggactcaaatgtgctctgcataggtggcggcgctggtggtgagctggttgcattagcgagcatattcactttatcgagagatttttcgtctaaatttgcctctgctttgaaaatagacaacgaagtaaacaaaaagcctagaaatttaaacatacaactagtagatatcgccgactggtccacagttgttgaaaagctaacagctacaataaagtcgaaatggctatatggtgattcagaagcagagtcatttaacgtcaactttacccacaaggactgcctacaaatgacagagccacaagatatcaagatatatcaaggcctcgacctaataactctactttttactacaaatgaactatttacacagaaaaaagtggagagtataaaatttctgcaacggttaaacgagaactgtgccccaggctgccatcttctcatactagagagtgcaggaagctattctcacattaccatcaacaacaagaagttcccaatccaatttcttatcgatactatcttagtaggcaatagaaaggacaagggaacgacaggtccatggtcactagtatccgagaacgacagtatttggtatagaatggacccaaaactcgactactcgattccattggaaaacatgcgattcttttaccgtctttatgtcaagaactaacaggctttatgacgttttactgttctcttttcattgttcttttctcgaagagtttagaaaaattttttttcttctcatccacaccgaaaaaatattaataagagagttgaaaattcgatttggaatcagaaataaagaaggggccacgatcaaacaagactcatttcgaataattgtaaaaaaaaattagcacaaaacaatatgaccgttcccaggaatcgtcccatggcaccatttggcaccattatcaaatcaagaataaaacaaccccagttttattggtttataggccattttttaaccatctttaactttatacaatttcatctttcaatcacgtccaaacaaaaccaattgtcatgctatagaagatcattattttacatatccgttacatatgccatcgttctttaccagtttttcaaaagtgaccagttaaagttcaattttacgcttttgcgccaagagatgaagaaattggataatttgcagtattttgccatgctattcatactttttctcttatcacagtttaacatcataatcagcggctcgttatacagtcccgttatcttttcaatctttcacttcctgaactattttaaggaaaaccttttgccatttttgcctttgataccacttaatttgaaaaatttgttgaactccaaaataacggtattcatccaaaactacaatggatttttcttacagatggcgcaagtatttgagattatctgcggcctacgtgtgggcctcttcttagtgcccttcaattttttcttgttgttggtaagaagagcaaacgtgtcgtttgaggtagtgggtacaatgttggcaggactaacctatgtatggtttttcaaattaaggtacctacaaagtgaatctatgaggcagatatttaaacaatatgtccttaggttggatgcatatgtcagccgtactttgcccccatattgttcccgtttatggaacggctataagaatttcgttatgacagtgttttggaagatacctgtgtagcatgctcattttaagtatatctaaatattattttgtatatactcacactcctctatagaaagcaaaaaatttcaaaaacgtttgaaaagctttgtttaacgatacttgtacttaattttagagtcagtttcacccctcctctcccttttcatctgccttttggatttggattgtccctcattagcattttttgagcgattatctgcctgagtttgttgagcgccaggcatgaacatgtttttgaggccatataacttgtaaccagcatagatggggcacaatagtagacaccaccaaaatttgaatgtcctgaaagctataataccaatgttaccaaaaagtgatagatatatcaaatcaaaaaaatatgatatcaaatttgtattgtcgttcaagtctataccttgttttactacgcgattgccatcatatttgggcttaccggatagcacaatgatatacagagcaacgaacataggaacgttcaaagccaccagcttaatccattggccaattgtaaccttacgtgaaatgaatagacgtacgatagccattcctaaaaacaaagagacttgcttgtataagccctgaattatttttgcatttgaactagcctgtttcctccctgctttgccagccattctaccaacacaaacttagaccactgcctttggtgtcttcttgaagccacacgtgaatactacctttttttcatctattatctttttttaattacgttgaaatttttcatttcaaaggcgcagaacgaaggtcgactaatttcatgacagtcggtagacgtggagaaaaaagttgattgttaagcctattaagttccactgagacaaagacccacaaagctagctagcattgccgcacttctccagaacaatgttctcctttgtccaaagattccagaatgtatcgaaccaggccttttcaatgggaattgtaatggttgtattcatcatggcatcctcatactatcaattaatcaataataacgcgttctcagtacctagtaatatcgataacgtcaaaactttaataaatgttagaacaagtagatattttggctcacagagaggcaaggcaaaggaaaatatgaaaattaaatttgatctaaatacagatctcactcccctattcaattggaatacaaagcaagtttttgtctatctaactgctgagtataacagtactgaaaaaataacaagtgaggtaacattttgggataagatcataaaaagcaaggatgatgctgtgattgatgtgaacgatctaagatccaagtattctatctgggatattgaagatggaaaattcgaaggcaaggatttggttttcaagttacactggaatgttcaaccatgggtaggtttgctaacttacggtgaaactgtaggcaactatacactgaccgtggaaaataaaaacaaagtttagactagtctttgctctctcaatttttgttaattatttacatgattttttgatatatatgcagttgattatacaatatgatatatgcatttctagaatttactcacaggtaatactctcttagatttcctcagttctttaaaatatgaaagatgtctcatttcaatctgttcccatttattgatcttgcttcttggcattaataagtaatctttcataaaatacttgtaatttgatatgaagtcacgtacctgatcttctaaagtttttaaatcatcaataccgtccaaatatgtgtctaactgcctcattatactgttatatgtatcgctttttaagtatagtctgggctgaaatttattgggctctttttccttcatttttaatgttggccaagatttatcactggactgcgtcttatcctcggatagtttcgttaatagtctaaatttatggatcaaattatacccatgaattagtgtgtcatcaacgattttcataccatacgaaagggttcttggatccttaaataacgcttctacagcgctgttccacgatatattatctaaaataaaacctttttctcgcaatttcttccacagtaatggcagctcatcgattttattcattgcaatcaactgacttactttataagggaacaatccgctgaatatgcttcttagtttaatatttggcgttgtagatgatggcaagttttcaatgttttcaatacgatccatgtatttagcgaaaagtgtttcgaaatctttccattgttcaatttgagctagtaataccaacaatgatctcatcatcacaaatttattattatttgatatccaatcatgctttttgaagaaaagctcattgtaccggttgtataactctaaagcccgctgtgggctatcatgtttcacaatcattctcattggccatgccatgaccgagggatgcagtttgttatacgtaacgtcgagagttccattggcagcattttccatgatgtcttctaccatattaatcgtttccttgatttcctcattattttgtaggctttttttggcaacggccttcaatatataatataaaattttggaattcgctggtaccttattctgtgacattgtcttgtacaagttaattataccgtcacgataaccctctttgtcatatgcctccattattatttcaaaatgtgtagcgtccaccttgattacagaatgttttattagttgatctatgatgctcaatgccgtttcgcaatcttcgttcagtgtaactaaaaattttatcatcatcttgtaaaattcactgtttacagccagttttgaggttgtgatcttgtcgaaaagttcttcacacttgttggcatttcgtaaaccaatataagctttgatggctttgttatacactgaaattagaccatctctccaagataaattctttgaatgtttttcaaataatgctattgcctctgttggcctgttactctcaatatatacatccatcaatgcagagatactttttccagtgtgttggatattataatgttcagtcataaggttgaataattcttgagcgattaaatggttcgtagttttgcaacacatttgtatcaataaagcaaagtgcccctccgtgatttccacgctaggatcctcgcttagtctttttaatatcctaaacgcaccatcaaggtcatttaaaccacgatacactttaagcattatggtatgcgttgctgttgaaggcgttatgtcgtatttcttgaatagttcgaagtggctaaaacaggctgcgaaatctccgactttataatgtgcatatagtaaagattgtaaaacagcgtatgtcggtatcatacctctcctcaataactgtgtatatagtttattgacactatccaattcaccaattctggccatagtatacatcaaaataccataatgttgtatggaaggtagcttaccgataccgaaaagagcattgaactgttgttgtaaggcgtcccaattatgcagcctagaatgagccaccaaaagataatcaaattggttttggtcgtgctgagcatcagggtatttccaatatgttgacgaaaccaaattaaacttctgcatgtgacaatacgtctttagaatacacgtcaggtcagaactcactatcggcaggttatgttcgcacttgtaattccaaactgcttctgcagaagaaaatttcctaatataagttaataagaacaacaacgtagttgcaaattgagacgctattgcgggcccttgcgttagctgaattgctttcaaataagataaataatcggggcgaacatttgattgcctcatgaatgataaaaagtttctcaaaactatcttgttctccatataattcgtaaattcacaatgtccattcactagtttcatccatttgacccatttatatacagcttcttcatgcatattcattataaccatcctagagaaaatcgagttaatgaggtctatcaccattgtcttttgtgttaatagaaaccgttgtatgatatcagagattgcctgatctaattgaatacctctttgtaaaatcaataaagagagaaggaactttttcaattcaggtaatgaggcatcctgttttaacaatctttgtgaaccaatagtggtataaagaaacttctgtgcaatttttataacgttcccataggcctggtgccgataaagatactttataaggtactgtcgttcaaatgttgtggtagctgaattacttgttattgatgttgttgctttctttgttaatccactgccaaccgactttagaggaacacttccgcgcgccataaaatatgagaccaggtttctctcatcctgtgagcataatggtgacgtcgatttatctcgaagcagcttccttatatgatcaggtacgccggtactccatatacccttcttataattataatttcttaatacggcaggagcacaccttttcataatggccaaaaagcgtgtttcagtatactccaacacccttaatcacttaaattcgaagctttgtacactattgcggcctctttcctgggtatcgaggctgcgttagcgtcacctagaaatcccactttaacttacactacatgattttttatttttatttctctattggcccgaaaagttacttttccttcaaacaatgaaaaatttcaaaatcaaacctcatcgcgatagtattaaaagtgctttcacaagaatgatacaggaaggtggtcaagtaagcaactgagcaaaatcaatatgggtacagccaagcaaaatcaaaatagaaagaagtttacgagggagtataaggttaaggagatccaaagaagtattacaaagaaaactagactgagaaaggaataccttaaagctttaaaagatgaagggtatgccgtaccagaaaaggaaccaaaaaccgtggcaaaagaatctgtaaggaagattaaggaagccagggcaatagagggaaagaagaaactagacgagaagaaggagatcaagaaacaaagaaagagaatgcaaaaagatgaattaaacaagcaaagaaacgagcaattggaaagaatcagagtttcgaaggaaaaatttcagaggagagaagatagaaagaagaaattgactcaaagaacaaggacaggccagcccttgatgggccctaagatagaggatcttttggataaaattaagacggatgatacttatacctcctagataatgatattcttcaaaatttcttttcattcgtgtatttacagaaagatctttttatttaaatttacttaattagtgtgtatattaattttatttcctgccttttgttaattcctttttattggaatttgttatttacaagactgttttgcccatgaggacttgactatttcttcgcttgcttcttttggaactcagatatcaattctttttgaacatggggcgctgttggagcgtaatgactaaactctaatgaaaactcacctttaccttgagtcgaggctcttaatgaggtggcgaaaccgaacatcgtgctcaaggcacattctgcttttaatgtaaattcatcatgaccattttcggtatcctgtattactgcttgtaatttattcaataaaccgatgacgttaccttgaaactcgtttggcgatgttactgaaacattcatgataggttccatgatcaccggctgtgccctcaggaaggcgtcacggaaggctgacatagtagctgttttgaatgataattcattagaatccacggcatgaatagcaccatcattgattagcattttaacatccaaaacacgatgaccgatcaatggtcccttttcacatacttcttcaaaacccttaccacatgcagccaaatacttgtccggtatacggccaccaacaatagcggtctcgaatatgttgcctttggtaatgtcatccacgggagataaggtaccgataactctaccatattgaccagcgccaccagattgttttttatgtgtataatcaaaatctgccgggatggtgatagattctctataggaaacctgcggtttacccgtgacacagtccacattatattcacgtctcattctttcaacgtaaatctccagatgcaattcacccatcccagaaataattgtttctttagattcaggatcgaacttcactctgaatgtagggtcttccttttgaaatctgttcaaagccttcgaaaaattcgatgcgtcctttgaatttggcgtaatcgataacgagacaacagcatctggaacatacatggatgacatagagtattgaacgctaccatcagtgaatgtatctccagaagcacagtcaataccaaaagtagcgcaaatttcacctgagccaacttcatcaacatcttccatctcactagaatgcatcctgaccaatcttgcaaccttcacttttttaccagtctttacatttgtaatgtaattaccttttcttaaacgcccctgatatacgcgaacataagtcaattgaccatatttgccttcttccaatttgaatgccaatccaacaaatggctgttgcaccgcaggaactaagttaaccttggcttcgttgttgctcacatctagagctgtattcaacacttcagagggattaggtaagtagtctacaatagcgtccaaaacgggctgaataccagtatttgccagtgcggatcccatcaaaactggtgtaaaagacctagcaattgtagatctgcgaatagcatctttaatttgttgcgtggtaggctccttttcttccaaaaacatttctgccatttcatcatccacatcagcaagtgtttcgatcaaaagttgtcttttttcctccattaatggcttcaaattttcaggcactggccctttttctataatttcaccattatcacccttgttgtaaatagcaactctattaatcaaatcaacgacaccagataagcttgattccgatccgataggaatttgtacagcagcagcaggtatttttagtttcgaattaagttgttctattgcacggaagggatctgaacccatacgatccattttgttgatgaaagttactcttggaacattatatctacgcatttgacgatccacggtcacagtttgggattgaacacctgaaacagcacaaacaacaagaactgcaccgtctagtactctaagagcacgctccacttcgatagtgaaatcaatatgacctggagtgtcgatcaagttgaaatgatagtttttgccctctttatcccaagagcagtaagtagcggcagactgaatagtaatacccttttccctttcaagatccatagaatccatcttggctccaacattatccctaccacgaacctcatgaatggctttgattctttttgtatagtacagaacacgttcagtgaaagtagtttttccggagtcaatatgagcagatatacctatgttacgcaatttattacatcttccaatatcgtctggagtaagtttttgtttgatttcatccaccaaaactttttcttcttcatatgtagaacgagcaagtggactctcatgaaaagaccttctcgagaaacctgaaaaaacttttgaacatgtgaaaaagggtattctacctccaaccatttttcgaggcacccacatcattttctggacactcatattggtgatatattgcagtgctttctaccttcttccgtttcaatctcctttattaaatctcgttttttagatattttcatcttggaaatttcggccgcttgtgaagttccatccccacaataataatgcaaagttatcatattaatatatatatatataaaagacatataaaaaaaatcaaatgtattgtgcatcttggatgccaaaagttacattttctttccttcattccgggccctcaatgatcgtcttgatattatttaacgggtggtggcttgtttcttcgaatgcctcgacagcatccttaaagctatagcgatgtgtaatgaatggtttaagcgagagttttctgctagagactagctcgatggagtcactataatcaccttgacagtatcggaaacagccttggaatgtcagttcttttgttggaatgatcgagatgggaaattgtatttcctcttgtcccattccaacttgaacgatcgttccacctgccttacagacttcgatgcctgctcgaacgcaaggctctgcaccagaacattcaaacacaacgtcagcacctttcttgccgattgctttttttataacactatctacagtaacgccatgtgggagatcacctgagttgacgatgtgggtggcaccaaactgcctagccgtttccagcttgttttctaatagatctacaaaaacaacatctgcagcaccaaagacactggctactttcccggctagcaaacctatgggcccagctccaaagacgacgcaacgggctccaaacttgatctttgctaatttattagcatggattgccactgataatggctctattagtgctccttcctcgaatgacacatcatcaggaagtttatagacgaaatctttcatggtcttataatactttgtcaaggtcccatcaaagggaggtgtcgcagcaaattttaaattggggtccaggttgtatctgccctctttcatctccggtgaaaacctgtcaggtattccgggctcaagtgccaccctatctcctactttaagtgtcttgacgttctcacctatgagggccactattcctgatgattcatgtcccagcaccattggtgattctaccacgtaattggctattcttccatgggtatagtaatggatatctgacccgcatattcctgtcgccttgatctggatgattacttcgttaggatctgaaatctttgggatgctgacattagttagggtgattttaccaggtcgctctagaacaatagcttcttgtgtagttaagtcagtcatgctcaatggtgttctctatcctcaaggcagtatgaatatgtctttttagtgtgtatggatatatttatgtatatacttatacagttttcaattttattttgaattaattcaggagaggggttacaatctcctaagggatagtagcgccggtgacattttattcgctctaagatgaacttgagttcgagtccactttgaggatattatggatttccattaggataggctctatctcactgggatcgcaagccacgccattgcccaaacgaatggcatgtgatgcgtttgcgggtttgacagattctggggtacctaatctcttagtatccagcataaatacttgatttctcacttgatgcatcattggataggcgggagatttcgtggttatgtgtgctacgtctgcaaaatgaatgtgaaattgaattttatcacggccgttatgcaaaacagttttcaattctatacatattgtaatcttagtgcctgcctgagggttataatatactatctgatactcgtttagattatgcaacccaatgttcaccatagtggagtactgacttccactctcatggaatttgccccctctttcattgagaattacttttagagctttaaacaaggatgacgtgaattgtaggtagctaaaaataaaatgataatccattttcgaattatctaagaaaggttgaattatatgttgtgggtttgaaggtgatagttgaactgtcagatttttaatagagtcgtcattcgttgatatctttattgtgcagtctttatcatcttcgtcattattggagagatacttgaaggaaatttcattcggttgtaatgcaattatcttgaagttttcggactcaaaattcttgtgcaatctttccacgacatccgttagtacaaccaattgcatcaatttttgcctaaatttggttagatattgcactattataccaagatttgtaaaactctcctccaaataaaaggctaacggttcttcttgtacaaaatgaatgtatagtttatcaatctggcattgaatcatcattgtgtttcttttaaatttagcatacaatcgtatttgggaattggagtaatctatcctcagaaacatggaactttctaatatggagttcagcgcttttgaaccttccaaaaatgactccaattctagagttattattgatatgttatcattagtattacttccttggataatatattgaggtagtttttgctcgttgatcatttcagaagaacaaatcttattgcgaatttctagttggttcaaagaatcgatcaacatatggtttataattctgtttaaaatagttctttgcaatatcataattttttgatatgttattgactccaatttgacagtcatcacgttggaattgtctaaatatttgagattccatttcccacgttgagagacaattttaccgattcttttttccaccacacatgatgttttagaggatattatcgataaaatcaaataccagttgagcggccaatgtggtagtctgataaataggtccctttgtaataacaaggaaacatcactattagtagtgctgttaccagcaatagcatatttattatcttcttttttaacaacgctttcgccgccagtattcacttgagtcctgattggtttatcaatcttaataatcctgctgcatgaccatcccgtgttttcaaacatggtggttaaaacatgaataatcttgtccagtttcagctgctgtagtattcttgccaattcctctggaccttcagctctatttatctttgacgcgtaatttgataatagtggagtaggattcctaaaataaaactgcccgctcaataaatcaatttttaattgaataggcgccatggaaacacatgtggtagggagttgaaataatagaacatccgaattttcttcgtcttcttggaatatatcccttgccaacagctccgatctgatgattctagcatgattgaacataatttcatccaaaatcccttcgatattagatacaatattgttataaattacaggcatatttttggcccttgatgcactctggttgtcccattttaagataagactttctgttgttctttgaatgccaatagtgatcttacccttactgtccattttcccattcagccaatatctaactgtaattgtactttttttagagtcatagttatggatcaaattacttttggaaaatttaccgccgttggccagctttaaaaactctctatgaaccatgtatagctgtaatgtcaacacgtatttgtgcagaaaattgtatagggataataatggatcattacttttcaaaagaatttcattgatcaacttctctaatcttggcttattcaaaggaaggttatttccgttggaacttgagttttcttcattgttctcactatcgccgttagtcgaagtagcttctgtaactgctgaaacagtttgttcagcttccgtgttaaacaacaattttaaatccacaaaaaacagaggggactgtctattaacagtcgataactggatttcaaattcattagggacagtaaagtagattctaccgtttttgatatgatagctgtttaatggtttaggaatgttcattaatgcaatttttattgagacagtcaagttcaaatcttttaatctctgtaaaatcaatccaatgggaactttggccattccatctaccatatccatagagttactgacaccgcttaatttaaagttgtgtgtaggtagatttggcctcccaagactcaaaacttccaaagcggtgaccaaatccacgttgggcaatttagcattggtcatagagtttagactgcttttcaaagcccaaatacaattgttgacattcatgttagtcgttctaaaccagttcaacagatcgattagtacgtgaaagttgttttgttttatagtacgggtccatttcacaagcacgtaaagtttcaaaaattgtgtccttaggaatataatcagctgtaagaaacgtattttctttgcggagttaggctcatttgcctgggtgtgaacattagttttcatgtactgagcaagttccttcattgtaaataccgtcaagttccttattactaatgccagactgacttgattaatctcaacatgcggcaacgctggcggaggcgcacttgtcatagtcgctgcacttgtatctttcggtaccatttctagagattctttttgggtggccgtagtttccgggtcggttgcagaagggccatgcagttgagtgttcttaacgggaccctgttgctcttgcccattctgctcggaccggttcttcagtgcgtgcatctcgttagaaagtctctcctcattagccagcatttgtggggatcctatcgtggtagtcattgcccagccaagaaaaccctatactttcctgccactttttaactctttttctgatgatctttacaacagacctctactaaacaattgaaaaattcaccgtttttacttgaaccagcgaccgtgcgatgggacaatcgtttagttaacaataagcgggacaaagtaattaaatttagtggcatctagagagaataattgaacgcaatgaagagagcatggtacgttgaattgtagaatgtggggggatagtatgcgcgagcttggtgacgctatggataatgagttgaatgcagtgaagccggtggtggaagaaggtggcatggatggtgccagaaaatttattaagggtaagagctttcagaagtcttctaccgaacatatgttgatttcgcccggtagggatggttcagtgccattgaatgggttgaaatcgtcgccggcagacccgcacttgtctgatgttaattctatcttggacaatcatcgtggcggtggcgagacagctttgacgtctgtaaataatattatcatggccacttcgacgaatggggacagtgatggggttgatggagatgccaagaggccgtctatttctaactgttcgtcgagatcatcattttttgacaccgtactgagcacgttttccctaaaatcaaattcacaagatacggttactaatgaagtcaaaaatattgaggtccagtttgcatccgaggaggctaataaaaaattccgccaaatgttcaagccattagctcctaatacgagacttattacggactacttctgctacttccacagagaattcccctatcagggcagaatctatctctccaacacacatttatgtttcaactcaaccgtgttgaactggatggcaaagttacagattcccttgaatgaaattaaatatttagataaggtcaccacaaattcaagtgctatttcggtggaaaccgtgactaacaggtacactttttccggattcatagcgagagacgaggttttccaattgattacaagagtttggtcaaaggaaaacttaaccaatatcaatgacgttttggaggttgatgagagggtctccaagaaaaagggaatatcatcgaccccttcttccatattcaacaatgtttctaccaatgcatataacgatttcatatcgacaaccactactgaaccaacaagcagggcttcctacatgagcgagaacgacatgctcatcgaggaggccataaggtccgtggacgattacatgggcacaccaagagcatcgccatcttcttcatcttcgtcgtcatcgtcgtcatcgtctttaggctcttcaacaacttattattgtaggcccgtatataggttaaagccaaacgcaccatttcaatatgaggggccattccatgtacaagaaaccatggactttccttataaacctgaggctaataatgaatacgtgcttctggaacgtcaattcagcgttccacccggcctacttttcattatgatgttcaatgaagataatccagtttttgagttaagctttttgaaaactcaagattcgtccaacatctcacacatagggacttttgaaaaagtcaataaagatggacaacattacagagaattccaatacaccaaacagctgcatttccctgtggggcccaaatccacaaactgtgaggtagcggaaattcttttacactgcgactgggaaaggtacataaatgttttaagtataacaagaacaccaaatgttcctagtggtaccagtttcagcaccagaacgaggtacatgttccgatgggatgaccaggggcaaggttgcatattaaaaataagtttttgggtggactggaacgcatccagttggatcaagccaatggtagagagcaattgtaaaaatggacaaattagcgccactaaggacttggtaaagttagtcgaagaatttgtagagaaatacgtggaattgagcaaagaaaaagcagatacactcaagccgttgcccagtgttacatcttttggatcacctaggaaagtggcagcaccggagctgacgatggtacagccggagtcgaaaccagaagctgaggcggaaatctcagaaataggcagcgacagatggaggtttaactgggtgaacataataatcttggtgctcttggtgttaaatctgctgtatttaatgaagttgaacaagaagatggataagctgacgaacctcatgacccacaaggacgaagttgtagcgcacgcgactctattggacataccagccaaagtacaatggtcaagaccaagaaggggagacgtgttgtaacagagtaatcatgtaatattgtatgtaaggttatgtatgttcgtatggtatggaaaaaaaaaaaaaaaaaggatgctatgtggagaatgtaaggcgtggtagctccggataattcagtctgtaggcttcatcacgggcagtggcctgactctgagagcttgctccggtattaagttgtgcgtttgaaattttctggaaaaaagaaattgattggttgaagctatactcgtcgaaagatttcttcggcagtggttgttgctccacctgcacgggagttgtgtttgcgtttatgttcggcttggctatattattagcgagtgatgtttgcaatttgctgtattgagaatcaatttgggtgcgtaagctttcaataattttgcagaccgcaggcacttccaactttatgagttgcaggtattctcttttatgaatatacgatgacgacgatgacgacgacgcatccatgcgcaaaagctcagggtgtctagatagtttgttagtcaataaatccacatatctaaaataataaataaacgacagcgacaagtcgttggcctggaacgcacactgtgccttttccaatatgccgatgcatgttttcaggtaaattctcaatggtatcgccggattgaagcgataatccttagcgtcctgaaccaattgcttactagacttcatgacctaccggggccagataaagatgcggaaggaagagaaaaaatgtatagtggttggtgaaccgcaacaataattcgtgccaacactttaatcgaagcaaaaattgtcttgtatgttattaatattatctatctaaccattgatttacgtataaaactgtcgatgctcatcgcctagcaatgaaaaaattttttcttttttttttcattatttctctttgttgcgtactttttttcattgcgtttcgcggcaaaagcgattcgagttgactggaagtgtgttatactataaaaagtgtatatgcctatttttggttctgatctttactttactgttaagtactggctgaggcagtagactctgcctctgttacggcagcggtattcgcctcggcatcagcagccgcccacggtagagtaggttctgttgttttgacgtttgccaaggtactgtccaaatgctccttcagcaaggcctcattactttccttctccggacccaccgattgcgtgatctcctgtacacggttcaagaacttgttcaaattgtagcccgcagcagcatcagagacttcttgtgtgtaagggacacccctcaactccttgactcttcttttgtgcactttgccctttaaatgcgtttttaacgctatagcagtctccatgtatttggcacagtgtatgcaatagtgctgaccaaggcccggtttggtttcatccaatggctggttcagaagcttctgtactgattccttggtggacaaatcgttatagatcaggtccaagtctcgtgttcttcttttagtcttgtatctcttcaccgaatatctacccatgatgcgctattgttttatcttcacttgtctgtgtgtttaactgcctttcaattcacctcatctcatctcccgctactttccatatataaaagcaaaattaatttgctttttcccctgtcagtataaaaaaattttccgcaggatatagaaaaaaaagaaatgaaattatagtagcggttatttccgtggggtgcttttttacacctgtacatcttttccctccgtacattttttttatttttttttttggtttttttttttcgatatttttccctccgaaactagttagcacaataatgctgactaaggaaacttttcatctcagaattgatggtcagtttggtttctctagagaatagtttataaaaagatgttgatgtggagcaaccatttatacatcctttccgcaagtgcttttggagtgggactttcaaactttaaagtacagtatatcaaataactaattcaagatggctagaagaccagctagatgttacagataccaaaagaacaagccttacccaaagtctagatacaacagagctgttccagactccaagatcagaatctacgatttgggtaagaagaaggctaccgtcgatgaattcccattgtgtgtccatttggtttccaacgaattggaacaattgtcttctgaagctttggaagctgctcgtatctgtgccaacaagtacatgactactgtctccggtagagatgctttccacttaagagtcagagtccatcctttccatgtcttgagaatcaacaagatgttgtcttgtgccggtgcggatagattgcaacaaggtatgagaggtgcttggggtaagccacacggtttggccgctcgtgtcgacattggtcaaattatcttctctgtcagaaccaaggacagcaacaaggatgttgtcgttgaaggtttgagaagagccagatacaagttcccaggtcaacaaaagattattttgtctaagaagtggggtttcaccaacttggacagaccagaatacttgaagaagagagaagctggtgaagtcaaggacgacggtgctttcgttaagttcttgtccaagaagggttctttggaaaacaacatcagagaattcccagaatactttgctgctcaagcttaagttcttttcaaacatttgaactaacttaaaagagaaatttttttgatttaaattctagtttattaaacagtaaatatatttatacattattgtaatacatataattatgtgtttttttaaagttcagcatgttgggtagtgatatatcctgaagtcaatggacactgttgctttttgtataccagcaggaaaaaaaaaagcctgagctgcagtaacgaagaattgttgaatgcgtctaacaagaaagggagcaatcgataacagggacgtgcgccgctaatgtcattcagattattcacgaggacttctcaacgtctccctcgccttaactgggttagtcccatcaggcgatacgccaaacaacctcaatacgatgaagcagagttgtttgcagagaacattaaccatggcgcatataaagcaaagaaaaggccatcagacgagcatttccaatggcctgagaagtctcctgatcagatcacaaaggaatctgaactccaatgggaaaggatggcgaaattatctgctgttgggcaagggatcctcattctcgtggtagtgggtgggttgggaacggcctacttgcgttggccagaattaaaatcctggtggttaatcaagatgaatggcggtcgcataaatgcaacgcaagagcaaagtggacaggattcgttggaaaaattgatcagacaaaaggccaaaaatctattaagggagattcctcaagtgcctgcctttcaacttggaatagatcatcctggtgtatacatatggggaaggtgtcattctaaggactcattgttccctgttagagtacctaatttggatggtcgtaaattcagagatatcctattagctccctctgacgatttcaacaccaattttgcaattgacgagaaaggcgatttgatatcgtgggatgatttgggacaaacaaaaacgatattgccagatcaagatttgacctcaatgaagtattctagtcactttttgtacgctttgaataaaaagggtgaaatattggtcatacctataagaacgccggatctgatagcttcgcaagtatcatcaagaaggtcgaaattgttgccatggaagacaaaactaagatatgattggaaattacaaacaaatcagattttcaacggtaaggaaggagaaaaacgtgtagtacaatttgacgctggtagccatcatctggtgttgctatctaatttaggtaaggcttattgctgcgcgacgggaaatgatcaaaaacaagctcaagtatccaaaggacaattcggtataccaacattctcacaattcgatgagtttcctcccaataatcaactattcgaaattgaactgctgaacaaatttaagcatgaaggagaagacgttgtccgcaaaagagaaattaaaaagatagcttgcgggtcgtaccatacactggcaatagataagactggtgaaatttatgcctttggctggaataggttcggccaattggcactacctatttcgtacaatctagaatatgtttctttcccaagatcggtaacgcatgcatttaaaccgcatttcccggggatgacgaattggaaatgtgtggatattcattgtgatgatgaaacatcgtttgtgaccattcgtaagcctggctcaacgtcagaccatcattatttcgcgtttggtaatggactttttggtgaattgggcaacaacactttcaagaactcgcaatgtgatcccataaaaatcaagtcggatgacaagaaattgaccaactggagttgcggctctcattgtgtgttcactgaaactgaacaagaaaacgaggtcattgcatggggtaataacgaccatggccaactaggtattggaaagaaaactatgaaatgcgctaagccaatgaacattcccgaagttctcaaaccaggacaagacacgacagatttggactcaatttataacagtaaattacacttaaaaaaggagcaacgtgtagtcaccaatggtaataaaagttgcttatactggcgggtttgagaaacgaaagagcatagaaggaaagtagcgagattcgcgatgttttttcaacccttataatgatgcatgtatatatggtatgtttatttatatatagaactcacggttacttctatcttaaccatttcaacacataataaatacctatgatcaagagaattaacgcgatccaaaagactagtttatctttgaacacccgtttattgatagaggtgatagtttgttccgaaacacccaatgttcttaggccatttgacattctatcttgtaccttggataaaattttgttttgttccactatattttcgaatgattgttggcccatttctagaatgtaatctaattgagcgttacccctttcgaaaacagactgttccttttgtagcccttggtacaacggtagtcccccaccgttgctagagccctctttaccatttgcactcgcaccaccaacgttccttttattcatgatggtctctgatgtactaaaggggttatcggagtccataacatgcgatgctcctgagccaaacaactgagttctggaattattttcgttgtaggattgttttaaatccttaaacttggcagtaaagtcgtgcagatcctgtgttaaagttgctagtcgattagcgaacttaggatcaatttcctctgcattagtatcttctttatatctgtttaaatgttctgcatattgcttaactgttttctccagtgagaccagagttgcagagatggacccttgtaaagaaataggggcggtcacagaattcttttcaaacctggccaactcttgttgtagttgatttttttgcttcacagcatggttgtaaagagcgttctatttgatggtagtagcaaaataccctgttagtattacatcttgttttagcaataatgagaaaagatgcctccggcgatcaaacataccattcccccctcaaatcaatatgattaagtcacgataatatctgcactattgccgtgtttccttctccatcgacagcgtcgatcctgtctattatagccagcacactgaaaatttcaatggctggcttgttgttcgcgtcgcaacttttgatatttataaaaagagagaaggcatatccaaaggataaggtattgtctttgtaaatcaatcaaccaaacctctacggaattttgacccttgaagcagggactattacacgaaaatgactccttccaccccaccaaggtccagagggactaggtaccttgcgcagcctagtggcaatactagttctagtgccctaatgcaaggtcaaaagaccccccaaaagccttcacagaacctagtccctgtcactccctcaacaactaagtcttttaaaaatgcgccattattagcacctcccaattcgaacatgggtatgacctctccatttaatgggcttacgtctcctcaacgctcgccgtttccaaaatcttcagtgaagaggacactattccaatttgaaagtcatgataatggaacagtaagggaagagcaggaaccattgggtcgtgtaaataggatattgtttcccacgcagcaaaatgtggatatagatgcagcagaagaagaagaagaaggagaagttcttcttccccccagcagacctacatctgccaggcagttacatttatcacttgaaagagatgagtttgatcagacacatagaaagaagattattaaagatgtacctggtacgcccagcgacaaggtgataacatttgaattggcaaaaaattggaacaacaactctccgaaaaatgacgccaggagtcaagaaagtgaagacgaggaagacatcatcatcaatccagtgcgggtgggtaaaaatccctttgcatcagatgaactggtcactcaggaaattagaaatgaacgtaaaagggcaatgttgagagaaaacccagatatagaagacgtaataacatatgtcaataagaagggagaggtggtagagaaacgaaggttaacggatgaagaaaagagaagattcaagccaaaggcattgtttcaatctagggatcaagagcattgaagaaatgaaaaaaaaaagtttctggaacgattatattttatttacttacttattctacatttatttgcaaaggggcattaacatcaacattttacatattataatatatacaggatattctatattacaacattaacaggatttttaacttttccttaccgtattcttttattctggttttctgtcttcagaataatagcatatttcattgtagtatttcgtcaaagcgagttaggggaggatgactacaagaaagacagcttcctctcttcagcttttagggaaaatcacaggaacaaaagctggaactaagcaaaagaagatgaatttcattaatggactgatatggttatatatgtgtgtgtggatggtacacggaaaagtgacgcagaaggatgaattgaaatggaataaaggatactcgctaccaaatttgctagaagtgacagatcagcaaaaagaactttcacaatggactttgggtgacaaagtaaaacttgaagaagggaggtttgttttaactcctggaaagaacacaaagggttcactttggttgaaacctgaatattcaataaaggatgcaatgacaatagagtggacgtttagaagtttcgggttcagaggcagcacaaaggggggtcttgcattttggctgaagcaaggaaatgagggagatagtaccgagttatttggtggaagttcgaagaagtttaatggtttgatgatattgttacgattagacgataagttgggagagagcgtgacagcgtatttgaatgacggaacaaaagatcttgatattgaatcctcaccgtactttgcgtcatgtctgttccaataccaggattccatggtaccatcaacattaagattgacttacaatccactagataatcacttgttaaagttgcaaatggacaacagagtgtgtttccagacaaggaaagttaaatttatgggcagcagcccatttaggattggaacaagtgctatcaacgatgcatccaaagaatcgtttgaaatcttgaaaatgaagctttatgacggagttatagaggattcgctaattcctaacgtgaatcctatgggacaacccagagtggttactaaagtgatcaattctcaaactggtgaagagagtttcagggaaaagatgccattttctgataaggaagaaagtataacgagtaacgagcttttcgaaaagatgaacaagttggaggggaaaatcatggcaaatgatatcgatccattactccgcaagatgaacaagattgtggagaatgaacgtgaactgattcaacgtttaagaccactgttagatctgaagaaaacagccataagtgacgatagtttccaagattttctttcgatgaacgcaaacctggacagattgataaaagaacaagaaaaaattcgacaagatgccaagctgtatggcaagcagaccaaaggtcatgatgagatattttccaaaataagtgtatggttggcactgctgattttcattatgatcacattggcgtactacatgtttagaattaaccaagacatcaagaaggtcaaacttctgtaagctcttgtgtctttgttatatgggtacaagatataagaaacataactattacatacgaaaatgtgcatgttatctatatccttctttatatagatgctgttaacttctttttttttttttgggaaaatcaactgttaaacgcgacagtaaaagcagcaaaacattaattttgcttccaagacgacagtaatatgtctcctacaataccagtttcgctgcagaaggcacatctattacatttactgagcataacgggctgtactaatccaaggaggtttacggaccaggggaactttccagattcagatcacagcaatataggactagaaaatatcaggtagccgcactcaacttgtaactggcaactactttgcatcaaactccaattaaatgcggtagaatcttttcacaaaaggtactcaacgtcaattcggaaagcttccttccggaatggcttaagtaggttgcaatttctttttctattagtagctaaaaatgggtcacgtgatctatattcgaaaggggcggttgcctcaggaaggcaccggcggtctttcgtccgtgcggagatatctgcgccgttcaggggtccatgtgccttggacgatattaaggcagaaggcagtatcggggcggatcactccgaaccgagattagttaagcccttcccatctcaagatggggagcaaatggcattatactcctgctagaaagttaactgtgcacatattcttaaattatacaacattctggagagctattgttcaaaaaacaaacatttcgcaggctaaaatgtggagataggataagttttgtagacatatataaacaatcagtaattggattgaaaatttggtgttgtgaattgctcttcattatgcaccttattcaattatcatcaagaatagtaatagttaagtaaacacaagattaacataataaaaaaaataattctttcataatggcagttgaggagaacaatatgcctgttgtttcacagcaaccccaagctggtgaagacgtgatctcttcactcagtaaagattcccatttaagcgcacaatctcaaaagtattctaatgatgaattgaaagccggtgagtcagggtctgaaggctcccaaagtgttcctatagagatacccaagaagcccatgtctgaatatgttaccgtttccttgctttgtttgtgtgttgccttcggcggcttcatgtttggctgggataccggtactatttctgggtttgttgtccaaacagactttttgagaaggtttggtatgaaacataaggatggtacccactatttgtcaaacgtcagaacaggtttaatcgtcgccattttcaatattggctgtgcctttggtggtattatactttccaaaggtggagatatgtatggccgtaaaaagggtctttcgattgtcgtctcggtttatatagttggtattatcattcaaattgcctctatcaacaagtggtaccaatatttcattggtagaatcatatctggtttgggtgtcggcggcatcgccgtcttatgtcctatgttgatctctgaaattgctccaaagcacttgagaggcacactagtttcttgttatcagctgatgattactgcaggtatctttttgggctactgtactaattacggtacaaagagctattcgaactcagttcaatggagagttccattagggctatgtttcgcttggtcattatttatgattggcgctttgacgttagttcctgaatccccacgttatttatgtgaggtgaataaggtagaagacgccaagcgttccattgctaagtctaacaaggtgtcaccagaggatcctgccgtccaggcagagttagatctgatcatggccggtatagaagctgaaaaactggctggcaatgcgtcctggggggaattattttccaccaagaccaaagtatttcaacgtttgttgatgggtgtgtttgttcaaatgttccaacaattaaccggtaacaattattttttctactacggtaccgttattttcaagtcagttggcctggatgattcctttgaaacatccattgtcattggtgtagtcaactttgcctccactttctttagtttgtggactgtcgaaaacttgggacatcgtaaatgtttacttttgggcgctgccactatgatggcttgtatggtcatctacgcctctgttggtgttactagattatatcctcacggtaaaagccagccatcttctaaaggtgccggtaactgtatgattgtctttacctgtttttatattttctgttatgccacaacctgggcgccagttgcctgggtcatcacagcagaatcattcccactgagagtcaagtcgaaatgtatggcgttggcctctgcttccaattgggtatgggggttcttgattgcatttttcaccccattcatcacatctgccattaacttctactacggttatgtcttcatgggctgtttggttgccatgtttttttatgtctttttctttgttccagaaactaaaggcctatcgttagaagaaattcaagaattatgggaagaaggtgttttaccttggaaatctgaaggctggattccttcatccagaagaggtaataattacgatttagaggatttacaacatgacgacaaaccgtggtacaaggccatgctagaataatgcgtttgaagtgagacgctccatcatctctcttaatttttcatgactgacgttttttcttcattttaattatcatagtatttgtttgaaaaaaaaaaaaaaaaatttcccttatcaatgatatccttacgattatataaattccttacctaaacctattatttgtgtacatatatcagagtattattacatatataacctttttctctaaaacaggaaaaaaaaaagaaaacgataacatgctctgccatcctttgttcaccgagcaaaattaaaaacgcaaaatgaattgtccctatgaaattattaaaggaccacatcaccagacttatctctggggggtcctctagaaaataagtcaggtacttgcctggactttcttccagttgaattcctgagctaacatacaattaatggagtgagaatgttcgaacgatccaggagttgcttttttcagtcatttgtttatcagtgtaacaagcatttcctttatttcttttatatcaacctgcaacctattaatattcaattcaacgtctcggagcttttctcgtaccgttttaccatcatccatttccatgctaactaattctgagattacgattacatattgtctcagttctggttcatcaatggctgataaaactttcattacattttggaaaaaatcttcgtcatttaggtctaaagtcaggatttggttccttatagactctctacgatcttttttcaagtttttttctgaagaaatatgtccattttcattagtgacagcggtagagtcctcttccgctcgaaccaaactatcactgccggtgttttcctctcgaaagggtttgtctttaccaatggaaagacgcccgtcttctgcgctttcatataatttgacagtggctatattgaactgttcttgcaaatcgccagttttggcatcccctacccaacctttttcatgcaattcctttccttgagtgacccaagcgacgaggttatctctaatatatcttgaagttataggtactcttgatttctccttataaactctgttaaaaaactcagctatcatttgatgacataatataggtctccttttacttgctctctttgttgtgtggagcaagagggcccaatatatgactgttaacttttcacaaagacttttttctttattattggaccatcgaaacttccttagttgccttgtttccgcttcgtcattactgtttccccccaagtctgtgggggctccaacgtgcaatatgtcgttgtcaatatcactagaagtatgagtttccacattcaacttggtattagtagtgttaattcttttattaaagcaaatagtatgtgtagattgcaggaggtcgaagctcttcggattggcaaaatcaatattctgctctataattttcacaggttttgttggcagtatttgtgcaattcctgtcattgagtttctaaatacattcttttggtcatattttgaagtgctctttttgcttttatgtactttttttgaagaggacgcattcacatttgttacttccaatttctcttcctccatttttggcgtttcagagggctttccgtaataatcttcaaaggaatttaaagtaaaattcttaaagttggacatccaaaaggatcttcacaatataagcgtttttctgtccaccagcttcaacaagcttcagcctactaccaatttctaatactgttttatcttattacttgcttacttatccactcccattgttttgtcctagatgacagcatcacccggactgaatattaaagcgtcagtgtcacttattttaagtcataatcaagtccttttaatgtggctatagattaaccctgtacactaaagctgtatattatttccttaaaggagcatttattcccaaactgtaacgcagaatgtcattccagaatcatggaaaaaagattcaaataaataaatgtatatacaccaaaaattacaacttcgaatcctatagtacttttaatctttttgaaaaaaatattactaaaaactatgtatcatgtccaaaggccatagggcctagcattttctttgttaaaaaagataaacagtagagaaataaataaaaaacgccctaacccaacatataggacctctttttcgttggcctagtcaactttaatggatgagtagatttttctaacaaagagcatactgctgataaagccaattgaccccgttaccaaacagcagagtaatgaaatgactgaggagtatcccacgtataagacaatagtcgtgaatccacccaacttaaatttggtgaataaaatagaatgaataaacacatacaaagcacaaccggcgcctccaattatgaatcctctccattgccacttccagttctccaggcataaggaatgataagtgatcaaaatagtgacgagtgaacttgtcaaagttaataggaggaaagagaaaaagaggaaaccaaacatgtaaaaaatcttattaaaccataaacttgtgtatatgaaatacaactcaacggcgatggagccaaatggaaagataccagcaatcaaagtagctggtatagtctttaaataccaaggctggaagggtatttgtcttgcgatttggtttgtcttggttggatgttcatcccagtgacatcttttcctggcaatcaatgaaccagcaaatgataatgggattgagaacaaaaaccatagaaaaaccataaaaaacagagtacttgctggtatgacaccagaagaatgaacaaacattaagaaaaagttcaacgcaataattattagcagaatagcaccaggaactagaagtggagtcaatatcaagtttgccttccagtatggcccattgaaaaatttgtagatgcccatagatgtataagagccgacaaacccgaataatgcatataagataaacataacagtggctaaggaacctctagaactaggtgataggaaacccaatgcagcgaagaagatactgcaagttaccatcaaaaataattgaactcctgaaccaaccaaaattgaaagggttagcgattgacttggcgaacgaaaaacatcaccatgattcaatttccaacccgaatcttcttgaaaatcatcgtccaaatttaactcgttgtaacgtgcgaaatcacttttcagtgcgcgcaatagcgaatggataacaacagatgacaataagacaacaactaaggagaaatttatcaaagaaaaccattgaatagaaggatcatatacgtgtaaatatttgtcccacctggtggcccaagaagtcgctgattcattgaatttaacggaataagtaaaataaacttcattatcatttccttcgtctagcatcaatgggctgccagtcgtttcacatgtacctggactggaacgttttatggaaaccggttcgacgataacaccaactacacgatagttaccttcaccacgatcgtgatattcaatcataatatcgaaatggttggcaaagtaaggcaattcgtaagttttcaccatgttacgatcattacgtgtttccaattccacatccttatcggtggtttctgccccttttggagtagcctcaatgtcggttccttgagttacctgtacaaaaccaaggttgaagccagcaccataaaaactagtcttagttctgccatcataaacctctcttgcagccggtaatccatcaataagccagttttggaagaagccattttttatcaatttattgatgaatttagcatcatctcccggaattacggtcttacacagggattcacactctttttcttgtaacatattcaattggaatggtgaattataaattcgatcaccaaatataacggatcccaaggattcaggttgcttttcgactttttcaggctgacaaaaatggaatctattgtaatagtagtcgtatgagtacaagaaattttctttatcgccagaaacgttattaccgtcctcatctttgtgttgataattcattgatggagttaaatgattaacgagcaatgggatgttgtcattttccctgtaagtggtaggcgctacacctggtaaatagaaggctttgactgttgacacaaaaaaatacaacaacaaaagctgtacgtgtgccattttgtaaatcattctgttttgttttcctttcggtacttgctctctgctactaaattaatatctgaaaatataacggtagcagatgaaggaaaagctggacaaggagccaaaaattaacttaactaacgtaccaaaaaaagatacaaataaaaacaacaaagcagttcaaaaaccttgaattacctttttgtttatcattaggcctatttcttcgaaccgatgacatttttcatggcttcaccaagtaaagaaaaattgccgtgaaaaaaatttaaagggctgtaacccggacttttgtattataagttaaaatcactcattctcaggcagtattggtaacattccaagtgacttccaatacgtgttgaatttactactaacattccagtgcaagtagtaatttttattaagttttgatcaacttaggattttcctattttatttttgtttattatattaagtgttcattattttaagtagttatatattatataatacaaccccgattagacaaacttcataagtttttcgggtgggacggtatcaagcatttcattctcatcaattcgcggtttaatgggcttataatcaccctctggatccttaaacacgtaggcaagaatgacgcctgcaataccaaggacagaaactgtccctaatgctagtgcaagaccaattaaaacgacaaaaccacgacctattttcttcttcttcgattttgatttagattcactgcttgccgatgaagatggaggctgggatgatgttgactgaggacttgtcacagtaatgttcacattggcaagtggtgactgagagttgaattcagttgaaacgtctctattaataaaaattattggattgtaattggaagtatttgttgtttctgaaataaaatatggggtccatttttggaaatcaaacaacaaactttgtaggtatccgtattgcgaaatattaaaattaccattaagtaagaggatactgccattattaacattgttgattcctctcttgttcaaagtgttggattcaatatctgtgtatatagctgaaacagagctaatagagctagcattgccaggtaacgaggtaatattccattcttggtttctatagataaataatgaagtatcattccatgccactatggagtcttcagtgacagtaaacgaattcagtttcccttcagaaccactcaataatggaatcatagtagaattggttaagttaaaggatcctaaacgtatagattggtattcttttgtttcaaaaaggcctgagataattaattctgatgagttggtgaaggaaagttgtgtgatttcaccaaaaatcgtgttattgaggaaggtagaccaagttttgctttcataattgtatagacataatccggtgcaattcggctcagtcatttggaaatctccgccgacaagcatactacagtttttttcaaagttaactaaagcatttattctagcatttgatcctagtgtttcattagcaatcatggtcaaatttctcaaatcaaaaatcgacagttctgctgtggttgaagatcctgcactgacagctagtaaagtttgattatcagcgtatagcatttgagtaataccgctagaccaattccaggaaggataaacttcattagaaaaataaattttgtttagagaatccacctcatatgcatatgccgtggcagactcatttaaataagctcccaggtaaggtacaatacccccttctaggttaagtggctctatttcattttcgttcaaaaaacgtacagacccattcaaattaccatattgcatatgagatactgcacctgaaaacaaaacatcgccatcgccattgttaccagccgcccaaagtgatagactaaaggaactggagttccgtataagcgcattggaagatgcattgaccacataatcgttatcaagaacaataaagtcgttatttgcaagacttatattaagggcactattcactgtcctcgattggttgaagacattctcaaatgatccattaaacaaaaaaacagctgattgattatttgatgaaagaatatctccaaatattagtaaaccttggttagttttcgttataccatgtacatcaccttgaatggtttggtttttacttgatgtaacctcaaagtcgtcattaaggtcgacaatggaaatacggttgcttactccaccaattactaatttgttatcgtaaatgtcagcataaagggaagaatttttagggtaattttttactgggaaaagattcaaagtagtattacctacctttgtttcgttcaatctcgtgctggtaaagtttgatttctggtattggagaataccattcaataaagtttcttttttagcgttgctagaatctgaaagtgtgttaaaagcatctaaagaaacagtaatgacattaacttgatctgccacgaccactgttgcagtgttggttgtataaattcctgagacatactccaaaacgatctccggtgagaaatctagatatcccgagtagatttgatcatattttagattatcattattctggtaaatcaagtacgtcttcattattgtgttattttgttgattccacatggtcacgtttacaatacctcttgcggagcacgtattatcctgaagacaccctggtgtatacatgttgatagtgtagtgaccggggtggataatgtttgggtaaaactttacgcgtggaattggctcattttgatctggaacatatttcgcggctatataactttcacctgttagaccattataccaatcattgctcgacaatgtagatgacgacgaatcattggtaagcgcgctgcagccatattcgttgagagaatcattagcataagtggagaatgtgtcctgatagagctccaaaccggataatccaacactaccaccgtatgaatttaatgctacaaattttaacgatgaaacgggaagttcattcacaaacgcaaagtcttggaaatctgacgtccattttacgtctgtcttgttgttatcgatgaaggtaatcatgtccatggatgaagatacattttggcttgctgataataaagtggctcggctatacaaagggcaaaattcaccgcaattcttcaactccccacttagtgggtccagatacgttaaattcattatgctactggatggatcagtcagaatttggaacacggagatttcactatcggaacgttgggaattataaagccttatttttgttggtgaaacttcatatggtaaattacaaactagagacccagacgtatccggataaagccatgcatcctcattagtgttaggacaaactaacgaatcagatgcaaacgttgtacttccctgggaatcccaggaagcgtacctcagtggaattcgttggcctagctccaatgtagtagcgtttaaagaggaagttgagttcgtaccgttatttgaactactgataagcgcagaaggatcatccagtgtataaaactggcctgcaaataaaatgttgtcattatttagcttgactatggaattcacactggagttttcaccaaaccctccaaaaggtaaaagttgggtggtatttgatatggagtcccaaatgagagcactatagcccgtcatggagccattattatatgaaaagtttcctccaaaatagatagaagaattgtctgcgagcacagcctgaacagctcccaaagactggttgaatataggcgtcatagacagtgtcgacaaattgtataatatctggtttccgacagagatattgtttatcgtgcctgatccgctaagaataaacgaatcaacgccaaatggtgtaattttgtctattcgagtatcatcagaggcatcttccaactggatataggtgttgttagagtaataaactaatccatgtgagcttgtttctggacctatttctttagtgaaattttgttggcctgtgtactcgtaaaaagataaggcgtccacacccccgaggatttgtactgcgttgctattattttgcgatatattcaaattcggtagcacattatcttcgatgtccagaagagatttaatattctccaactgtgatgccttcgatatctccacaagaaaaggaaatgcgagtgtccagagacgatgaacaaacatttaatttctatatcgtaacgaagaacaggtgtattttgatcgttttctcttgcgtttcttcgtttcccggtcaatcaactgtataaatataaaacgaaaattgtattatcttctcctacaaagtctagtatggggatgattaaagcgcacactttccttcgagacttctgatgatgacatttccacatttccatatatttctttttttgtatcgcgaaaaaatgggaagaatggcgtttctaaccactaaaaaagaggaatttttgcctaatttgggaatttgtcaataaaaatgtaaaacatatgagatgtattattgcctgcggaagattcttaaaaacatgacaaaatccaaattgaaaatgacctgaaggtctcgacttttcggattttcattgttgctatgtaaatctatagttaattatatccaattctggtaaccaaacctgtgcttcgtacaccaatcgggaccatgctcatagtattcttctcttgtgaccctcgcttttcggtaggaatctgtctttgcaaactgtgacatcacttcccacccaaacagagcacagtcaccttcgggcaccgaaacatgacaagtccaatctgtgggtaattgcctttgtagttctgccgcaagccgttgggcgaaattgggcagattaaagtttcctcctgtacatacaatgtttcctaccataagaggtcgcactatttcgggcaacatggaaaggctctctaggatggcctccacaatgcctggtttagtaatttgcgaaatttctggatggaaaaaagtttctggtattgtgaaaagctcatctgtcagtgttatgatctgcgcatcttcaggtaacggtacattttcttttctggggtttcttacgtaaccaagaaagcttgtttggaagtcaggaagtacatattctagtgcatgcttatccttcgttttgaaactatcaaaataagacaccgggctaacgaacaagcattgttccttgatattgttaacaagtatggtttcatccatcatattgtagtgtctgaatgatagagtttcctttagtagcccagttaggaaacggcctccaatgtccaatttttttaccgctttatagtacggtattcccttcaggacaggaattatccaagtacaattaaacccggaatcaataactaattggaaatcatgataatcgctacctgaatcctgcgcattcttggactcgcttgatgtggaatttgtactgtctgagttgccacggacaatatcgatatcttcgtccttacctgaaattgttctcatttcacccttatatgacttggtaaatggtacaaagactgctacaggagacttgaaaagactgtcgaattcatattcttcaaatatcacctggtcggcatgcttacttaattctggtaaagtcatacagctctcgctagcaaccaaatgatgaccctttccctctttcagatcaaacccatcaaactctgaaggattgaaaaggcaataatcccatatacaactctctaattcccataatgtgagctgtcctagttcatgtggcctcctgaaggtgatagatgaaatatctttgatgtttttgatatgatttgataaatacgatgtcccaaatttatctttggccaatgcatttaaagctcggaacggtttcttattcgtggaaggaccaaacttgatttcgtatgagccattatcaatcacaatgggtggtgtttccatagtttaaattatcttgtccacgattctgcgcttcttctcctttggtcttgcattaattctcttgttcttcttggcccattttgaaatgcatttgtaattatggacggaaagtaaactgtttacaataatcacgaaaatacatataggtttacattatctacacactggaatcgatttcataccataaaagaggccctataagaagccgcatcaccttaaacactaaccacgtgcaaccaacagaatatatttgatgtctgatagtccattgagcaaaagacaaaagcggaagtccgcccaagaaccagaattatctcttgatcaaggtgatgccgaagaagattcgcaggtagaaaaccgagttaacctaagcgagaatacaccagagccggatcttcctgcgttggaagcatcttattccaaatcttatactcccagaaagcttgttttaagttctggggaaaatcggtatgccttttctcaacctacaaactcaacaaccacgtcattacatgtaccgaacttgcaaccaccaaaaacctcttctaggggtcgcgaccataagtcctactctcaatcaccaccaaggtctccaggaagatcgccaactagaagattagaattgctccagctttcgccagtgaaaaatagcagggttgaactacaaaaaatttatgataggcaccagtcgtcgagcaagcaacagagcagactatttattaacgaactagtcttagagaacttcaagtcctacgctggtaaacaagtagtaggaccctttcatactagcttctcggccgtggtaggccccaatggttcaggtaaatcaaatgtcatcgattccatgttatttgtatttggatttagagcgaacaagatgagacaggacagattgtcggatttaattcataaatcagaagctttcccaagtttgcaatcatgttccgtagctgtacattttcagtacgttattgatgaatcttcgggtacttcccgaatcgatgaagaaaaacctggattgatcattacaaggaaagcctttaaaaacaactcatcgaaatattacataaacgaaaaagaaagtagctacacagaggtgacaaagcttttaaagaatgagggtattgatttagaccataaacgatttttaattctacaaggtgaagtagagaatattgctcaaatgaagcctaaagcagaaaaagagagtgacgacggactactggaatatctggaggacataattggaactgcaaactataagccgttaattgaagagcgaatgggacagattgagaatctaaatgaagtttgcctggaaaaggaaaatagatttgaaattgttgatagagaaaaaaactctttagagtcagggaaagaaacggcgttagagtttttagagaaggaaaagcagctgacgcttttaagatcaaaattatttcaatttaaattgttgcaaagcaactctaaacttgccagcaccttggaaaagatctcctcttcgaataaagacctcgaagatgagaagatgaaatttcaagaatctttgaaaaaagtggatgagattaaagcacaacgtaaggaaataaaagatcgaatatcatcttgtagctcgaaagaaaagaccctggttttagaaagaagagaattagaaggcaccagggtgtctctagaagagagaacaaaaaatttggtaagtaaaatggaaaaagcagaaaagactttgaaatccaccaaacattcaatatcggaggccgagaatatgcttgaagagcttcgtggacaacaaaccgaacacgagacggagatcaaagacttgactcaattgctggaaaaggaacgaagtatacttgatgatattaaactatctttgaaagataaaacgaagaatatatctgcagagattattcggcatgaaaaggaactggagccttgggacctccaacttcaggaaaaagaatcacagatacaattggctgaatccgaactatctttgttggaggaaactcaagctaaactgaaaaaaaacgttgaaactttagaagaaaaaattcttgccaagaaaacacacaagcaggagctacaagatcttatcctcgatctgaaaaagaagctgaactcacttaaagatgaaaggtcgcaaggtgaaaagaattttacttctgctcatctaaagttaaaagaaatgcaaaaggttttgaacgcgcatcgccagcgtgcaatggaagctagatcctctttatcaaaagctcagaataaaagtaaggttttaacagctttatcgagactgcaaaagtcaggacgtataaatggtttccatggacgtttgggcgatttgggcgttatcgacgatagttttgacgttgctatttctactgcttgtccgagactagatgatgtcgtggttgatactgtagaatgtgcgcaacactgcatcgactacttaagaaaaaacaaacttggttatgcaaggtttattctcttggataggttacgccaattcaatttacaacctatcagtacaccagaaaatgtaccgagactatttgatttagttaaacctaaaaacccaaaattctcaaatgcattttacagtgttcttagagacactttggttgctcagaatttaaaacaagccaataatgtagcatatgggaagaaaagatttagagttgtcactgtggatgggaaattaattgatatttctggtacaatgagtggtggtggcaaccatgtagcaaaaggtctaatgaaattaggtacgaatcagtcagacaaggttgatgattacacccccgaggaagtagataaaattgagcgtgagctatctgaaagagaaaataacttccgcgtggcaagcgatacggtccacgagatggaggaagaactgaaaaaattgagggaccacgaaccagacttggaatcacaaatatcaaaggcagaaatggaagctgattccttggcgagtgaattgacactggcagaacaacaagtgaaagaggcagaaatggcgtacgtcaaggcagttagtgacaaagcgcaactaaacgtggtgatgaagaatttggaacgcttgagaggcgaatacaatgatttgcaatccgaaacaaaaactaaaaaggaaaagatcaaaggcttgcaagacgaaatcatgaaaattggtggtatcaaattgcaaatgcaaaattcaaaagttgaatcagtttgtcagaaattggatattctagtggccaaacttaaaaaagtcaaatctgcctcaaagaagtcaggaggagatgtcgtaaagtttcaaaaactgctccaaaactctgaaagagacgtagaactatcatcagatgagttaaaagtcatcgaagaacaactaaaacatacaaaactggctttggcagaaaatgacacaaatatgaatgagacgctcaacttgaaagttgaattaaaagaacagagcgaacaactgaaggaacaaatggaggacatggaggaaagcatcaatgaatttaaatctatagaaatcgaaatgaagaacaagctggaaaaattgaactcactgttgacgtacatcaaaagtgagataacgcagcaagaaaaaggattaaacgaactatcaattagggatgtaacccacaccctgggaatgttagacgataataaaatggactcagtgaaagaggatgttaaaaacaatcaagaacttgatcaggaataccggtcctgtgaaactcaagatgagagtgaaataaaagacgctgagacttcttgtgacaattatcatcctatgaacattgatgagacttcagatgaggtatccagagggataccaagactttctgaggacgaattaagggagttggacgtagaactgattgaaagtaaaataaatgaattgtcatattatgtcgaagagactaacgtggatattggagttttggaagagtacgctaggcgcttagcagagttcaaaagaaggaagctggatttaaataatgctgttcaaaaaagagatgaagttaaggaacaattaggaatacttaaaaagaaaagatttgatgaatttatggctggctttaatatcatatcaatgaccctaaaagaaatgtaccaaatgattactatgggtggaaatgctgaattagaacttgtggatagtctagatcctttttctgaaggagttacgtttagtgttatgcctcctaaaaagagttggagaaatataacaaacctttcaggtggtgagaaaacactaagctccttggctttggtttttgctttacataagtataaaccaacccccctttatgtcatggatgaaatagatgccgctctggatttcagaaatgtctcaatcgtagctaactatatcaaagaaagaaccaagaatgcacagtttattgttatttcgctgagaaataacatgttcgaattagcacaacagttagttggtgtttataaaagagataatagaaccaaaagtaccacgattaaaaacatagatatcttaaacagaacttagctagtacaataatcaattcaagagcacttgctgattgtaatatcatgctatcaaagaagtttaaagatactacccaaattcccgcctgtttatttcttcttttgggcagcagttaggaaataaaaaaaaaaaaggtcaatgataatgcaccaaaaacagaaagtacatgtatatcttaacaaactctcaaaatacaatttaaacaaagttttttgaagcaaaattcgaatgcaagattcataaatatggggcgtaggaaatctatactatatgcaaatatcacgtagttaaaaaactataaaacataaaccagaaatatggtatcaaggacttttgaatataattaggaacgagattaatgcgtatcatctagtatcttgacatactgcttttctgcaagataaacaagcttttggacggggataactgcggtttggtgagtgaatttcggaaatttttttctattgacaccaaaccattccataggtggagtggcgtctcccagatctcttatctgaggcacttcgatctgcggttcttctagtgcaatataattaaactttgaagcggcttcttcctttttaattgattcttcaagttcttcctcagtttgtccaaaggaaatatttgctacctgggatcgacgaactgccagtgctttgacatgtgtagtccacatttcctttatgaagtctacaggccctagattccaccttacagatattttgtctgaaaaagagcaagcaaatagatattctaaattatttgtcttttcttcttgtaaagttgtcatatgaacagcaagttttggaatatcaatgatagtaccaccgacaatcttggaagcataatgcatgtaatcatcaatagcaatggaagctccaacttcctcatctaattcttctttggaagtagaaagcgctgcagaaacatctaaaacttgtagttgcaaatctgtctttaattttttccccgaatgtgtttcggaacgtatagagactttgtcaattcttattactaacacttccacatcgaataaagatattggcgaaatctggacctttgaagaggagatattcaccgagagatcagttctgagtaatttcagcgatcttaaaatgtctttgtataatattggttgcctagattcaccaggattggaatctctcaacgtctccatatacgatattttattatcctgcctcatacgtacaatggtgttgtagatatccagtatatttgctacaactaatgcagtagagctgaggataatttcatctgatgaaaaagagacctgcagcaaatcaggtagaacccccttggcatccttttcattatgaagatggaagtgtatgttacttatagtgccgattaagaacatatgataatcaaaagcagcctttaccgctatatcatcaatattcagggaggtggaaactaatggatgagtatttttgcttttttcaggtggccattttacttctgataaccaacttgcattcgcaacttcaaataaaccactcagtctaccttctgatgtcaagctaataccgtcagtgaaagcatgcagtaactgccgcttctcgttataatgatctgtggccagccatgttctttgtgtccttaatgaaatcataccgagagaaggacccaaatcaacgtctccgctaacatttgtaaaaattaatgtaaagcaccagggtatttccgtacctgcatcggcatagttggttgatgttaatgaactcatttcaatttccttattaacagttctttgcactggccgtgtgtgtaaaatgctactgaacctccatatgtccaagaataaatacaggttctggagctgctttacattgaagaagacgcttagatcagaaaccaaccccgttccatacatactgattacatcaggatgtgtaaataaaagcgtcaagtccatgaaaccaacttcaaaggacgtacttacttctcttgaaaatatgtgcttaatggacgcttttgtgtgttctagagttaaagaaaactccaaaggctgttcagagtcgaactcattggtagccatactgaacaaaaacgattcaaatccaacatctgcctgaaccttagcttttggttcacagctcaaacttagctgttgcttggctgatgttagttttacagccacatcaaattgatccaaaagtcgcttataatcaacattctgtgaagaaggttttgtaaagtttggtttttcgtcggtgctatgtttctttatcatcttttgcagactttcagaaaattccattaataaaggagcacatcccgcatacaaagtattatgcgttgggtcgacagtgattaatgttctgaatttatgtggcttaactttatcttcatcatgtttatatgtacagtttatagtgactactggactttttatttcaaaagatggctcactcttggtttcaatatcttcgtacgtgtaaaccctaaatacaccaccgtcatacttgaaatttgagttaacagatctaatgttatcgagaaagggagccaaactactcgaagcactttcgacactggtactagcataagaattatcattttccgcacgcaaactctcggacacatccagaatgttctttttcagctcttgaaatgctcgcatggattgtaaagtagactcaatgacatccatgaatgacgggacaaagtttacatccagtgcttcaccatgaaatctaaaaaaccaatctttcaactcaccacatcttttgaaccagtaggatatttgcatgtttggcaagaaacttctattatatttgtctttctcgtttccttcagagaaaaaagtgcttgaggtattaccattcgcaacagagaaaaaagcgtccacaactgtgaatttcccaaaatccttttcatatgctgaaaacaatctgttataacctaacattaacccaggattggagcctgctccatactggaatatccacccaatacaaaatttataggacaggatgtgtattgaacggaaatttatgggcatttcttttgacttatcacttttaccggtgaacatcttagtgttccaaatattaggggcatggcgtcttgaatagtaatggctcaagtctagcaatttatgcgcgccccacattaatcttaatagagaatcaggagataagcagaccctgaaatgagaactttccacttggaatgactgctccgtatcaaccgttctttgtagggttgatacttttatggaaaagtcgagtaatttggaaagaccaatgggtagtgaccgctcctttattagaaataggatgttttcgatggaaaactgtcccgtcaccttggtttcttctggtaacataccgttattcgtattggtcagagaaagtagcagcatatgtaattcaaacacgaaatacgtggaagccactggcacaagaacaccaaaataagtaatgctagtatctaatgtccaatttatcattatcgagggtgcctgcttctctttttttggtagatttgaactaaagaataaaggcttcagggaatataacagattgataccctgagaagcaagcttttcatcttgtaaaaaactgtttacaatacggcgcggctccgaaaaggttaacttaatcatagatattgagatgtcaacgtttatcaacgaatagccttctctagaaattcctcctttaatttcaatatcgccaaatgaaaaccttaggtattgctcctttgtctggtgcgatgtcatgaaaaaatcagtatcccatatgcttaacaaaatctcatttgaaccgaatttgttaaaatatatatcaagctgcttggcttcgtgacgaatataaaatggcgagagcggcataacttcagaactaacgtttgaaaaataacatgacaagactgtattaattttctggtcgacaaattgggactttttctttgatttaggtttaaactttatgcgctctttaatcatcatcagactttccctaatttcagtaatagcggttactaattgctcagttgaactcattgctctaaaatgaagatctgcgcactggttgtttatcagaatcgtaggcttgtgtgaccatgcctcagtagtcgctaaaactgaaaagtcgcgcagttgagcttctcccaaaatgacagatgtgtgttttaaccacacttccgatttctgggaaaatataaccaatgaacccgcttgactagttgaatcttttagattttcccatagtaaactaactctacccccaactgttctactcatcagcttcgtttggtccatgaccagttgcagttcacttttatccactaataaaacggtgttcattttgaattgctttgataactccttttttggatcacttttgtcatcttcgcccactgctgcaatgagtggaataagatcttgcaatttaagtaacctatcactgaattttccttttactgagcctactcttcccgtaatttcaatagtttcttctcgatttgaaggtaagcttgtcaccggaggcgtcaaatccactaccagattggcatccgcaacaacaaaattatgctcaacctcatatccctcaccataaacagtaaggtaaaatgatcccatggtacacttcaacaattttttaatcaaattttgtttatgtttctcattttctgccgtgaataatttgccgtatatatacgaccttgcaacatctgagaactcccaatttctccaagtcgaaaacacagacatgaagatattttttgcatctttagcagaggtatatttcttttcttttagcacttcgtcgatgttgctttgccaatcatcaggaaggtacgttaaaatgtgtctcagacgcgtaataattttccaactacgattctcacgcacatgccctttggaaagtctcataataaaagcaggttttgttatgacgtaaggatcatgactaatttgataatattcgcttgcggctgtgagctttgaaatgagttctgtctttgaattacttctggtgttctgaatagaattaaaagaagtgcaaacctcttgaataagatttccctggtcactacagtactcaaacagccattccatttgagattcgtctatggtaatatctgatgacgttaagtttaatgagttaacttgtctatcttctgtagaagaccatacttcgaaaccctcaatccctagcgacagtgcagggggacgatcttcagacaagtctggatttttcttctggttaacagtcactctgacagtttttacctttgctaaagctgctacttctaataatttatttgttcggttcttctctagagacttttcactcatttgataatcaatacgatctaaatagagctcaaaaccttcctcacctgtctcttgccagattaaatttagataagcaatatggatatcaatgtttgaaatagaagtgatcccttcttgaaggttgcttaatcgtttcacaatcccaatttcaatatcgtctaagacttgtaccatgttttcagagtaaagctgttctaataaactcttagcgaaaataaaaagcaacgggtcgacatccaacagaatatatgaaacatcaacaacatagttatccctttcgtggtttctgtcttctgtaaaagcgacaggtttgaagcttgaagggtccgcttcttcgtcattatcatcttcactgaagctggctcttgaaggctccatagttgatggagtttctgcgaatatgttcttgaatggatttgtggtctccagaagggtagcatactcgcccacaatatcttcaatgatataatctatagtatcaggcaaagtgggaagaggtaaagttgggatagacgaagatggtgctatagccccgtacaggttttggtatgtatccgaatcctgatagaacagcggaagaagaaaaggacacctatgatagggtgaatcgtgtattgttatatatctgcgttgttctgatctttttttatcgatatccttgtattgctcaaagtttgtaaatcttaattttgtttcgaatttgagaaatgatgtgtctacgccatcgcccatcacgcaatttaacgaaattgtcaattttggaattttcacgtctattctttgtgaatatttttcgttttcaaagtcgatcaaagtaaacaatatcgattcagcactaataactgattgagatttcatcaccggatctttaaggcctattcttattttttcaacgtgcacggttagcgaggtcatatcattaatggtctcagtgtcatataataatatattttccaagtcattgtagccaaaacctatcttataaaaggaattaaagaatccctttataaattcaatatctgaatcaatgcataaatctccgagattgatatcccattgacaaaagtaggtaggttctgtgggtggtaatccatacattctatgtccatgaatggtgaggtccgaaagcaatccgtgctcttgctcatcagctccgttattacgacgtataaaatcaaatacttcatttatttgttttgaaacgtgccgctttattgaagtcccgttgagaaccgccattatgtccatataataattacaacttctgaaatccactacaagttcggcaaaatgtagtgcaatgcatggatcaaaactgtaaatcgtttctggtaatatcagagcaccatcccaaaccgaaaatgtgaaccaaatatcagtttcgttggtagtccttttcaaatctgaccttttcataggacctttatcctcagattcgttctttagactgctattttggtaccctgaatctacagtagatgccaaatctgccaccgagcttttcgtagtgacatctccgacttccctagcgccaaggacacctgtgtactcttctgacgtcacaaaattaaaaaattcaccgaagtaattcatctttacgtttgttaaatacctcatgacaaacccatagcagtgaagtactgtactcttgctgttacactctatgactagcgtatcgacattatcaatatctaactcggaatagagaaggtaagaacctttaattgtaaagtcgtatgctctccccacttctttatgtttcatgaattcgttcaatgtattccaagggggggtatttaacatcattctgaacattggagttgagatctcgtaggacatatctgtgtatgtccccaaaatactctcacggggtaccgtgacatcaattgaaagcttatcaccatgaagggataaataacagttttcgttaaaatctaacggattgttaacaatattgtgatcattgacgtttaagtaaatggaatatccttccatttcccaattgactttgtatacgaatggtctaaaaagttcgtaaggcgtaggatcaccagcggaaaagtctgaaagcgtatctgcaactaaagttatatgctcacgtagcagaaacgcctctaattgttctgacttcatgttaattatccatatagctttgctattccaacccaatggatatccaatatccccatcaatatcgaataccttgctttttaacaaaatatcgtgattaacacttgacctaatttcggtttccaggaaatgaacatggaaattattctgaaaaccttgcactgtaggacaaacacttatattgaaatttgcataggtgtccttacaaaatcggagatccatccatccaaatggcctatattcttcattagtttctttgtagtgtttcaaaaattcggggtctttgctactttccctcgtcggtatacgccaagtagtatcttccattattgatatattcatcctgaaaagtgtatatattcttctagaacctggcgggagtttttttataggtttggctgtccttgaaactaccggtgatagaactctttgtagatgactgacttgtctttgagcccaaggtccgtaacagatggatcctccgtgaatttgaacatctaaagcaaaatctggaggtgctccgttattgcccacatctggtccatcaatatcaggtattgtcggatgtgcaccatgtggcacaacgcccggaacatccacgtcatatgcaattgtgacctttgggcattttaaaattgatgtaaatttagcatattcatggttcgtcaaatcgaactcaacatcatctaaatcacttgctttagcgtcgcccgcagaagccttataaagagataaacctttccatttatgatagaaattgtcatctgatgtgcctgcgctttttttagtctttttcggtacaacaggcttggttactatctgaaagactcgtacaaacgttttccataactttgacactttccctctatctattttaaacttcaatccaatagcatcatcgtaaccaatattttgtttgatagaaatttcgaagtttttgaattccatctgtgttttatttctgtataaatctaatcgctcttttggaggtaaaacatctattatgccttttccactttcataacttagaatcataacagatggcgtgaatttgtttcctaacagtagggaaccgcggctaaatttaagctcaattggtaaaaacatcagtagctttggatgtttgccgatatctgtttcttggtagtccctgtcattaacaattgatgcatcagagttcgttgtgtatgcagattcgcttagatcttcatctaatttatcagcactacttccatcgctaaaaggttcaggaaaagaatgctcattaaggtatttttcaaatttatcgcgttcatcttttgatagtaagtttataacattatcgtacgccactgttctgttgtaaataaaaatttctagaccttcacattctacggaaattttacagggaagctttgcttttttgccagaagaagacttgttattctctatcaattctgcttttctgcaatttaaaagccagtatttccatgttaaactaccctctaataccgaaattgtataatctttgtgtattacggaaaggtttttaaaatgtattcgaccacctagtaaggagacacgaagtgtctcaacatttatcttgattttcgctcgtttccatagtagccattctaatataaaacttacaaggtatgcatagattcttcccatgtagaatatcattgtcaaacatactactaccgtgagaatccaatctactaaaaagacccagctaaagtccttttggtgtgtcaatggaacaccacgtaattgtgaaatagcttccatgcttgctaacttattaccgtcaatagaagacttgagtcaggtggctttaatgagtactattctttttttttttccaaagagcactatgttgataataccgcagtaattttttttgagtatcctgtagcctagaaaggttgaagcttataaaaccgtgccaacagctttatagtggggagtttggcttccctctatttgtatattgatcgccatccctacgaagttattgggaacgcatcgtgaacctctcactttaatgccagcggtagaaaaaaaagtcataaacaatacacgccggctacacttagaaagaaatgacatttgctgtcttataaaaggacttgacagaccaaagacgcgtataatacaccaagaatggccttattggagaagttgcatcgaaggattgttgatatggggcttgtcccgcgtataatcgccttattaccagttatttccatgctatgcgctctatttgggtttatttctatagctattctgcctatggatggacagtacagaagaacatacatttctgagaatgcattgatgccttcacaagcgtatagttactttagagaatctgaatggaacattttgaggggctatcgatctcaaattaaagaaatggtaaacatgacttctatggaaagaaacaatttgatgggttcttggttacaagaatttggtactaagactgctatttacgaaaatgaacaatatggagaaacattgtacggtgtaatgcacgctcctaggggtgatggaacagaagcgatggtgcttgccgttccatggtttaattcagatgatgaattcaatattggcggcgcagctttgggtgtatctttagcaagatttttctcacgttggccagtatggtccaagaatataattgttgtcttcagcgaaaatcctcgtgcagcattaagatcatgggttgaggcataccatacttccttagatttgactggtggttccattgaagctgctgttgtgttggattattcgagtacggaagatttcttcgagtatgtagaaatctcatacgacggtctgaatggtgagctgcccaatttggatcttgtcaacatcgctatatccattacggaacatgaaggtatgaaagtttctttgcacggtctacccagtgatcagttaactaataataatttctggtcaagattaaaaatattatgcctgggaataagggattgggcgttgtccggtgttaaaaagccccatggtaacgaggcatttagcggctggaggattcaatctgtaacattgaaagcacatggaaacagtggtcatgatattactacatttggacgtatacccgaagcaatgtttcgctctattaataaccttttggaaaaatttcaccaatcgttcttcttttatttgttattagcaccacgtcagttcgtatccattagtagttatttgccaagcgctgtggctttatctatagcattcgccataagttcattaaatgcatttataaacaatgcttatgcaaatatatccttattttccgagtataatttggtagcgttgttggtttggttcgtgtcattggtgatatcatttgttgtttcacaagcgtttcttctaataccttcatcgggattattgatgacaattagcatggcatcttgttttttacctttgatactttccagaaaaattcacatctcagaaccactatcatacaggttgaaaaatgttgcttttttatatttcagtttggtttcaacatctttgctaatgataaactttgcaatggctttactgatcggcacattggcatttcctatgacatttgtgaagaccattgttgaaagttctagcgaacatgaggtgacaactcaatcctctaacccaataaaaactgagccgaaagatgagatagagctcgtcgagaatcacatggatacaacgccagcaaccccccaacaacagaaacaaaaactaaaaaatttagtactattaattttgacaaatccatttatttcaataaccttattcggactattttttgatgatgaatttcatggatttgatataataaacaaactggtttcagcatggttggatttgaaatgttggagttggtttgtactttgtataggttggcttccatgttggctattgatattagcgtcatcgtttgaatctaaatctgtcgtagtaaggtcgaaagaaaagcaaagttaggtgccattggtaagaagtaaaggattaacgggtgttcgaactacgcaattgattttatacgcacaaacattacaaatcgaagcaaaagaagatgaaatgatatgatatactgatacaaatatgtattaaataaaacataagtattgatggaaacatggcatagagaagcgaagatgcgataatatcaaataactatatgtgagttgtggaagaaagaaacgatcacattattataataaactagctatttaaatgtttattgaagactgttctgcccccttttattcagtcacggtattggtcaaaaaattctttatggaaactttcccatttcttaatccattccagaccaggtgccaaaaatgttgttcttaaatggtaagtaccaggttcttgaccaaacccagaaccgggaacagtgcaaatgccagtagattctaacaacttcttacaataaaattcatccggagttaactctaagtggcgagcttcttgaactgccttgaaaggtaagtctatcttagggaataaatacatggcaccttgaggcttttgacattcaatgccttctaaagagttaaatgtctcatacagtgtcattgctcttgtaattaacttttcatggatggagttacgttctgcttggtccgactcgaatgattcctccccttccactggtggacgaaccatcaaatcaaccaaagcttgacctgtgacaacgggacacaatgaaatcgaggctagtttcaagataacttgtctcatctcatggctgaatccagtgagttccatgtagccacccctttgaccacattcaccagaaacacccttagaagtcgaatgcaaagaagctagctgaacattatcgaatttacctggatgttccctctgtaaatgtctcaaaattttcttcatagaatggaacttggtgcccgggaagatattttcttgataaacttcgtcagctatcactactgtaccgtacttggctgcgacttcaaaaatctgagctatagactcaggtgataggacagctcctgtaggattacctggattgataaccactagaactgtaggtttgatttcgttctgtatagcctctttgacgacagtttcaatttcttctggattagttgaccaacctgaattctcatctaaatagtatggtaaagcttgagaattgttcaaagctagagtagcggtatataatggatattgaggaattggaatcaagacacccgtttctggccctctacagaaaattgataacaagtaattgacagctgcggatgcaccagcagttaggaaaatatcctctgggtatgatatctcgccttcgtccctcttcgttataaattcagcgacacttttccttataccttctacaccttgagaagaagagtaagcaccaacagaaccaccgatatcttccattaaactctttgcacgtttaatggcatctagtttaaacaatttcgaatcaactagctgctgttcgttttggtttaatagttctgggtattgtaagagagacaagacctgtctgtagtaagtcagaggtttctgttgtagttgctgaggattaccaatattggcgttgataatcctgtcaaatggcagagattgaggatccttctccagttgagctttcaattcttcagctctcattgggatggcacctctaacggcgtacttagccttcaagacattttcatttacgtcttccaaagtcaattgttcggcgggataaaactcgttattcgaagttttcaacgtgtggtgtggaaagcgattcaaatgacgcaggtcgtttagcgaagattgaccagataatgaacgtctatgattttgagcaacaatccaggaagagctatgtctctgtaggacgggtctaactttcctgaaagcttttaactttgtactactggctgaggtagaaaaaggagtagtgatatgtggcattttttctgcgcttgaagtgagagtccttatatgatatgacttaataacgtgagttatagaattactcactgtgaagtgatttttggcagacagtgataacatcgtggagagagcaaaataaagactggggaaatatatttatatgcgttcaattgagaagcagaaacaattaaatgcgggggagaaacaaagaagctggtcctgttctcgagcaacgtgtgactagtatgaacaactagagtaaaatagcgagaaagcagtagtagtaacggaagagcttttcctagtatggtccgcgggtcacgatcgtttacaaagggcgcagcaaactctaaatacgtcaaccacagcaggtcagaagagtacgtgaagttgtctcaacgaaaggtcgaaaatcgttaggcttggaccccttcagaatgaaaaaaaaaaaagacgcaagagtgaaaaaaaaaccagtactgtaaaagcagaaaacgtctaatgggaagtgctactatgtaagattatatcatgaatgtgctgtgtattatatatggattatatagccacgaatatgcggtaaataaacatatgcatatatgtgtgtggggcagcgctctgctgtgcaatccttgtttctttgtttcttgggtcgggatttgagtagcgacgagccatcctctgcagaagggaagaagaaagaaaggcagagaggcaaagaaagagtcaggcttatcttatcttaagagatatgccgcttggacccaaaagaaagggaaaagtaagtacgcaggtgtagttttgaatgagtggcagtgatagaggagaccggttatacgatgtgttgggggtgacgagagatgcgaccgtgcaagagattaaaactgcttacagaaagcttgccctgaaacatcatccggacaagtatgtggatcaagactcaaaggaggtaaatgaaatcaaattcaaagagatcactgccgcttacgagatcttgagcgatccggagaagaaatcacattacgacttgtatggtgatgataatggtgccgctagcagcggtggcgctaatggctttggagatgaagattttatgaacttctttaacaatttcttcaataatggaagtcacgatggaaataatttccctggcgagtatgatgcgtacgaagagggcaactctacaagctctaaggatatcgatatcgatatatctcttactttgaaggatttgtacatgggcaagaagctgaagtttgatttaaagagacaggtcatctgtataaagtgccacggttctggctggaaaccaaagaggaaaattcacgttacacacgatgtggaatgtgaatcatgcgctggaaagggttcaaaggaacgtctgaagaggtttggtcccggtttggtagcttcgcaatgggtggtctgtgagaaatgtaatggtaaggggaagtacactaaaagacccaagaatccaaagaacttttgccccgattgcgcaggcttggggctcctgtcaaagaaggaaatcatcacagtgaacgtggctccgggacaccactttaacgacgtaattacagtcaaggggatggcggacgaggaaatcgataagaccacatgtggtgatttaaagttccatctcactgaaaaacaagaaaacttggagcagaagcaaatctttttgaagaactttgacgacggcgccggggaagatttgtatacaagcattaccatatcgttaagcgaggccttgacgggatttgagaaatttttgacaaaaaccttcgacgacaggttactaacattgagcgttaaacctggcagagtagtaagacctggtgacaccatcaaaatcgccaatgaaggttggcccattttagataaccctcatggccggtgcggcgatctgtatgttttcgttcatattgaatttccaccagataactggttcaatgaaaaatcagaactactagcaataaaaacgaatctgccgtcatcttcatcttgtgcctcacatgcgactgtaaatactgaagatgacagcaacctgactaacaacgaaactatatcaaatttccggatcattcacacggacgatcttccagaagggataaggccgttcaagccagaagcacaggattcagcgcatcagaaagcaagaagttcgtactgctgtatccaatgatggcatcaataactttttattctatttttttttttttttcataagttatcctacctgtatatatgtatatatatgaaattcatttactgaatgcggtgaagaatgaagtctttcgcaccttcagtagaaaaataggaagaatccccatcgcggcggacataaagcaagcatacaaaggccttctatcagaacagcgattgcgaacttggagcaacaatggcgtcccaggttaacgccttattactgccggtcatagagtctacgccgcttcatcaaataaccaaggtagcattgacgaccacactcacaagtaaacaaagcgattacaagttcaaagaaatagccgtgccgttaacaaaatcactacaactgtacgagaaggcgcaaagaagacaagatttaagggcaagcttaaaagcactggagagtatcatttaccaaacgcacttccaatggaataacccgctcccacgacatgcgcatctcttccaaaaacactaccactttctactgactcactggccatttgagaaccacagagacttggtagattccatcgctgtaaacaatgggaaactaaattcaacgtcttcaaggagcgtctggctgaaggcggattggataacactgtttaacgttaaaaacccttgggtccaaacgccgccatcgttaatgcgtctgagtgggacagatcttgataccttcacaccagagaggatattcctgataaattctcttggaaaccactacaaatttttaatagcgaacagtcatctaagctacaatcacaaaaaatacccctcccctggcgtgcaaattcctgtcaggaacgctcttggcgaagtttctccggccaaacaaattgcccaacttttcgcaagacagctgtctcatatttacaagagcctcttcatagaaaaccccccgctctctcctgagaacgagctggcattgactgccgtcttctatgacgagactgtagagcgacgccttagaaggctctatatgcgagcttgtgcaagggcatatacgactactaatgccgactccaccacggagcctttgatgtttcattgcacccggtgggaagttgattagttgttgttggctgttatactggagtaaatgtcacgtgccactgtggccgtgtcaggtcacgtgaagagagaaattcggccacagttgtggtcctaaacaaggactgaaaaagatcgcagaaactagcaacgtcggatagcggtatggttgaaccaaagtccagtttttagtcatagccggttgagggatgatctgccgttcagtgttctgcgttcaataatacgcatatatatatatatcaaggtatcaacacaatacttgaacaggttaggctcgtactaaagcctggaagtttttatctttctgtaacatttttctttcttgaggtgtgtgtgtgtatagattagcagggaattatctaagatatgtccagggaaggttatccaaactttgaagaggtagaaattcctgactttcaggaaactaacaacaccgttccagatcttgatgatttagaattagagtatgaccaatataaaaataatgaaaataatgacacgtttaatgataaggacttagagagcaattctgtagcaaagcacaacgcagtgaacagctcaaagggcgtaaaaggctcgaagattgactactttaatccttcagatgtctcgttgtatgacaattccgtttcccaatttgaagaaacaacggtatcgctaaaagagtactatgaccacagtatacgatctcatctcacggtgaaaggagcatgtagttatcttaagagtgtttttcccatcatcaactggctaccacattacaattttagctggtttactgcggatcttattgcaggaattaccattggctgtgttctcgtgccgcaatccatgtcatatgcacaagtcgccacgctaccagcgcagtatgggttgtactcctcgtttattggtgcttactcctactcttttttcgctacatcaaaagatgtttgtattgggcccgtggctgtcatgtctttgcagaccgccaaagtcattgcggatgtcacggcaaaatatcctgatggagattctgccataactggtcccgttattgcaacgactctagcgttactatgtggtatcatttcggcagcagttggcttcttgcgtctagggtttcttgtcgaactgatttccttaaatgcagtcgctggatttatgactggatccgcgtttaatatcttatggggtcaagttccagcactaatgggttacaatagtttggttaacacgagagctgccacctataaagtggtcatagagaccttgaaacatttaccagataccaaactggacgcagtttttgggctaatcccgcttttccttctttatgtttggaaatggtggtgcggaacatatggaccaaggttgaacgatagatacaactccaaaaacccaaggttacacaaaattatcaaatggacatatttttacgctcaggcttccagaaatggtatcattattattgtattcacttgtattggttgggcaatcacaagaggcaaatctaaatcggagaggcccatcagcatcctaggctcagttccatccggtttgaaagaagtcggggttttccatgttccaccaggattaatgtctaagcttggtccaaatttgcctgcatccattattgtgttattgttggagcatatcgctatttcgaagtcttttggtagaatcaacgactataaagtcgtccccgaccaagaattgattgctattggtgtctcgaaccttttaggtactttcttcaatgcttacccagcgactggttccttttcaaggtctgctttgaaggctaaatgtaatgtccgtacgccgttatctggtttgttttcgggttcatgtgttcttttagcattatattgtttgaccggcgcattcttttacattccaaaggctaccttatctgcagttatcattcacgctgtatctgatcttttggcctcttatcaaactacctggaatttctggaagatgaatccattggacttcatctgtttcattgtcaccgtcctaataacggtatttgcctctattgaagatggtatttattttgccatgtgctggtcatgtgcaatgctcattttaaaagtggctttcccagcgggaaaattcttgggtcgtgtggaagtcgctgaagttactgatgcttacgtcagaccggactccgatgtggttagctacgtgtctgaaaataacaatggtatttccactttagaagatggtggtgaggatgacaaggaaagttccaccaaatacgtcacaaattcctccaagaaaatagaaacaaacgttcaaacaaagggctttgattctccatcttcttcgattagccagccaaggataaaataccatactaaatggataccgtttgatcataaatacacaagagaattgaacccggacgttcagattctccccccaccagacggtgttcttgtttataggctatcagagagctacacctatctcaactgttccagacactacaacatcataaccgaagaagttaaaaaagttaccagacgtggtcaattaattcgccacagaaaaaaatctgaccgtccatggaatgatcctggtccatgggaagcacctgctttcttaaagaatttgaaattctggaagaaaagggagaacgaccctgaatccatggaaaacgcgcccagcacctcagtcgatgttgaaagagatgacaggccattgctgaaaatactatgcttagacttctcacaagtggcacagacagacgctacggctcttcaatcattggttgatttgagaaaggccataaatcaatatgcagataggcaagttgaattccactttgtgggtatcatttcaccatgggtgaagagaggtttaattagcagaggatttggtactctgaacgaagaatacagtgatgaatccattgttgccggtcatacaagttatcacgtcgccagagtacctcaaggcgaagaaaatcctgaaaaatatagcgtttataccgcttcaggaacaaatctacctttcttccatatcgatatcccagattttgctaaatgggatatctagccaatgcatttacaatggacatgcaaacatttatatcatctctttttttctatattcctaaaccaaaaagttttcccccttaaaagtatacatttaatatcataatgagatagacactgtttatataataagaaataataggtaggatggtgccatcgtgagcatatacatacctataaatatttaccttatttttattttatttttctcttcctctcaggaacaaaagaaatacaaccgttattaatgttattgtcgtgggacagctcccctttttttttatttacttaccacagatagaaaaacatgaaagcagcacttacaaatagtataatagtgaaagttaataacgtaatatttttgaccttctgccaccacattatttcttttatattgaccgctttgcgcctaaatttattactgctgctatttagttgggaagttttatccaccaataaagaaactctttcttgtctctccaagaacttgtcgatgttatcgttcattatctggatgacgtcctttatttggtcttcggtggcatccccgatgtcacttatagtgttctgaccattcccattactagattggccatttccagaactatttaaagtttggttacggtattcgaccagctcttcatggaaagagtctagtatttgacctacatgcgaacttaaaagttcgtttgtagcgttggactcgtattcctgcagcccacttagtatcctgatgggcaaaatcttgggcatatctactaatgtgaagcaaacgtacacagttttggggtcatggtcatccgtggagtagaaacaatcgaatccgtcgatgagattcattgacatcttggtaactttgttccccttgatcggaactactttgggtaataccatatccatgatcaaattatggaaaatgaccggcgttatctgctcgtttgctgaagttattgtaccatagttttcgtttttctggaacggctggaaacaactagatattgtttcaccattttttataacttccacataacttactaagaccatatgcaaaatcaagcaaaatggaacgttagtctactgaatgtaacatagtaaaattatggcatggggggatgagcattcgcataatcccttttttaaacatttgttaattgtgtagaaatatttatacataccattaaagcgtttcatttggtaaaaatataaaagtccaatgctctaacagcttaataaattgtcgcttttcactctgttcttcaaatttaatagctgttgctccaacttagtcaagtgctagaaaattcatagaggggctttttttcatcattattgtgacctcattttttctttcttcgatcgtttgaggcgaatattacccgggcgcttggtggtaatgcgttgttttaaatattatatataatgaatgtggtggtagaatatatagtttactatttttagataatgcaaatgggtggggtgaaggcgatgaaaaggtggggggtctatcagagaaacctgctgtcacaccagccctttacgacatattgaatctctctcgtaggtgcggaagtcttattggtgactttgcctaaatttagttttccgcatggtttgagcattgtgccgccattgttgaaccatggcttgacgtctgagtgtacgcggaccaaagaacttttcaaatccgccgttgcatgttcgcttgcggattcacggccttgcgaaggttccgtattgcttgtcgttgcaacaaagtgcaaattccagggggtagaatcgccaaaaagatcatttcttgtttcatggaccatgtcagaccataattttttcctagtaattagggcaagcttaatatcgttcgtagagacatttggctcctttttgatttccaaagaccgaatttcggaatacgttagctgcttcaacagatggtcatctacttcgacttcgggtaaaatactcttccttttacatgatgtttcaatagagtataactttaggaaattggtattcaaacttttttgtcttattcttttattgggcaagagctcgctagatgcaatcgaaccgtcggtctcgggcgatggtgatgcagatggccattgttctaattctaccaggtcattttcgtaaatcatgttttctgtagtcgatttgctcctactcttccttcttgaagtcttgccgcctttcttgtcgatgatttggaagtccacagaggtcggacgaagtttggcatcggacgacgcagaaaccagtgaaagggcagaggacgatcgcggacgccgttcgtatacgggaggaaagatatcgactaaatccttaacctcccagtcgtcgaacaaatcgagatcatttatgtttattattttcattttgggcacgaccggctcagccagtacctcatcgccaatcgcgggggtctgcaaatcgacagcgtcagcaatatcatctgtcaagggatgaagtttagaggagctcaatgaagaacagtcgctttgagcttcctcggagaacttcctctttatgctctgtgttaagtggccctcatgtatggggcattcgcccgataacgtcttggcggaatttgttttcctaacttgcgacatgaccgagcttaaggacggggtcatcaaagatgagcgattttcgttcagcagttcggaatcgtctcgagccttcagtattctagtcctcttgaagctattcctcttggttagtgttctagtacgttcagcgcttccttgaccatcgaactgcggcttagtggagtggaaataaatctcatcgctcaccgtcctattacttgtggcggtcttgttcatgctggcgctggctaacttgttattcttcttattagtagcggtagcgtaaaatgacttgggataaaatacctttgatgagtcgctccatgagtgcaatgcgccatcatcacgtatgcttttgatgaggcaatgttcatgcacatgagcatcgtgcattagtgtgtgatttgtgttcacgtccagcagcattctataattatgtcttgttgaaagtgttctgtatgttcgtgtctatccaaagaaacaagtaattgagaaaactagccatcaaatacttgtgaagaagcgagtttccattctctgtttcactcgtttggcgttctcaccatcccacttttatttcattggcttttttaacacaataaggcgccttcagcacctttgccgcgcattaaggatggccactgacgaaaaaccggataaaaaaagacgaaaaaatgccgtctgaccctagtcaggagccgcctcatacaccctaattattttggcgctaagccctaagcatcattattacccgacatgaagcgacagaagccctacggatgtgcggctggaaaagaaagtttcatgaagaaccagttgatatatattttactatatacttttgctgtgtatttctatatgaggctagttggttggtgggaactggaagtgaaagttctgttctttagggtgcagcggttgctgttgctgttgctgttgctgttgctgctgtggttggattgatgcttgtgatgtttgtggtgcctgtggtgcttgtggtacagttttgctgccagtttgctgcgagtatgtaattatggggtgagcggcatttacattaggtgctggattgatggctggatttgttttttcgtaagcggcgatactaggcgttgtgctacttgacatgtttgcaaatgcattattaaacactggaggtgagacagactcggttagttcccttttctttgcaagctcttcgagccttttcttttcttccttcattttttttcttctttcacggtcttcctgttgttttctttgtttggcccttattattttcaattcaggcacaaaaatgttgcgcagctcaagttccaagtccctgatgcaccaagcgcagataaaagtggagcattcagacagcggtttgcgtttatcagtaggtcttgaagacttggtgctgggttcaagtgtggattggggtctgcgagaagaccttctattgccgtgcgaatttcccattatgatgacgccaaaatcacgttgcgacagcgtgtgctgtggggattttgtggttgaagatataagctctataatttttggaggttggcattcccaatgctgccacctgtaacaatgatcacagcatatcaatgggcggttattgaagaggtcagtctccgtgtcttcggtgataatcatgggcgccagctctggttcgcccggacattggaaaacagaatcttggttgtcgggctcttgctgcggagtaaagatcccgtagttggcaagctcatctagctcttcctttgttatgcagaagtcactaggcaattcagggacgtctcccgtctgtagtggcccaacagttccaggaattggtggttccaccgggattatactagattgaaagttagggccgtgatcaagaactccgatatcgatttcatttaagggattgtcctcctccctgcccaaagacgtttcaaaaaacggtgtaccagaaccacttctatctttgagctcgttacgcctggtcaatttttcatctctataatcttgatcgtacaattgccacaattggttccaaagaagatcttttatctttttgatttccttcgacactagcttgtttctgtgccttataaattgttctctttcatctagtttttcaaaccactcactttccaagtcttttttcttgttttcttcctctttcgctaccagtctcgaagatcttttcctccttgtcattagctccgcaattgctctctccttttctctgttggccaaaagttttgccgaatatagtctatgttcggcatacaccggtattaagttagttatgaactcatctatggctttcgaacttttattctctgaccagtattctagcatggacccccaattagttgtaatcacatcataatcaattgtaatcgattgaagatatgcatcgatatcgtgagagtactcgagatgaataagctccactgaatcaggaatgtctgggtcgctttcttttatagtacagttctgtagttttattgggatattcagagtttgagagacttgggaggaagagccttcttttactctgtgaatggttttctttacgagtacaccaacattgggtaaggcaaacaagctcttcatttcctcccctccactattatcatcatccagtataacttcactaaacgtaaacagatgcaagttattcgctaagtagtttttgaagatcatatttttcatttcaattaattttatgatactgtaaatgatgtcgaattggcgtgcaatttcaagctccaaaaaaggtaagtccgtaaccaaatctgaatacgcgctcgagttttgcaagtgatggttaactataacattccaatctttcaattgcccgcttttatttcccgctaattgatgcaataattgcaatctaattctgtcgtacaaattttgcgatccttcatctacgtcgacttcatcattgtaatagttcgagtccttcccgtctatcttcgaaaatacgtcagttacaaatacaccttcatcgaatttgatattcttccacaagcatttggtagagctaccgccatactggtcagtattaaatgtcgttgtagtatatgattcgcagacattggaaagccaagccatcacatactggaagtgccagtgattggccaagtccgcgatcttctcatctaatatttcagaatacggcagctggtgcttgttcaattgggctattatgtcttcggagacatattctttccagtcttcactatccgcattcgcagcgccggcaggcatgctcgctcctacatttcttgtacccctagttctcttcgttctcatcgatcgctgattcaccgctttgtatctatatatgattagccagtgtgtatgagtaaaatagagcaattgatctagtttcttagtcgtgtcactattgaataaataaatgttaatgttgctggaaaggaagaattatgtcacttttgacgctctcgcattccgtgtgcggtgatagcggtaacttggtctagcaacgaaaatttaaaaaggttggaaaaggaaaagaagagctcaagtggacctagaagtcctgctttgccaccgtttaagcaaggaatagagcacgccgttgacacaaattcacagtcaaggacgggccacgagaactttattacaaaatatactgcattacacgaaattcagcggaactctgagcgcgaacagcattaggtaccgagaaacgcttttcaaaagaaatttctaaaagttttattgtgccattaatatcgcggctcaattgttaagtatttcactatgcctaatccgaatacagcagattacttggtgaatccaaatttcaggaccagtaagggcggatctttatcgccgacgccagaagctttcaacgacacgcgagttgctgcaccagccactcttcgcatgatgggcaagcaatctggaccaagaaatgaccagcaacaagcaccactgatgcctcctgcagatatcaaacagggcaaggaacaggcagctcagagacaaaatgatgcatcgaggcctaatggcgccgtggaattaaggcaatttcatagaagatctttgggagattgggagttccttgaaacggttggcgcaggctctatgggtaaagttaaattggtcaagcatcgtcaaacaaaggaaatttgtgtaataaagattgttaatagggcttccaaggcttatctccataaacagcactctttaccttccccaaagaatgagagtgagatattagaaagacaaaagcggttagaaaaagaaattgcgagggataaaaggactgttagggaagcctctttgggccaaatcctttaccatcctcatatctgtcgtttatttgaaatgtgcactatgtcaaaccatttttatatgctttttgaatacgtttccggtggacagctgttagattatattattcagcatggctcattaaaggaacaccatgcgaggaaatttgccagaggtatagctagtgcgctgcaatacttacatgccaataatattgttcatcgagatctgaaaattgagaatataatgatatctagttcaggtgaaattaagatcattgattttggtctttccaacatttttgattataggaaacaattacatacgttttgtggttccttgtactttgcagcaccagaactattaaaagcgcagccatacacaggacctgaggtagatatttggtcgtttggtattgttctttatgtcttggtctgcggtaaagtaccatttgatgatgagaactcaagcattttacatgaaaaaataaaaaaaggtaaagtagactatccttcacacttatccattgaagttatatctttattaaccaggatgattgttgtcgacccattaagaagagcaacattaaagaatgtcgttgagcatccatggatgaacagaggatacgattttaaggctccatcatatgttcctaatcgtgttccattaacccctgaaatgatagatagccaagttctgaaggaaatgtatcgcctagaatttattgacgatattgaagatacaagaagatcattgatccgattagtaactgaaaaggaatacatccaactttcccaagaatactgggacaaattatccaacgccaaggggttgagttcaagtttaaataataactacctaaattcaacggcacaacaaaccttaatacaaaatcatattacaagtaatccatcgcaaagtggttataatgaaccagatagtaattttgaagatcctactttagcatatcatccattactatcaatatatcacttggtttcagaaatggttgcacggaaattagcgaagttgcaaagaaggcaagcattggccctgcaagcgcaagctcagcaaaggcaacaacagcaacaagtagcacttggcactaaggtcgccttaaataataactccccggatattatgaccaaaatgaggagccctcagaaagaagtagtacctaatcctggtatttttcaagtgccggcaattggaacatcgggaacctcaaacaacactaatacctcaaacaaacctccactgcatgtaatggttcctcctaaactaacaataccggaacaagcgcatacttctccaacatctaggaagagttccgacattcatacggaattaaatggtgttttgaaatcaacaccagtccccgtgtctggcgaatatcagcaacgttctgcttcacccgtagtaggtgaacatcaggaaaagaatacaataggcggcatattcagaagaatatcacaaagtggacaatctcagcatcccacacggcaacaggaacctcttccagaaagagaacctccaacatatatgtcaaaatcaaatgaaatttccatcaaagtaccgaaaagccatagtcgtactatatcagattatattcctagcgctagaagatatccatcttacgtgccaaattctgttgatgtaaaacagaaacccgctaaaaacactaccatagcacctcctataaggtcagtatcacaaaagcaaaacagtgatcttccagctttacctcagaacgccgaactaattgttcaaaaacaacggcaaaaactattacaggaaaatctcgacaaattacaaattaatgataatgataacaacaatgtgaacgctgtagtcgatggtatcaataatgataatagtgaccattatctctccgttccgaagggtcgtaagttacatcctagtgcaagggctaaatcggtggggcatgctcgtcgtgaatctttgaaatttactaggccgcctataccagcagcccttccgccatcagatatgacaaacgataacggctttttgggagaggcaaacaaggagagatacaatcctgttagcagtaacttttcgaccgttcctgaagattctaccacatacagtaacgatactaacaatagactgacttcggtgtattctcaggagcttactgagaagcaaattttggaggaagcttcaaaggcaccccccgggtctatgccatcaattgattatccaaagtcaatgtttttgaagggttttttctctgtacaaacaacctcctctaaaccattgcctattgttcgtcacaatatcatatctgttttaacaagaatgaatattgatttcaaagaagtgaaaggcgggttcatatgtgtccaacaaaggccatctattgagactgcagctgtccctgttataaccactactggcgtgggtttggattccggaaaggcgatggatctgcaaaatagtttagacagtcaattatcatccagttaccatagtacagcgtcctcagcatcaagaaatagttcgataaaacgccaaggttcttataagaggggccagaataatataccactaacacctttagcgaccaatacacatcaaagaaattcatctatcccaatgtctccaaactacggaaaccaaagtaatggtacatcaggggaactatcttccatgtcattagattatgttcaacaacaggatgatattttaacaacatcaagagcccaaaatataaataacgtaaatggtcaaacagagcaaaccaatacttctggtataaaagaaaggcctcctattaaatttgagattcacattgtaaaggttcgtatcgtcggcctagcaggtgtacatttcaaaaaggtttctggtaatacgtggctatataaagaattggcatcgtatattttaaaagaattaaacctatagatacgttgttcttactaaatatttcaacgtgtgtctttcaatttttattatctaatatttatctttttttaatattatagtataatttatttaagctgagatctgctttctttaatctttcatatgatgaaataatagttctacataaatctataagaataataaataaagtaaaacaactgcaaaaaacatcgatgtcatccaggatccttgaaagatttcactctggagaagaaaaaagatttctcatttctcaacgaacagttagatgcattcccttccttatccactacaattgaacttagccatttcaaccgttgatatctcttattgccttgattcttgatttggaattcttcgataaacgtatacttttcatctgaccttgttatctttaaatgaccaaaatcataatcaaatccgaggctccaataacacatatgactatgcctgggtttgttctctttggagaagtgcttcacgacagcgctaggttcatctgtagaaagtaatctcaaacattggccgttctcataaaatctgaaatacctgtaataggtgatcatgtgaactggctttaaaagagataacgaactttctgcattggaaccgtatcttacataatttactacactgatgtaaacaccttcgaatttaatatatggcctttcccttaacatacgataatcatcaccccgccatatttccttttcaaaggtatttatatcggtgattccgttaagatccattgccattttgtcgtatatttgcttagaatatatgtacttcgcgaaagttttaaatggcacagaatcgtggaagcaaagcttgctaaaggtggaacaagtcatcgacaaattcacccaagattcaccagacattaatataacttttttaataattctcagtaaaatgtcgtcaggcaagatttccagaatccagcagggttgaagttcagcattttcttcaacagataagtcatctttaccggtttcattttgttcatctggagcatcagtagtcattgataatcccgatagttttttgtgcagcatccactcatcaagtattttttttctgtacagtgattccacattatcatggattttcaatgcacttcgatagaagtttatagcatctgacattgacccatccttctctttcagtacacctttttcccaaatagcaatagcctctttagccctagggtccttttcataatctactatcatttgctccttgagtttagcttatggaacacatgtgtcgtcgccaaagatgatggggaatgtttgcttttatcttgctcagtcgatttcgctatctaggaactacaatccttttttttgtcatttggaaggctctttaaaattccgaatcgataagttcggaggtgggaaaggatagcggtatattccttcccaaataaaaaggctacaaacacattacataaagaatatttgttcaagtaaacatatcctcttcactcaagattacttcgacaaaccatcattggtgtttccaccaatcagcatatcaatctcattcaataaagtaaagtcaaaattgtactctaaggcaaaatcgttaccgtgagatagagtccctaataaatccatagtttctgaattatgcaaagcatcttcagagttttctatgaattttctagcaagttcgtaattcagggtaggcgcacttaaaaaatttaagaagtcttgttttctatcctttttaatcaagttggacttcatgcattggatggctaaaatcgcagaataaatcatgtaaattgtggccttctcaaacgtcttaaatttatttttccaaacttttaaaagataatacagttcatcaacataaccttcaaccaattcccggctttgtttgatttcgtatatgaaaggtttattataggaaattagcacgatatagtaatgaaaccatacgtaagctatggttgggttaaaatctgtcatttccatcaatgacctcttggtccattgtagttcagggggcaaatcccttctccaattgtatacctccagattaaatttggccaagtattcactcctttgaagtagagtttcgtttgggctgaaaatcttggatgcaaaaatctccgttattctcgataacacaatcagtttcttcaaggggtttgcagtggacaatattacttttgggtcatatatgtactcctctataccagtctcaatttcaggtagctcgtctgtttctggaacagtggaattggacaaacgcaaggaagttgatcttccaaagaggatcgctattaaatgatcagcaatgtagcagccccaataaattctacttctcacttcaaaatccattattgacagctcgtcttcataaacattactccatgcttctggattcaaatgtaggccgatttcgtgggcaatcctaaatgccagcccagaaagataccaagccatggggttttctccgcttccaatgtcataaaatgccaaacacaatagagtctggatgattgctaatttcgaagaggacgacgattcagctaacgaagaatcttccagttgaaaaatttttttgagtactatcgtcttggctctttgataaaacacttcagattgttgaaaaagctcagtttctgatttgtatgaaatcaaagatcccaatgcagcgattgcaaataccaattcttcggaacaatagtaacttttagtgttagtatcaccgaagaaagcacttaagaaagtttctctatgaatgaaaaggtaatgtcccgggtatagccatttgaaaaagagtgacaacgatcttaagataaggggacttcttgataaattttttaggctgacctgctgttgctgatatcttgtgcttccatccgtcttcttttttattatagacaaggaatttgatggatatatactatttgtgccaactggtggagggctctcggaaggcattttcttggtgaacgcatcagactcattctcatcgttgctttcagatgatggtagtgctgattgtgctgtttcgccatactttaagattttttcattaggagcatcaccatgatcactgttgttttttaacgaggagagagcattgctagcaattgtggaagacgaggaacttaatatttgcaactgttctttcaaagaccgaatctggctctgtaaagcttctacgtaagtcgtagaatatcttttgttccttaagtcttgttgagtgaatacacattcggtacgaaacttgatacagtttgaacaaggcttttccatgttacatttccttcttcttctacggcaattctggcatgctagttttctcttcctgggcacgttgttattattctggtcattatctgtcacagatttctttaaactggacggaagggagggtgttaccgttgttgttaaaggtggaggtgaaggctccaacatcattgctgcgattgtgtagagcttcgagttttaaaagggctatttttgaaaacttacggcgatgtcaacttgttgattttgctttgtttcgttcgggatggatcggaacatccgctcacatatgagaggtttacactcttgatgtatatgttgctctatcttgtatacggttaagtaaagtgatgtattatgtatatgtatgtatttatatatatatatatatatatgcgtggttttccatattgtatttttcttctctactctatataggcattactttgacaggaacgagactaaagaagaggcaaagtgctgcgggttgtccaggaaaagattatggccagcatcagggacttcaacgtagctagcctttgccttgttttttagcattgattcagtagtcaagtagcccgcatatttatccatccaatcgtgctcgccatacatgaacatgacaggcgttgctgggttcaaaaaacgaacgttgtttattatcggatctctagcgatcagattcctttcaaacaaatgggtgaacaccttgattgtctgtggttgcaccgtctggttcttcccgacaaatgagtgcaaaagatagtccttatatatctgatccggaacttttacgtatgcggtggagatgtagttcgagcacaatttggagcctatgggtcccatccacttcaaaacgtttagctggttttcaaagataaaccgcggtacgttcagctttcttgtataatatcgggacgatgggtcggtaaacgtaagtggataggtggtgttgggctcccatttgtgggtgatagcatgtatactgttttccacaccaagaggagatatgagacacagtttctcaatggaatcagggtacttgagggcgtatttgaatgaaatatatcctccgaatgaatggcccaccacgtttattttgcgaagcttgttatccttccgccattgctctatcctgtctacgaagtagctttcgtactgctccaggtgtgacttgatgtcctctgctggggggcgcttctctatcacagggattactacgtcatcttctatatgcttaaacctgagagacttgatcttcttggttttgttcacttgcaatgctggcgcctctgaggcaccattggctggcaagtcgatggcatatagatctttaatgttgtctgacaggttctcaaacgtcctgtagaacgccatcgacgaggcagcgtatccatggattagtactgtaggcgtgcacactttgttcgcacgcttattgtggaaatgccactggttaatcccgcctggagtcatcgtgttattaacggacccacgcacagtggtgctatccataatttgctgctgcagggccttcaggccctgcacgctagcacacaccttggcgtctgcagtagtggtctccttctcagttttgctgcaccatttgaaagtgtttgtccacattctactgaagaaaactacgcttacgtatgtatatgtcctgaacaatgagagaaagacctgcgaatatacttctactactccacgtacaaaaaagagcacgctgctttatttatacttttgtgccacaagaatgatcaacatcaacataaatatcaactagtatctgcaacacatctgctccacggaactaaacccgttgagcagtgccccgtggaaacgtaaactatcgcaaattgggattaacaagccaaaaacagccaagcaagattcacgaaaccgcgcctcgtttggaccccgaaggcccatttaacggccggccgttacaagcaagatcggcagagcaaaccactccccagcaccacagcacatcactgcacgagcaacaataactagaacatggcagatagcgaggatacctctgtgatcctgcagggcatcgacacaatcaacagcgtggagggcctggaagaagatggttacctcagcgacgaggacacgtcactcagcaacgagctcgcagatgcacagcgtcaatgggaagagtcgctgcaacagttgaacaagctgctcaactgggtcctgctgcccctgctgggcaagtatataggtaggagaatggccaagactctatggagtaggttcattgaacactttgtataagtgtttgttgtttatgtatccgcatatagcagttataacagataaatggcacttttcgcacacccgttgttttatctccgatagtacgtgggcctttatttatggtcgtttaacgaaagaacggcatcttgaattgagcaggtatttaaaagataggacgagaaacaagcacatgatctgtgtcgaaaaaaagtagcaaagagaaaaagtaggaggataggatgaacaggaaagtagctatcgtaacgggtactaatagtaatcttggtctgaacattgtgttccgtctgattgaaactgaggacaccaatgtcagattgaccattgtggtgacttctagaacgcttcctcgagtgcaggaggtgattaaccagattaaagatttttacaacaaatcaggccgtgtagaggatttggaaatagactttgattatctgttggtggacttcaccaacatggtgagtgtcttgaacgcatattacgacatcaacaaaaagtacagggcgataaactaccttttcgtgaatgctgcgcaaggtatctttgacggtatagattggatcggagcggtcaaggaggttttcaccaatccattggaggcagtgacaaatccgacatacaagatacaactggtgggcgtcaagtctaaagatgacatggggcttattttccaggccaatgtgtttggtccgtactactttatcagtaaaattctgcctcaattgaccaggggaaaggcttatattgtttggatttcgagtattatgtccgatcctaagtatctttcgttgaacgatattgaactactaaagacaaatgcctcttatgagggctccaagcgtttagttgatttactgcatttggccacctacaaagacttgaaaaagctgggcataaatcagtatgtagttcaaccgggcatatttacaagccattccttctccgaatatttgaattttttcacctatttcggcatgctatgcttgttctatttggccaggctgttggggtctccatggcacaatattgatggttataaagctgccaatgccccagtatacgtaactagattggccaatccaaactttgagaaacaagacgtaaaatacggttctgctacctctagggatggtatgccatatatcaagacgcaggaaatagaccctactggaatgtctgatgtcttcgcttatatacagaagaagaaactggaatgggacgagaaactgaaagatcaaattgttgaaactagaacccccatttaatatatctctgcgtacatatgtatatatatatatgtgtgtatatacatgtatgtctgtatagaaaacgcatatcaactgatatatatacacgtgaagcaaaaaaggcattgcctctgtcagagaaacgaactatcctcgttgctatagtgtcttctgcacttatcgcgtagactttctattggcactctgtcatggcatttaatcttgtacacattctttaattcttcttgcaaaagaaggtactcttcatgcaaatgatgactttggagtgaattgactaatcctgagtcgttccagaaactttttaaggcgttcgtttcatgatttattatgtcatccaaccgtctcatattaggtttcgaatttgttacaaattctcgccttgataacctctccaggtcttctttgttgcatccaggtacactctctaacaacattgaaccattgccctccggattcgcactgtcatatttattagcctcttcgccgcacatgatgtcaatatcgggtcgatagctgtctatgccgtctagatggcccaccttatgaaacacaagacaatgtgctgccctttcggctttcaaaaaactgtcaattctactttcccttagcgtattgcgctcacaaaacggtgaataatcgtattgcttttcttcctcgatgtggctcaaagtattcagatagtcgacttcgtctacgtccatatttatcccatagagatcatctgcagtcctctcctctagtacttcgcctgttatgggcatcgaatcatcatttattacccttgtcgaccttttccgtagcggtgtggtaaaattgttaaagttggctttgttgaaccttggtgttttccagggcggcaatgacggtagttgaaacaacttgccttcgttcttatcaccattttggttcatcttactttgtcacagctatttctttccttcctgaatttgtccttccaaacctagttccctgttcttaatttccttttatttaggtttttttttttgttttgtcaagagccgcgcacaaaatatggtattattatagaaaagttggacttaaaagcttgaaaaagcttagattttatattcatatgctggtatatatgtacgactaaataatataaatttgattataacaatccactcaaggtcagcttctccaggaatggtgaaagatcttcacgacgtatttcaattatggaactttcaaaattatctattctcactttagcatccgtttctgcagttatttgttgaaacgccatgctgaaattattcaaaataggtttttttgtgtgtatcgtgtctagtccgcgaggatacctaggtgttaacccagcaaccaagtaagtgtccgtattttcatctatgctggcaagcaccatgggcaacaattgcttgtcttcagattccgcacagcattctatgagccaatttcctaatcttaataacgtcaatgggtttctgtacaagtctaaatcgggtccgtcttgtaagacgcataatctataaattcttaaatgcttgattaatttcttctccaatatagcaaccccggtattaaaaattgctctctgtaagtcttgtgctagttgaatgccacggtttaatagttccacctttctgtcatctagagcatcccaactgagccaaaaattcgaaacccatctttttctcaaattcgtcaatttttgagcgctgttatcttcttcttcctctccatctgtatcgtcattattgtcattatttattttcacactatccttatcagttgaattacctacttccaaaagagctgttagtgcttcgacaaattcactggcacttatggacccacgatatccaagagttctaacaaacccatctctaattatatcttgcaacccataacgatccaaatttttgtcaaatattatcccaagttctctcttaatagaatgatccatgtataaccatgtttcttgtgcagtacttaatggtatacccattctagcaaacatcttatgcaatctctttttcccattttcattccatagggatagtttggcattgacatagttagaataataaaaactgtcgtacaatgaagaatgcctcagtaagaaaaggtagtaatccggttggatgtttaacgtcaatgtatcaggggtctttactgagtttctactgcttggtgtgagacgcttcacttcatcttgcaataaggggtataatcgattgtaaacttgagcatatgctatatctaacgaggtcgtaccaagtatattcaaccacaggtttgaaagatttgtttctccgatagcagacaataatgaatagatttgtgcagatatcgagttaaccactgttgtgccttgagaatagtattcctccaaaacaccttcatattcatggatttgcttctttcgttgctttctttttgagagatcattcggtcctattgaagaattacctcttttattagatattgtctcatcttcgtcttcttcgtcctcgtctgtgacttcatcggcatcagttgcctcatcgtcacccccattattatcgttctcgtcacctgagagctcatcgtcaccactctcctcgtccagttcaagcaatttatagtatgcttctttttgttcgcctaatgtgtcatccaccgtaccgtcgtcaaaacattggatgatttgtgatccaaatatattgtcgagattccacggtctatgagcatccaacacgtagatgtctctcctgaaactttgttcccccgacttttcatctgtatcgataacatactcttggggatcgatttctaagaaagcctccagatcaataacgcctccaaaccctactaatagcagactatttatattgtcatccaattgagaatagtggcgtcgtaattcagagtacccaaatatcggtactatttgagattgtaccaattgttttttgaataatagtgacaacatcttcgtcgcacacagcgcatcgatgttaagacaagaaacgaaaatgaccaattgacatgatgaatgagacgatgaattccttaagattttgttgtaggcttcgctaaactggctgattccataatacatgtgcgagagtatattcttgttattatgtgccttctctctagtgtttattgctacacttttattgctctatagtgcgttgtataaagtagccacaatggattgttggcattactacagcttcattatttactgaaatttcttaaaacgcgttagatgatatgttgaaaaaaaaatacgcgtcgtgaatgaaacttattaggttttacgactagttaaagcaagagagagaagatcgaattgactaaatgtcttcactttgaatttattctagtaggattcgcatggctttttcataataaaaatctcgtttatttatgcttttggttggttttcctttgataaatgcggcccttgctttgtttgtggttgcaacgagttcgtcaaatgataaattgacgcttaacacagacgcatgggaaccacgtaattgaattaatgttttcttctcgaaacaattgcaatgtgactttcttgttaggcaatgtgagatgaaagatggcctttacctttgcagatgtttgggtgtggctctgagctgtcctttataattatagagataattttgatgaaagctcagaagacctttaatgacgaaaaataggcatggtttgccaggcaaaaaacgaccaaattttactgtagtatgagtcaaagtcgctggagtatcgttctcatctttgcattgtttatttttggcagcactggagtgaatgccttcttcaatttcggtcatcatcagcaacagcaacagcaacagcaacaatcatatgaagatcaagttttaaataacccttgtgatgggtatttgtgtccggacaccctaacgtgcgttgcacagcagaaagactgtccttgtcccttccctaaatctcagttgaaatgtgtccttcctgataataaatttgtttgcatatccaaaccagccacacacaatgaaaagtttagagcaatatatgatgaccctgtcaagggccccaaagcaaagaacaaggggtttagggattgtggatgggtatcagatgcttacaaaaaccattgaaatctgtataaaaaatacatacacatacatatatacatacgaaggatttatcttctcattgatattctagtctctatttcttccgggaacccatctcttatacaatacttcaccaacttgaaaactattgaacaatttagtaaagttgtttgatttccatagtgctatcgcctcctgttccgagattagtctctccacgtagcataacacaaacgtcttctttgcgccgcccacaacacgggctatgctagaataccacgtataatctttagagacgtcgtggtcaagacccataacacaaaattcagcgtgttgaaatggtggccctctcttatataataaataatcgcagccgaattttataccagatcttacgcaccaaccgtgtgatctgtagtgatggtatataacgtatgatctgacaaaggagtgaatatctttatatttggcatcgaattgaaacagtttccctgccaggcacgcgggagatatgtcaagaacaggaagtgcaaaagttaaaaacatagcttccactggcattagttctagtgactctagtggcaaaagatcaccgttctcatcaagaagattgttgtcttcatctcttaaatttgattcggaaatgtcttgctgttgtgcaacgatgcccacgtcttctgtttgttttagtttaaattttcttaatgattctcgttgtttctcaaggaggatgttttcctcatcgatatgaccacctttttttcttaattctagtaattctctttctaacttcgcacgttctttcttgaactctaatctttgtaatctcctctgttgtgtgaccttctctaaagtcatctccgtttcagtattactctttgttcctccccgattgtggaggggagtatcattgagacccagtctggcctctgttctagctttccatgtaggctcactcctgctaaattgaccagtgccaaaaaatccattattccaaagatatagcatttgcttgtcatcttgaaccgtgatgtgaagagtggtatctcctataaaatctacatgtactttatcgttcagtgcgttcgtactcttgtaatagcggtatgcccaatatagccaagataacggattatgaaggattaactctggaaggtcatctacggggtgaattggaagaggatacttgtaacgcttctgattgaccctccctttagacatgctccttcttgagtccttcgtacttattgtcttttcagcgtcgtgttacaatgaaacgttttagcatattgaatttcgatggaagttcaaatgttttatgcaccgaaatgaaatactagagcaaagagatgttagtgaaagcaccagctaatatagctctttcaaatttacgtgaaaaagttatgtgtggcaatataaatctatagcaagagtggcttctataaaacatttttgacaagaaataaaattcagataccgttgtagtcttgagaaatcattgtgctcacatcgattaacttcgagcaacataaatcatgctatcatcattaaaataaagtggaagtattaagaacagatataatagcacgagaaaaaactcgttcaactaagtctagacacacctcctggtgttatttagtccgttctcttaacaaccaaagcctacgagctctcaaacagctcttttgttttaacttcctatagaactgaatgggaaacttgcatcttgaagaaaatttttctctttaaatatctgactgaagtattgatcccttcaaaaaaaaaaaaaaagagagttggttacccatatgggaataatatttcttagggctaattgacaaaggattgctaacagaaaatgcaaaggactaataacttgaatcatttttatatcaggtttatataggtatacgttcagtctaattaataatttatagtttacagtagttttttacagtagtttttttttttttttttcagttccatgatttttttgttcctttgattcgtgtagtaaacctcctcttcttggttttcacgatatacttagctggatgccaggtctgtaaagtattgacgcaaaatcagtgaaagcatttcgggtagttcgcttatatcgtgtacaacaacataaaattcaaaaggaaatgtgtccaagtatttggtaatctttaattgcggattgccatactgatctggaatgtagttcacttggctcatgtctaagatggattcattagaagtaataccatctatgatgacaaaaaccagcataattttgttttctctagcacggcggaccagtttttgtattgtttcatggtcttcgcaaataccatcagagattacaatttctagttgccattggtcattatgtaccatagcgcgagcacgttcaaaaattttagtagattcagccacaagtttcttaacgtctgttttagtttcttggaaaccaaaccattgaaaagctcttgcgccagattcgttactaaattgttggtcaaatgagtgaacttctttaatattttcaccgaatttgacaatagataaccctccagcctctagctgagttaacgtcttggagaccaagcataaactatcaaaagcgagtttaacgcatttagattcgctcatagacttagaatcatcaagcgcaatcattatttgatactgacgtttgcttggtttagttcttctcaaccagattttatctttacggaattgtgaggcaatatatggaatgatccgtttcatattcagtctcttacctgttttgtaatcacccttcagctttgtagccaaggtaggttccaagattagtcttaattgttctccaagacgtgatactaaatcggcggtcgaaatttcacttttatgccacaattcacgggattcttctaacgatctttccggtgtcaaactagcacttgcatcaggtggattatcctcaatgttttcaattaaagattgtatttcactgtcatcctcttgatcagccgagaagtgttcatttgaaagttcgttctcaaaatcttcctcactctttcttttaccgatgaatcctgactttttgctgtcaacgtcattgttagcgtcatgcgcgtcgatatcagatagcatctcttcttcatcaatatccattttttcatcatcggcgtcttctactaactctttctggtccacttcttgctcctccctatcatcatcaatggccatgtcttcatcaatggtttgtaattgatcctgtgttgcagaacctaaagcttgcgtatctgtttcagtatttgcaccctcaacatgttcaaattcatcgggacgttcattgtttttttccaaattttcgtcctcttcgccattagtttgtgcttcttttatatcttgacgacgtctatgatattctttcatgctatcacctagttgctttaaagcagccgtagcctcttcgcgtgattcttcattattctttgtcacatcttcttgatcttcttcataggtattctgagtcgttcctgaacctccaacatcgtcctgttcttgtgtgtccgtagcatcagcaccagcacctttggatccagaatcttgttgaacggcagcttcttgatcgatgtcttcagtatcagccttttcctcaacgccatcaagaccttctgtattctgctcacctcctttctctttgttttcttccatagcagcatcttgctttaactcttcttcatcagacatggcttgctcttctgggccattttcttcgtcttcctttccctcatcattagtcatatccacatcctcttcagcaccttcttcttcgtcaagagctgtttctgtctcgccggcatcttcctcaggaccaggttcgtcgttttcattatcactttcgataccggattcttgtttgacttcttcgtcttcgtttccaacctcttccttgtttaggtcatcaggcattccatctgacatatcaacatcttcgtctgattcttcatgctctgaatctaaattcatatcttcaggaaggtctagggtttcgatttcaggaacattagcctccaaatcctcgccttcttcatctttaacttcgtcctcctgttcaccaacgtcgttttcctcttctgcattttcatcgttttcaatttcctcatcgccatcttcaggtgcatttgggtcctcatcccctccttccttgttatcccgctgttgttcgtcattttcagcagcttgtacatcttcctcttgattttttccatctaaattctggtctgtatctttttcttttgaattatcacttgccttatcatcccacattttatcatcaatagcgttggggtcatcttcattcaggtcatcaatttcttcatctaattcttcttcttcgctatcagtatcttcatcatcattttcttcaccattagacaaatcttccaattcaccagccatatcgccctccatctcaactgcatcatcttcattctcgtcatccctctcatctttatcttgttgttctttgttttcgttttgtgcatcctcagtcaaatcttcgtcttgttcgacgtctttattgttattttgagcaccttcaccgtctcccaagcctgtaccctcttgcaagtttttgtcgtcaacttcttcagatggtggctgcggagaacagaacccatttttggctaagctatgcaatatcgtcgatagaatgtacataccacgacttgtgttcgtgtagtagattctagatctttcaagaaccacggtcattgcgttgtaataacgtgtgattaccggtagtgtaaaggatataactgatttaacgtaaattgattcagtagtggtaaaatcaaagtccttcaacaaggataatgctgtctctatatttttagaaacaacactggatcgtaatagtttaacgtttaccataactttcttgaagctagctgataaccagttatcatcagtttcggatatagattcaattccatctccaattaccttctggaaagataatataatagatgtgaaagtacggcggaaagcctgttcaacatcttccaccgaagggcctctcttctgttcctttttaataggaccccctttatttgctttgatccactctataatgatatcaaaaacgaaagcgttccctgtctcctttgcattttcaagcttcttcaataattcattaatgaataactcaaatctagaatatgactcgataaatgaagaatcaaaaattcgactggaattgaagtgtacgaaaaacgaagataaggtcgattttgcatctaacaagatcttttgttgttctgaagttgctgagtatttcgaaataacagacaaggtctgtgcggcatagtctaacaaagaaggcagccacttttcaaacaatctgacattatctacattcgcttttaatgaagaatgaacaatatcgccctttaagcaagtaaagtgttctaggtctaacatcataccattaatcttacagtaatcattcgtgaactctgatagagggtgacgaactgtaatcagggaaaacatcaaactctgtgcgagtgccatacctctttctatagcagcaacagggatatcatcacttggattcgatgcagcgcttctcagcttgggtaaaaggtcaaggattttgaaaaagaatgcgtctgacgaatttaaatattcattattgaaaggggcaatgtttgccaaaatagttgttgtagaagattgaactttttgaatgtcttccctaaaattgacttttaaaccgattcttctcaattctttcaatgcatcacctaaaagtttacttttttgagtcttcaagtatgccaacctctttttgttctcctttgtatatacattaggggtttccttacgtaacctttcagcttcagcataaaagtccgatgctaaatctgcgaagttagggaattcctgtgatgatatcttttccaagtaggagtccatgttacttgctaccgtgtcaatattccttaatggcgcagctctcatactccaagtagaaatttctttcaccaaatttttcgaagcctctaagttggggtcttcgtaaaaatgttgttttaaagtagggagttttagtttattttcgttggaatacaaaagaccggcctcaataatggttttcgcatccccatttagcaaatcacggtattttctgacaattttgtaaaggttgttatgagacttacgagaactttgtttcagggcatcaacgttaacatctttccaactggctaaaagaattatatcgtcaatttctttttccagactcttttttccattcgtaatccgctcatcaattaatggtttgaactgataatagaattttatagtattatggagcaagcccgctatcttcgagctcctcaatccaattagttgaatgtgcttgtagaatgcttttacaagatctagcctggcgttgaattcgcccaatgtactcttactaaaaaataagttaagtgagcttaccaaaagtgtagcgttaggggccgtttccttcttttcactaacaaaatttgaaatgacaattgactcgtacaaataaaaccaccattttccaatagattttctggtttttgcgtcttccgagttgaaaagacctttccaggtgcgtaattctagttttctccatgaaactatcaaatctgtaatcagtttaacggtgttattcagggatacttccgaggaagcgtatttttcccattcagctaggtatgtatatatttgttcgatcttttgaagctgtcttgctaagggtgttttaatggggtagtttaaaaattcttgggaaactcgatataattctttgagggtggcatgttctggccactgcttcaacaatttcaagactgacttaagcacagtttcaatgatatcacctgctttttgaaactccggaatagagaaatcgtggtaaaaatcgatattaccaaaaacttccgtgtttttgaaagattgtgtttctgcatcaagtgtattaatcacagcagacaacgatccgcttttcaactcttctatcctggtgttttttaaatcttcactcaaaattgttgttattatcgcaccgctcttcaactcagaagaaaagttggcgtcatgatctttgtcaaataccgagatatatgtgtcggcaagcttgaaatagatgtcatcaagattttcaggactcgaaatatctttttcattagttaccaaagctgtgtcctcataatctggaaacagctttctaaagtctgcctcgtaatcatctgaattatcattgaatttgaacatatttgacttttcgttttcctcctgctcctgtctgaaacgtctcacagaccatcttgaatacagagtatacaaagcagcctcaaaaatttccagtaaatttgtatccctcttatggaacttaaacagcgtcaagaagtacatcaaaaccttttcaatcgaagtatcttccatatcaccctttttgaagaaccttgacagctcatgataagcgcttaaaacattctctgcgcatgaaatattgatagggtccatactccataaaggagaaatttggaatgatgctctatccttagatttttgaagcttcaataaatcaaagccaaagttgatactgtaaatatatcccgcgaggatatcatttaaatcagcaaattttgaataaccgctttcgagacgattcaaaaaatgtgcactattttgttggagcatttctaatctacgatccgattgatctgaattgcacttgtaggaactcactagctcttttatttgacgagaactcatagttgacgacaaaaatgccatccattcatcaaataaagagtcaatagacatgcctgtacgatataccctaggggattgaggtgcgtcgtcatcgcttatggtattgataagtttttctgtgaaaatctcctcatcgccactgattactttacgaacatttctccaacttttcattaggttttgagaaaatgtctttgtcttcaaaaataaatcatataaaacgtaatcgtgtattgccggatcatagggagaatctgggacgaatagcagaagcaaacctgtaccaaatgtgatccaagcttctcccagttcttctaatgatttcgaactttcagccaaatctagagcgggaaagatgtattctgcaaaagtcacgcgtgtctctgaagcagttttttcttctatgagagagcaaagttctttcaaagtcaatttcaagcagtccccgccgacgtgaatatcaataacttttctgagccatgacagtaacatatttttatagtactccatttggctcttaagtaggttaggtgaacacttgatagtggaggaaagtagcaattctgcgtcactaatagattgtttgatctgatttcccgaaaatgatttcaaattattagatttacgaacgacatcttcgagaaactgggatgaaaatatggtagaagtaaaggaagtcaatttagcatttttttctgtccaaagaacatcaaagataggcggataattgtatttgttggtaataagttttgtaagtttttgcgtggctaaagaagaagcgggagcaagttcttttattagctcggctgtgtcaactgagaaggtatatctgatcaaattgtcaaattcgtcagcaaaataatgttttcttttgtttaaaaacttatttgaaattagttccaattcatttataccatcttctaactttgatagcaagagattaaactcacttaatttattattcaacacatcatcatttagcaaccggaaaacgtccatcaaatccttaatggaattgtatgattcagaaaattggagcagacgtactttgtcaaatttttcagataaattaatgagcttttcgaaagctagccagctgttggaggttgtcggataattttttctgaatatatcccatagtaaagttatggagtggcccctcgacaactgtaaaacatcggtaaattccaaattgatgttaaggaagggagttatctcaatgtctgatttggattttacggacgcaatccagctatctatcaactccttatatactcttagacgtgcttcatcctttgtaacggcggtttctaatgctgcaattacaattaccagtaaatcccaataatattgatattggttggagccgcaaaataaactttccgtcttaaggttttcagacattactgttaaaatattgtagagaatacagaatattggaatgcgaggaatattcttcaaatggcgaccgttaaaggcagccgcagataattcaatatacgtcagttcgtcaattttaccatgagttgatttttcattgattaatttgagagcgttcaaagagttgagtagcagacgtaaacttgataataagtataacgactctggagatttgatcttatctgaatacttgctgactgttggaagaacatattcgttcaaggtaagcgagacagtttcctctgtcaattgcttatcatgcagccccaaagccttctggaattttaggtttgcaggtttgtataggttattaatcttttctaagacacccatatcagtcaaaaatgttataaaaacataaagcctttctgcgatctttttttctgagtactccgtgcaattcaatacattattggcccatttaccaacttcccctaaatgggaaatcggaataacagcagcaagagattcttcaattggttcttcgtcagataataataaaatatcatgtacttgtgcaaatatgcatggtctgcttaaataggatggaacatagtgttttaatggtatcgacatatcaggttcatttagttttatttttttgatgccatcatcaatagaaacaaagtctatattctctccaagttcaaagcctagggtgaggcgatcgaaggctgtagaacgactgtgcaattcgtcgatataaatctccacacctctgtttctcatagctcgggataattcaccatattttggatccatggtcaaaaataatctgaagttagggtggggtttgagaacccttggttggccatcttcttggctacattcattgatgagcagcgacccgtctatctccaatagagagttcagtctatcaagaacagaaggagaacaaagattagcattatctaagattagccaatggcccttttcaactgctttgaccaacatgccatcaaaccattcaaatttaaccgaagcttccttagtgatgatttcagtcattttttcaatattcatactcatagtttttaataggggatgcccttctaagtgcgaaaagaacctattaaaacgatttctgaaatcttggaatttctcaggtgtgacgatattattgagcaaatatttcaataagttcaaaccttccatgattgcggtagcatttggtgagagcttcatattcatcgagattatttctcttacgatatttgttaactcctcagtgatatatgatatttgtctagtcaaatcaacttgttcataaccaccaaggatatccatactatctatatcactattcatggaaaacacgtctactctgggacccaagattgaagctaaaaatcttatcgtttccgttttaccggagtttgagggcccaacaagtaccaacggccaattattgttgattgctttcaaaacagattcataaacggcgacattgcactctaatgggaaaagattctgggtaattggatagcggtaatggggatttcttagagctacctcgttgttaatttgaacatagtcttctgtaagtttgaaaaagttctctttagttgagaatttaccaaaaatatcttcaatgagaagctgtgctttattcttatcgctgatagtacggaacctctgcttaacgattatatcaacaaagtcaaacacgtccacatcttcgcaaatcgaatattggttgagtaactttagccaacgcaatgtatctctcaaattgaactcccatggtgaaccagaattaccccaaagttttcttttacagacttgatcctctaaagtagacattaacttaatcattttcgcgatgatatctggctcaatacttggatataagtgttttgcaatcaaaaggagatcatcagatgtaagcatgtcaataaataccacgctaaatcgattaacgaaagatttaggaagacctttcctaccaccaccttgatactgaggattttgagcagcaaagaccagaaaattggggtggcaggaaaacgatatgtccaactcggggatatacgcttcgcctcgatgatctaaacaggcattcaacccttctaggacggattgggaggctaaattcatttcatctaataaaacccactcacctttcttcattgctcttaaaaacggagcatcgtgccataaaaattcaccacttcgctcaccaggagcgtctgcaccgaaaagatctactagatccgtttgttcagacaaattgattcttgtaagcttatttcctgtaatattggcaagagcggtgattaaacttgttttaccaacacctggactaccttcaagtaaaattggcttgtgtacttgcatagcccgtacaacccttactaagtttgaggcagtagtgggggcggttaagttaaaggatgaagactgagcatctggaaatcttggtattttgaacattccgacttgtaattcatcctgagtcacaataatttcgttcgtttcaatttgttgtagttccaaatcgtcaccacatagtttcaatagttgtataatacattctgttctaagtgactttaaatcattttcgttttcagctaagtaagcagtgttatttgtaccaagggcgtcaataaaaaccattgaggcaccttgaattaaggcagttgacttgttctgtattttcggaaacactttattaataaattcaacccatgcaagtatgtcacgtaaagaaatgacaccacttgttgcatttccgcctcccagcttcttgccaaaccattcagagaatttcacaattggattagcaagatctttcaagtcctctaaaagccttgaggatacgatcatgtttacatcgttgaaatcttccatggatggtacccatatttcagtaaatctatttcttaacgctggagataattcttttttaccgtaatctccaccagggttcatggttgcgaagaattgaaagttttctgaagccgttacaaggctatcggatgaaccctgttctgctaacaacaaactcctttctggctccaaaacactatttagtctttcaagaacggaatcatctgctagcgatatttcatcaagtagaaaaaaatttcccgtcctcatagcttgaatcagaggcccgtcactccattcaaataaaacattcaaactatccctcagcttttgtatttccagttgaacatcttcggctatatttttattatctgacttagaatatagctgtaataactctttcaagtctacatcttggtcattagcaatattcaatgctgtttttaaggattttattagcttatattgaatttcagacctgttacgaacaggtctttgagcacctaatatgtctccagtttctgtgttttgatgggcatttagtgtgatcagttctcgacccatgaattgcgccaataattggcaaattgttgttttgccgcacccagtttcacctaccagtagtactggctccttattctttaaacaactagaaactaagacggatagtcggcgcattccttttgtccaagtaacagagccaatggcttctaaggatttatcttccagacttgcataatattggtccatatctaatttaactttcattactttttctaaagtctttttgactgtaactttttcttgtggagttctgcacctttctgcaagaagcatatagccactggcagcaagctgctcatatcccactgcgtcccttaaagcccagcggaaaagatcacgtagagttgcaaaactatttttctgttcgaacaaccttgaagcggaacgttcgatggataattggcggtatacttcaacgattttctttgcatatgatggggcaatttggcagcgctcacgtaggataatttctaattcatcttgcggaatatcgtcgaagtgcaactccagaaaacgattcctaaaagctcttgaaagaattttacggccaccgtatatcccaggtggattctgggtagcaaaaagaaggaaatcaggatgaggatgtacaacttcttgtgtttctggaataaaaagttctctgttatcgtcaagtaacctatttaaggcttctaaaacatcggttggggcaagatttaattcatccaaaacaatccaatatccttttcgtagtgcctcgactaaaacaccttccttaaacgacagctttccggtatcatcggtaacatatgtacctaaatattcctgtaaatctgtatgctcatggttatttatacggacaaacttatggcccgttatatccgcaagatatttgatcatactggtttttcccgatgaagttggaccttgaataagcacaggaaatcttttgcctgatgtagctcttaccaaattcatcatattcttttcaacaaaaggcgtaatgatatagtgagcttgttcttgaattgtattagggccctttttcatccaataatgcttaaactgaacataatctggtcctggagagggaggtgtctgtgacatgattgacttgacattttttagcctccccaatgtgaatttttctattactggcttcagaatggcctcagatttttggtccagtaaagtcaaaaaactcatacagaatccatcatacagggaacggcgtagaccgtagatatgaataatatcagtaacataaagcaatgtacgcgtcagggtacggatactaaagtgtggtttttggtttgagccatcaactatagtattgttatcggagagttttttggcttcaaggtaaagttcagcgatgtcatttcctacccattcatcgctgacgctgtactttccaatatatttatcaattatggaaagcaaatcagtaatatcacgttccggagaatgtacatatatttcggtaaatcttgatctgatacccataggtaagtctcttttaccaacatcagtagcggggttcatacaagcaaatattctaaaatcggggtgagcttttataggctcagcgtcacccttttctgaaagaagaatactacgagaatcaggctcggtgagaaggtcagaaatactttctaaggtatctgcggttgctaaattcacttcatcgagcaatagccactccccagccctgatagtctttaccaaagaaccctcgacaaaattgaagacaaacgagttttcaatagagctagactgggcctcaaacttcttcactgagtcattgaagtcagcccatttgtcaagtaacaattttttttcatgagtattgagtcttcttttcttcttctttgcattttcgttttcattttcagtgtttgtaatttttaatatgctttgagccattttgtacgcttcgttccaaagtttaacaacgttcttccattgattcttgttgaagcacctatgtagcatcttgtgaaacttctcgttcttctttaaggaaaatgtagcattaaaaagagtttcaaaattttcttgtataggaactgcaactgttttagaatttacgggtttgtacccaccaagaagatcaccagtttctgtttgttgtgaaacattgattaccgttaatttttttgctaacatcttagcaagttgttgaacgactgtagttttcccggtacccgtttcaccgactagtaaaacaggttcagtcatctgtatacaaacagaaatctgttccattagtcttaaagaatgattcgtaaatgcgaacaatgtgctgttcattgattttttttgtatatttagcttttccttaagtaatacggctcttccaattttaatgctatcatcaaggttttccaaagtgggcacatgttgggtcaaaaataacgaaatccttgaggaagcaatgtctaatgactcgccgattgcttgtataataggttccaaagctttgaattctccaatagcgccagcgaaacagtcggcggcttcggagaaaatactgtcgtagacagaagactggattagttggtcaggtttgttgatgccattgtttttgaataggatgtctaacctttcgcacagcttaattaaatctcttacagatacaactcttgtgtgtgcccccttgttcaatgaaatgaacttggtgttcatataaatacttttgacgtttttgtatgaatcgattagtttggggataaggttggtcaaaatgggaaacttttgggctaaaatgtgtgtcaaatcctcttcgctaggttcctctaattcaataacattccagattctcataccaatcatattcaagttatagatcttattggaactatccttctgatgatcttcgtttattctaacagttgatattaactggaaaccatttgcagcctttacagtctctcctctggatggaatggttagttcgcgcttttctaaaagcgataaaagtattgataaaacatctgtaggagctttatctatgtcttctataagtacccatctcccttctttgaccgcggtagcgagaacaccagctctccattcaaacgtgcctggcttgtcaccagaggtataagtaccaatcagtaacttggcatcagtttgttcacctaaatgaattttcacaatggagtcatggcaacccatatatttacttagctcattgattaaaaaggttttaccggatcccgcttttccaatgagcattattggagttgaattttgaatctttctcccgagttgacgaagagaggaaaccgttttatgagtagggacaaaggttaatgggtagaatactttgtcgtggatagtgtggaccttagggacgataacgccacagattgacgcgaccttagtactcaaatcctgaggctcaataatgaagtagctagattttttttctatagtgaaacattctggaacactgggtagtttagagaaatttgcacatctcttagcttcgttcagttcgaggaagctgtaatcaattccagaatcgccctcaaaatggcccaacaatgaatcgcgtgattttatataagtgtcgagcatatcgtttaatgttttttctcccatgtctaagtataaagataaaacctttaatgctagaaatataacaacctgattttcttgttctttggtgagtaaatccacaagttggtataaaatgtcgggttgaatgaagcgtgcaaatacttctttattgtgatatagtaacctatagtatgctaatagtattttaaacatgtcggaatccttttgtgtggatggattttgaagaatagtgatgaaatgatcattctctttatctaaatagtcttcaattaatggcattgcaacgggaaatattgtaattatacttgccaacttttcaattacaagaacgtaatctttttttttggagtcctttatccaacgtgccactatctctaaaaaaatatgtttgtaaaggaaaacatgaccagtgatggaacggctatgtagtatagttcctgctaaattgtctaaattctcagaagttgattccttgttgctaaagtggaagggcgcttcaatagcatcagagggaaaagcagaattgaagagaattaacctttggttaactacgtctaaatctaacaaaattctatcctgggacattctcagcagattataacggttttaaaaataatgtgaccgcgtaaagtagaggtaccttaaaataataagagtagaattcgatgtcaaattaactcagaggtactttgaatctttaaaataatcactttggagaggaatgtctaaagtaaagcagtaagtgatataatgttttcttttcataaagctaaatagaccttagctcatcgcttctttaaaatttttcactcgaaaaagaaaaaatacctcgtaaagggcgacaataaatgatgagtagaaaaagaaatggaataacggttcaagtgcatttaaaatcaatgccttgaatatgtgtttcagtatacattcagtttgactatatatcaagagaaagctttagtatgggaagtttgttgagaccggttgatctggtaaatcaaccgcttggattccaagaaagatataaaattttgcagaaattattcaagcagctacaaaaggcatatgcacacacaaaaggaactaatattgaccttgaaagacttgccactcgcttagaagtccatgttgctaaaaacagcttgtctggtcagagttacaagtttaacatgagcattttactgcgggatgtgcttaaatataaaggagatctctcgaagatcaaaattaatgggcgcccccttaaaggagctaagcctcatttatcctcaattggtaatgcaaactctatcactacaaaatcaaaagcgatggaagctttaaaggctctgattttggattcgaaggtcttagagaaaaatgggtatattgttaaggaaatgcaaaataaaactaatgatgacaatagtacgcaactgtatgcaccttgtttgcgttgcagctcaaatttcaaaaaaacagacatcatggaaaagactctatgtaggtatcaccctttgaaaagaatatacaacagagataccaagaaccatcagtatccatgctgtggtgaaactactgattccgtttcttttctaaggctaggatgcaagacgttttttcaccatgtgtttagaggagaatcatatgacgagttatgcaaaatttcgaagttttctagtacagatgacattgatggtgttgagaatgttctttctcttgactgtgaaatggcttttacatcattgggctatgagatgatacgtttaacaattgtggattttttcaccggcaagacactatttgatcatgtaattcagccaataggggatattgtcgatctgaattcagacttcagtggtgtccatgagattgaccgaaccaattgcccgacgtacaaggaggcacttgatgtttttttatccgaaaacttaataaataaaaatagtattcttatagggcacggactagagaacgatctgaacgtcatgaggctatttcataataaggttatagatactgcaatactttattcaagaacaaagtttaaggtttctttgaagaacttagcgtttgaagttttgagtagaaaaatccaaaatggcgagcatgatagttctcaagatgcaatagcaacgatggacgttgttaaagtcaaaataggtatttctccaagtcaaaacaagtgggaaaaataatgtgatcatattcaaagttgagcagacatatatagttattacatttcatacggttcacatgagttttattaagtaattacgttaagaaacaacatgataaaagtaatgatttcgtattgctttcctattttctgtatttaagcgaacaataataatgcaccttttcaatatctgaatattaaaatatcgtgaaattgggttcaggatgtaccaaacttgatgatagctgaagcaccataatcctatttaaagaagtacctgttatccgtcagtaattaccagaacaagttaattttaagtttaatctaaaaaagtattgcatgcggcattaaaagacaacataaaacatctaaacggtaaagtatgatcgataattctccataatagttctgttatttataatctccagcactaataaatgctatacgtatatttgtacacaatataatttcagaatttatattgctaccatgactgtctgagaattgggggaataacttgataattgttgggattccattgttcgtaaacgcaataatattaggtatatagaagatactaaatgttctctccgaggatataggaatgctcacaatggaatcgatatatttctacataatagtattgagattattcctcttttagttttatataattcattatcctattacattatcaatccttgcatttcagcttccattagacttaatgactgtttctcaatttttatgtcatcttcctggacctcatgtgatactataccagtagcatgaatactactgaatcgatgatactttagagtttcattgcaacagtttcaacacagcctggcatgaacagtggtaaaagtatttcgtccactattttcggctactataaataaatgtttttttcgcaactatgtgttcgcgaagtaacccttcgtggacatttggtcaatttgaaacaatacagagatgatcagcagttcccctgcataaggatgaaccgttttacaaagagatttatttcgttttttttttatcatcgagtgaagtatcgtgacttgtacatttgaagatacccagcgtacagcagtgtatctttatcttcctgtatgatatagataactaacatctcgaatagaaaattgtctcgcgttcgaacctaagcctttgctatcggttgaacatagaagaccgcgtgattcattttagtgcgtaagaatgctattagtacttatgtgctttatgaatgtgaatattgttacagctatgcaatggtacgatcatactctgaacgatccatttaaattatatatgtcaaacagaagagaaaggtttttttattgaagatttcacagaaaatcaatcattttgcaatattccttcgtcccagagaaggtttcggcttttacagcaacgagaatgattcttccattatttgtacctagcttccacatggatttcgataagtgtagtttcaaaccatgaacgcaattcaaaactttcaaattggtgcaatccaagaccctccctttacatttggagtcgttaactaatgagaaaatattacagcattttgcgccatttaccgtcaagtcacaaatggagacacatgcaggaataattaagtgggattcaacttgcatttgactgtcacgaagtttgaccttatattcggacagatcaattttaaaatctgggttttccaataaaacatccgagaacttgttttcaaacaacactgcagcctctctggataggtctacatgaacagtcttattctttttgttgaatattattttgcactggttagagtgtaattggaaaataagatcgtgcgaaactgtatcgatataaggcctttggtattttaacatgctccagtgtctttcaatacaatgttttaccttttttgttggaggttcatattcatcattgttgcctgaatcagtctcggttttatgaaatccagtagcggctttttcaccctcagttccattgagacaactgcttaccgctaaagattggtttccggtatgaagtgatgttaacctttcaatggttacacccttcttggagacgctatcaagagctatgcaaacttcttgacaattagttaagggattatatataatttttgcccgcactaattcctgctccaacctgttgagacggtaataacgacactcttttatcagagatgcggttctttcctcagacagttctaatttggaaccgcccagtaaagataatatatctcggaaaaattctggggaccttgcaatatatgagggtggtaataaaggtggaaagcccggcttcttatttgactcccacttctcaatttcctcataagatatgcgagaaatcgtttcaaaatagttcaaccggttcccttcttcatggaataatgattttggtaccttaaagggaacacctccaatattagtgaagtggtagtcgtattcttttatgagtttaactaacttgggtaactgaaaatataatgcgtccgcgaaaagacaggtaaattgtacttcgttcttaatatcgggaaaataaccttgtaaatgtctgtatattatgatgaacacgtcttccgatctatcaacaaatagaatcgtatttttatcgtgcgtattgaagaattgggtgaaaaaattgggcgcatccgaattcaatgtagcacctgagatctcaaatagcttttggccaatcctaatcttgaaaacttcatggtttggtaaaagctcgggggtagtttctaactcttttgtataaaccacgatctcgcccttttggccagacatctgatatgagcgtgcgtgtgagtgactttacacttgtctatccacgtcctgaagttgttcgtgttctttggatattcgtgttcaagctaataatgagcctttaaggtaatacaatttataaaccaccaccttggcctcgatctattgcgcttatgttgtctattagtaatcaagaaaagaaccctaaatcatcggcgtcccctgtggggctctcggaaaaaccggtcctgacgtcactgaaaagatttcggcacatggtcatgggaccagagaaaaattaatccgacatgtggaatatttccttccgttaaggtagtgagcgcggattttttctgatttgtaattatacggggagctctggccaaaaaggtcagtatttggtgatgaagttgaatatcatcttttgattttcttctgtatcattctttttctttttccacaccccttccggacggtattcacatattgttgagaggttaaatgaaaaataaaggggtggaaaattaaggacgagatgtaagggaaaagcataaacgaaacattatataaaggagcacaatttcctctcccttgccaattgtgcatataccgtttctttataacgaaatttcaacaaaccagaacaacacaagtactaccaataaccacaacaaaacatgtctgacttagttaacaagaaattcccagctggcgactacaaattccaatacattgctatcagccaaagtgatgctgacagtgaatcttgtaagatgccacaaacagttgaatggtccaaattaatttctgaaaacaagaaggttatcattaccggtgctccagctgctttctccccaacctgtactgtcagccatattccaggttacatcaactacttggatgaattagttaaggaaaaggaagttgaccaagtgatcgttgttactgttgacaacccgttcgctaaccaagcgtgggctaagagtttaggtgttaaggacaccacacacatcaagtttgcctccgacccaggctgtgctttcaccaaatccattggtttcgaattagccgtcggtgacggtgtttactggagtggtagatgggccatggttgttgaaaacggtatcgttacttacgctgccaaggaaaccaacccaggtaccgatgtgaccgtttcctcagtcgaaagtgtcttggctcatttgtagatgctatgtaatagacaataaaaccatgtttatataaaaaaaattcaaaatagaaaacgattctgtacaaggagtattttttttttgttctagtgtgtttatattatccttggctaagaggcactgcgtatacttcaaggtacccctgtgttttgaaaaaaaacaacagtaaaataggaactccgcgaggttcaggaacctgaaacaaaatcaataaaaacattatatgcgtttcgaacaaaattaaagaaaaagaataaatatagattaaaaaaaaaaagaagaaattaaaagaatttctactaaatcccaattgttatatatttgttaaatgccaaaaaagtttataaaaaatttagaatgtataaataataataaactaagtttacaacaacaaagcagcggcaccagccaacaaagcaccagcagctggcaaagccttagcagcagcaccagtgtaagaggtgacagagtgagttggagcagcagaggtggtgttctttggagcttcagtagaggtaactggagcagcagtagaagtaccgttctttggggcttcagtggtcaatgggcaccaggtggtgtattgagtgataacgtcatcgacggtgacggtagcggtggaaaccaaagctggggagacagtttcagaacagacgtggtcttcacaagaagtgatggtgaccaaagtggtagattcttggctgacagtagcagtggtaacgttagcagcggcagaagcgacagcggcgacagcggcgatagaagcgacagtagaaaattgcattattgatatagtgtttaagcgaatgacagaagattaatttcttggtatgttaggaaagaataaaggagaataagaataattagaacaatgtaggatggaaagaaagattatcaagcatgccgactttatatacttgaacggaggcaaaggatgcaaaattttctcacatttctttctgccgttatgttggaagtaagactcccattatcgcaatactgcaacacgaatatgcaaaatttgctgagttatcgcagatagttgttgcaaagatagcggcgtaggtggccgcgaaatggggaattccaaaacaaacggtttttttactcctgagaaatacttgtacgggataatccagggcctaccacccacgcttcgaggattggcttttatttttttttttttggtggcgttttatttctttcccgctttctgggacttgtgcggagttttgagaggggcgcgcggcaaaggattcccaaaacggaaatcagacgccaatagccagcactcaaagcagttctggacccattccgattttcccatttggttcttgcgcgtgctgattccgacacgcgcgtctataaatagcatgaagtatccgcacaccgcagcgttagtgaggtgagggtggcagcaagctaattcccgcatctggaatctgaactgccccttttggactaaccgtgtggttcatgggtgggcgaagtgcgcaacctcgaaggttttcttttgcgtgtcggattttacatccggcggtagcgcatgatgccatggctggctccagatacatcctcagggcaccagcatctataattagattggcgcaacatggctggctgcactgctgtcttcacttctttctttttccggcaatgaatgatgtatgttttgtggcaaaagggtccgcattgtacctgtttacagttgagattatcgtttttggtagcccttcattacggcataacgtattaagtttcttttattttgctttgccctggtttaaaagacaatgtcgattaaaagttaattttaatcgattgaaggaaataagaggaatagcgcaagttgttaggaaagcgttctttatctccaagactttgccctgtatataattaaacacctcaaagcgcttcgtcatggatggagattattcggcattttgacatacaggagtgccacatgcgaaagcggagtgggcgtattctctggttaccctacatggtctggcggcgttattatacgggaggatcttcgaagggaaggaaggaaaaaaaaaaagaaaaggccaacgaaaagcaaatattatctatcgtcgaaattatcatactatcttacaataagagtagtaattactttcttgtttgtatagtggaagaggaatttgcgataataatagcaaaagtaactaatctctaacaagaaaccttatttattttctctttcttctatattggtaaatactagactcgaaaaaaaggaacaaagggaaaacagggaaaactacaactatcgtatataataatgaccactaacgaggaattcattaggacacagatattcggtacagttttcgagatcacaaatagatacaatgatttaaaccccgttgggatgggggcatttgggttggtttgctcagccacggacactttgacatctcagccagttgccattaagaaaatcatgaaacctttttccactgcagtgctggccaaaaggacatatcgtgaactaaaactactaaaacatctaagacacgagaacttgatttgccttcaggacatatttctttctccattggaagatatatattttgtcacggaattacaaggaacagatttacatagactcttgcaaacaagacccttggaaaagcaatttgttcagtatttcctataccaaattctaaggggtttaaaatacgttcactccgcgggcgtcattcatagagatttgaaaccgagcaacattctgattaatgaaaactgtgatttgaagatttgcgatttcggtctagcaagaattcaagaccctcaaatgacaggctatgtttccactagatactacagggcacctgaaatcatgctaacgtggcaaaaatatgacgtcgaggtcgacatttggtccgctggttgtatttttgccgaaatgattgaaggtaagcctttgttccctgggaaagatcatgttcaccaattttcgatcatcactgacttgttgggatctccgccaaaggatgtgataaatactatttgttccgaaaatactctaaaatttgttacttcgttaccacacagagatccaattccattttctgaaagatttaaaacagtcgaacctgatgccgtagaccttttggaaaaaatgctggtttttgatcctaagaagagaatcactgcggcggatgccttggctcatccttattcggctccttaccacgatccaacggatgaaccagtagccgatgccaagttcgattggcactttaatgacgctgatctgcctgtcgatacctggcgtgttatgatgtactcagaaatcctagacttccataagattggtggcagtgatggacagattgatatatctgccacgtttgatgaccaagttgctgcagccaccgctgccgcggcgcaggcacaggctcaggctcaggctcaagttcagttaaacatggctgcgcattcgcataatggcgctggcactactggaaatgatcactcagatatagctggtggaaacaaagtcagcgatcatgtagctgcaaatgacaccattacggactacggtaaccaggccatacagtacgctaatgagttccaacagtaaacgtgtttttttaatgtccctaaccactcattcttacttctttttgatgtttcttttttttatggtactcataaaagtatttacgtatatagttgtatagaggaaacaaaaaaaaaaagataaaactcaattacaaagtaaagtggacgtatttcgatcatgatttttttctgttttaaccgcattggattttcttgtaaaactggaagaaaaaggaaactaaaaagtcaagaaagacctttttaagactccaagaaccgtcacttatggcgtattgtttgtttatcagcacttctatcttcgataaaggtttgtctgtcttatattgtttacatttcaagtctaattctgtgcttttaccgaagaggaattttcataaatacggagaaaatataaaaaaaaagtaaatacagaaaatagaacagttgaagcagaaaaagagaacttgctaaatagctgtctcacccagacaagcgtatacttaccacatttagtcttttgcaatctcattcttgttgaagataactattacattcacggactgtggcagaaacttctccttaagaaattaggaactcataaaaggaatcagcagctctatgtaatatcaaaatcttttctattttttgtatttatgctctcattcattaattctaacggagctatttattataaacagtgaagatataaaccatatgtctaatagaacaaatttcaaaaagtcttcaatttcgtggatgtgggaatgcatttattaaaaataatgaatggcaacatacgacaccaaaataggaacactttcagtactatacagaactacggatcttagtttattgagttttgagaaataggttgatatggagacaatttcttagcgttattagaggttataagtatacagaataacctacgagtagtcctcaagaagataagactctgcaaaaggtatcaataattttacttaatcatagcactatttcttctttcgctttgtacagcagctcatatattccattacattatcaattcttacatcgtagcataaaacactaagattcaaaaatagaaaactgttgtatctcaaaatgagatacgtcagtatgacaatacgtcatcctaaacgttcataaaacacatatgaaacaaccttataacaaaacgaacaacatgagacaaaacccgtccttccctagctgaactacccaaaagtataaatgcctgaacaattagtttagatccgagattccgcgcttccaccacttagtatgattcatattttatataatatataagataagtaacatccgtgagttaatctgataaaccgttttgacaactggtaacttccctaagactgtttatattaggattgtcaagacactccggtattactcgagcccgtaataaaacaaaaacaataaatcttgttcctcgtggcccaatggtcacggcgtctggctacgaaccagaagattccaggttcaagtcctggcggggaagatttttttgctccgacaattatgtcgctacccttcagttttgttgaaaatgatgcttttatcgttaactttacttatctttattgtttgcaagattactattaatattaaagagggtctagcaaggatactgcgattgtttctaaatatttcaactttctacgttattcatctttaggaagctaaaaagcattcaaaagattactatgaagttaatctttaaacatagtttgatgagcgtctatgcaaatagaataacttcaaaaaattttctattccatttttggaaagccccaaaaagctatattctataatttctgaatcttattgtgcttgtggaggtcaccccagttttctataaattattattcagctattatcccaatacgactaaaggtattgagattcacggatattttttcccctgcaactttcacaactggagggctctgtttcttgattttctttttgtcatataaacatatcttagcgcgattgctaacaaatagtatagatatcataatttttcctcatcctgcacacaattacctatagcagcgtcattcgcaccgccctcctcattggattttttaactgtatttctcgttttagatgagtcttcaacatttctatcgttttcataaatatcagttttactgtcggaatttttattgctctcaggaccaccttcaatatctttatctgcaacggtttcgtcctcattaaaattttctgcattaccctcaaaattctgttcattttctttatcatgatcagtgttaatgttcgtaacgtctgtaaaaccattgctaaaatcttgactgtcttccttatcgccattttcatcgccctcaccgtcatcgccattttcatcgccctcaccgtcatcgccattttcatcgccctcaccgtcatcgtcatcgtcatcgtcctcactatcatcgtcatcaccaccatcatcatcatcatcctcagagtcctcatcagtatcatcatcttcattgtcctcactatttcccacctcttcactttgttgatctgtctccgcatcaggtttataatgtaaacccaagcccatcatagctttctgtatcgcgttcgatgttttacttctgtttttgagatcttctgtggattcagtaacatcttcattagcagtattctttggtttattgaaatattccttccatgaattccataagttggctgctggcttgtctgtattctttccaggatttacagaaatttgggaaacagacttttttgactcgatgctttcctggtctttgatatcctcctcgctttgatgaccatttttattgcttgaagagttgctagagcttctttttaaattatgaaatgtggccaaaaatcgttgctgtaatagagacagagtgtcggcaccgttatatatatgcttcggaggaaacaagtcgaacaatctatcatctgttcttgagttgaatatcagaaaattttgagtctctttccaactctgaacccaattcaaattgaataaatgaacgggattggaatttagcatatcctcaggtatagtcttcaaagcttgatcattctctttatgcaggtccaaataatcacttaatttaacactggaaagtaaccccgttaaatagtcctcgaattgccacctaatgaaatcctcactgccttcaaattgagagttttttggagtttcatcatcattttcgttccatgtgtctgatacaattccagatatagattcaatccattttttatcatgacttgacaattggaggacggggttcaaagtcttgtccagaatatctacagtggaattgtctgtattgacaaatatgtggcacagttcctccttttgttcagcaagcaatgtgttggaacttccaatcataaaaaacaaagtacgttctgaccgtatgtcattcatttgctgcagtggagtatagggtgaaaatagtccacctttttcgaaaatcggtaatggaaaacctaagaatctcaacactgattctcgattgcttgatttaaacgagtccacaacatttaatttcgaaatatcctgaaacaactgaggactgccagaatcctgcaaatttgacatcaagtccggaattaagctgatcagaccgaactgtaaattacacaaagcttccacgtcgttgccgtaaactataatttttttttcaagcataattgctttcaataagactaaagcgtttctcttaaaatcatgtagtatctttctcagacataacccaatataaagacgattttcggcatttctgaccaatgatgcaggcgtgtaaatcgacttcaggttttcgtataaagactggattatcttcctgtccccaaaatcatgctgcaagaaaaaagcattagtcacaatactaagtttgtccttgatttgaccgaagattggttgccttgagatgactacaattgccttctgtacagtagatcgtgttacatccttatctttagtgaccaattcatcactctttatctgtctcgagcaagatatggcaaacaaagtcgtgttgtcattgatgctatcatcactcagatcagttgccccgttgggagggctcctttgtcttctttcatcatatagtaatgtgaaataagtaaatgtttcttcaaacgagtgagaaccatcaggaagggcctggaagggtaaatttggccatagttctgcactttgggtgccctcaggtaagccataccagtattctatttcagggcctcttttgtgatgaaagtccacaaggcagataccgaagatgactgcttcctcgtgttcatccattattttgacaacaaggttgcagcgaggcagaatgtatatgttagtttgatatggtcttcctgcttggattcctttaaggcttcaaaattttcttgaaaaggaaacttcgtgaatgagctgtaaggatgcttgatcgggccgtacattcttatgcaagatccattattgactgctctctgttgggttagcttccatatcttccgttacccgttcgtataatcattacccgacggacaagcatcatttcagcggctatttttgctaggcaaacctcctaagcaatgatacttctcaaacgttcaatggaagtaatagaagttcaacttaccccattaataatccacacattagaaggttgggacaataaaaataaaaagcattaattagtgtaaactttgctcccaaatgcaagtctaaggtaagttctttggttcatggagtttttgcagtgtaatctcacgtgcactagactgagtaaagcgaacctgagttcaagaaataatgattcacctatgacatatagtccaactatacaagcaatgaacccttacggattgaagtcattcaatgttcaatgtttgttgtaataagaaatattactagaaaaagattttttctttcggcggcgttttcccgcttttcttaaacaatctgcagttttaacatcgaattcacgaatatttgttcgctaaagaaataacacagaagatgaaatgaagaacatacattgagggcgacgaatatatatgacttataaatacaattgctgtgatgatggatcaggaaccaccgttggttcagtggtacgatttgataacgtcaccttgttaatcgatcccggttggaatccatctaaagtatcgtatgagcaatgcatcaagtactgggaaaaagtgataccggaaattgatgtaataatactatcacaaccaacaattgaatgtttaggtgctcattcccttctgtactataattttacctcgcatttcatatccagaattcaagtttacgcaactcttcctgttatcaacttagggagagtttccaccatagattcatatgcatctgcaggtgttataggtccatatgacacaaataaactcgatcttgaagatattgagatatcttttgatcatattgtacctttgaagtactcgcaattggtagatctacgatcaagatacgatggattgactttactggcgtacaatgctggtgtgtgtccaggtggttctatttggtgcattagcacatactcagagaaattggtttatgcaaagcgatggaaccacactagagataacatactaaatgctgcttctatattggacgccactggtaagcccttatcaactttgatgaggccctctgcaataattactactttggacaggtttggctcctctcaaccgtttaaaaaacgttcaaaaatctttaaagatacattaaagaaaggtttgagttcggatgggtccgttataataccggtagatatgagtggcaaatttctggacctgttcacacaagttcatgagttattatttgaaagcacaaagatcaatgcgcacacacaagtacctgtacttattctgtcttacgcgagaggaagaactctaacatatgccaaatcaatgctcgagtggctgtccccttcactacttaagacatgggaaaacagaaataatacttctccatttgaaattggatcacggatcaaaatcatcgcaccaaacgaattgagtaaatatcctggttcaaagatttgcttcgtatctgaggtaggagctttgattaatgaagtgataattaaagttggtaattctgagaagacaaccttgattttgaccaagccgagctttgaatgtgcgtcgtctttagacaagatactagaaattgttgaacaagatgaaagaaattggaaaacatttcctgaagatggtaaatcattcctctgcgataattacatttcaatagacaccataaaagaagaacccttgagtaaagaggaaacagaggcgtttaaagtacagcttaaagaaaagaaaagggacagaaataagaaaattctactggtgaaaagagagtctaagaaactggctaacggcaacgcaatcatagatgataccaacggagagagggcaatgagaaatcaagacattttagtggaaaacgtcaatggagtaccaccgattgatcatattatggggggtgacgaagatgatgatgaagaggaagaaaacgacaatttgttgaatttactcaaggataactctgagaaatcagcagcgaaaaaaaatacggaagttcctgtagacattataattcaaccaagtgccgcttcaaaacataaaatgttcccatttaaccccgctaaaatcaagaaagatgattatggtactgttgtagattttacgatgtttttacctgatgattctgacaatgttaatcaaaatagcaggaaaagacctctcaaagacggtgctaaaaccacgagccctgtaaacgaagaagataacaaaaatgaagaagaagatggttataatatgagtgatccaattagcaaaaggagcaaacaccgtgcttctcgttactcgggattttctggaaccggagaagcagaaaattttgataaccttgactatttaaagatagacaaaacgctctccaaaagaacaatctcaactgtaaatgtccaattgaaatgctccgtagtaatcctaaatttacagagtttagttgatcaaaggtctgcatctattatatggccatcgctaaaatctagaaaaatagttctttccgcccccaaacagattcaaaatgaagaaattacggcaaaacttatcaagaaaaatattgaagtggtcaacatgccattaaataagatagtggaattcagtacaacaataaagaccctggatatctccattgactccaacctcgataaccttttgaaatggcaacgtatcagtgatagttatacagttgccactgtcgttggcaggctggttaaggagagcctaccgcaagtgaacaatcatcaaaaaacagcgtcaaggagtaaactagtcttgaaaccattacacggttcatctaggagccataaaacaggtgcgttgtcaatcggtgacgttaggttagcacaattaaagaaacttctcacagagaaaaactacattgcagaatttaaaggggaaggtacacttgtcataaatgaaaaagtagcagtccgcaaaatcaatgatgcagaaactattatcgatggtacgccttccgaactttttgatactgtcaaaaaattggttacggatatgttagcaaaaatctagccttcttgtatacagcacaaataaaaggttcaatttacgttcgtggactgcccacaaaacagtatgtgacataaattgctgtgtatctcgcaccgctattatctgtatataacattctaactcacttttaacgatattagcattattgatttctttctttttctgctgaatttcaccaagcggaaattttcaaagcagaattttttccctaatttgctacaagtgctattctatcccacaataaaaggaaattgttgatgagttttagaaggattaactctagatactttgaaaatagaaaaggaagcagtatggaagaaaaaaaagcaaaggttcctccaaacgtcaacctttcgttatggagaaagaacacggtagaaagcgatgtccatcgattcaattctcttccatcaaaaattagtggggccctaactagggaacaaatatactcctatcaagtcatgtttaggattcaagaaattaccatcaaactgcgtacgaacgattttgtgcccccctccaggaaaaataggtcaccttctccgccaccagtttatgatgcccaaggtaaaagaacgaatacccgtgagcagaggtatagaaagaaactagaggatgaacgtattaaacttgttgagatagccctaaagaccatcccttacttcgttcctccggatgattacaagagacctaccaaatttcaggacaagtattatatcccggtggatcagtatcctgatgtcaattttgttggtttattattaggtcctcgtggacgtacgttaagaaagctgcaagaagattcgaattgtaagattgcaattagaggaagaggttcagtcaaagaaggtaagaatgcaagtgacttacctccaggcgccatgaactttgaggaccccttgcactgtttaattatcgcagactcggaagacaagatccaaaaaggtataaaagtttgtcaaaacattgttatcaaagcggtgacatctccggaaggccagaatgacttgaaacgaggacaactgagagaattggcggaacttaatggtactttaagagaagataacaggccctgtccaatctgtggtttaaaagatcataaaaggtacgattgtccaaacagaaaaatcccaaatatacagggcattgtttgcaaaatatgtggacaaactggacatttcagtagagactgtaactcatcgtctcaaagaatgagccgttttgacagaaacgccacggtaaataattctgcgccaatacagagcaatgacgtacactataatagcaatactcatccaattcaagcaccaaaaagatctcgttatgacaataactcgacggaacctcctttaaaatttccggcttcttcacgttatgcaccatcaccttcacctcctgcgtcacatatttcgaggcaagctcaaaacgtgacgcctacaccccctcccggcctaacatcaagtagctttagttccggagttccaggaatcgcccctcccccattacaaagccctccagagtcggaacaaccgaaattttcgctacctccacctcccggtatgactacggtacaatcctcaattgcacctcctcctggcctaagcggtcctccagggttttctaataacatgggcaatgacattaacaaacctacacctccgggactgcaagggcctcccggattataatacactcccattatacaatatctgcatttttttttatttgtgttgaaggtatgtagtctctattttgcatagttcctttttttgttggttttttgccttcctggttattattaacttttgatatttaatttacttactagcttattctactactgtttagtttctacggcctgaactacaatgacaaaaatattatttcacgatacccttacctttattcaaagtgcctgttcctgtttccattttttggctagttccaagaactttgatggttttggcttgtcatcatcgatatcatcaggaaaaatgtaatccacgaattcttcttccacaccgttctgtaacctcacttttttgattactttagggaatcttttcttgacggtttcttgatcgagttcagtaccgtaagtttcttcatagtcttttagcgcttccaaaatagacagtctcccttgtttatcatccttctccttgaaaaaaactatcgcctcttcaaaaacttttcttgcctccaatttattctcatcggtaatttcaaactctatgtcttcatccacattttcgctttgcagttttgctaaatctaatagttgttgctccgtcggggttgaagtttgatacatggcgaattcgatccagctttggggggaatattggttgagctccaaatatcttctataaagcttccttgccttttcaaattcttgtgattctgtctcaaatgttatgtatttttgaagtaatacaattttagcctcctttgttaagaaatcagaattttcatctagtgcaattgtatatatacctcttactctatcccaatctcctaaattttcttctagttctccatattgtgaccaaatttgtagatcagagggctgaaattcaataaatttctcatatatttttctcacacgatcaaattccttcaacttcacttccaactcgatatatcctttgaaagttttagccttaggacataaaccgattgctttacccaaaatttttctcgccttcggtacatcatcatgtcgtatcagaaatttagcatacattagccatattttggaaaaagtgaaatgtttatgagggatgatgtcgtcaattaacctctgaaaaagttcttcttctaaaagcgaattttccaattctaactcaacatagcatatatatctcatccacagataaatataccttttccactgaacattttttgatagttcttttggtcggctgtccacaatagctttctcgaaagtttgcattatttgtttggggaaactttctgaaatgagatccaagtacagccaccaggtgtcataatcataggcgttattactcaatattgtttcatactccattttccttttatagctaatagtttcttctattgagtttatgtcaccaaactgcttttcaaaatccaacagtcctgccttgagcaattgattggagggccatttttctatagcaatttgataaagagcactagatctttcgtattcttgctgcgcagcttcccaatgagcaaatgaatttactaattttgcaacctccatatcagaccaaatctgtaaattttggaggttagctactgtgtctatcgctaaagaatacacacttctcgtaaattcagtattaccatgtctattttcaaacctcacccactttagccatgtctgcatttgcgggtgagccatgacgtattttgagtaaatctctcttacaccgttccagtttttctgtcttatttcaaaatccacgaaagaattccatgcattaacccctggctccaaggagcaccatttggtgtacagtgatcgtacaatttcaacgttgtttaacgactcttcgacaatgagatacttgtaccataacttgtctactctgggcaacgtactaatagctctgttcataagattcctagcatggttaatacatttgactttcagctcagcatcaatgtatcgtatccaaagggggatgaatgaactatctactaataatgctctttcaaagatagatctggcgcgcctcatgtcgtgttgttcgatttcgaattgcgcataacgaatccattgtcccatatccagtcggtttctcttcaaataaccctcatattctgttctcttccttcgttgatactctcgaagttcctccaagtctaatatatcaatattagtcgatcctcttgctttttgccccttcttgtacacatcccgcagaatctgctccgcagaaacatgcgtatcaacggctgttggctctaaagtgtccatgctggcaatagtagagtacttttagctcaagtttgtctatctattatgaacttgcataatcaatgagtctcatcaccccaactatttggcaccaaggtttttaattttctatcgcgtcttacggatgtatataaattatttaaccaagtataatagcggttaaattgaactcgcaatattaggaaaagagctatgatgataagctcttcttgataaatgaagccaagtcttctaattcatctggaactgtagaatgggccatacctttgtatactttaaattcataattttgtatctcacagctatcttgatagaactgttttgcctttatacctagtccaataggaactactggatccatgtcaccatgcccatgaaaaattggtgtctttacattaatgccattcttatgttgtttcagaattcctgggatggaacaaaatcccgacagagctactataccaccgattttccatggtaaagtaactgatgttgcgagagctaatgcggcaccctgagagaaacctccgataataatctgctccggtttaattcctttatcaatttcttgcttaaccgtcttttctatggaattcaaagaattcataaaaccgtcactgtcaactttggaaaaactaggatcccattccaagatgtcaaaccaagcaggcatcaatgcaccgccgtttgctgtcacatgaagctctggagcattaggaaaaacaaaattagtatgctggaaagcggcagggtctctctgttgtaaatactgagctaaaaatccccatcccgaacctgtatcacctaatccatgcaagaatatgatagtttggcgtgctggctgaatttttgctgcaactctaagtccattcatattcgatagcgctcaaatgggcaaatatagtgtatgtgttcttattttcgttctcttttgctaacatttttatttcatacagaagccatttttccctagaataggcgttctgaaaagaaggaaatatgaaagtaaaggctacaaaactaaggataaaacaacgaaggaaaaataaggggctcaatataagcagattagatattatcagagcagaaatggatgtggtaccatctccgggtttaccagaaaaagtaaacgaaaaaagcaaaaatattcccttacctgaaggaattaaccttttatcatcaaaggagataatcgatctaattcaaacccacagacaccaattagagttatacgtcacaaaattcaatcccttaacggactttgctggaaagattcatgcattcagagatcaatttaaacaattggaagaaaattttgaagatttacatgagcaaaaagataaggtccaagccttattagaaaactgtaggattttagaatccaaatatgtagctagctggcaagattaccattccgaattttcaaaaaaatatggtgacatagcattaaaaaagaaattagaacaaaacacaaagaaacttgatgaggagagttcacagctagaaactaccacaaggtccattgactcagccgatgacctggatcagttcatcaaaaattatctggacatacgaacacaatatcacttgaggagagagaaactggcgacctgggataaacaaggtaatttgaaatactagttcagcagctaccgccattatcaatatgtacgtatatagactatactttatagattattctagatgccaaacgaattattagaatattaaagcctttgattataggccatatcccaggtaaatagtatactaggaatgagaaaaaaaaatgtgaataaatggtaacctattcttagtgggtaagataaactattgtgaagtaaaaatgaagaccgccaacgtaacaataaaaaattaataataaaaaaaaactttgcccaagcgagagcaacgatttccgccagaaactccaactggcttggagatgtgaatgtctaaactttgtgcaacggttttcagatgaatgcaaaaagaagagaaattaatgtgaggggtaaagatggaactatatgatcaccaacatttcttttacttgatgtagaagtggcggatgcagtactggtcgtcaggttaccgctaaaggaagcagtttgtgaggaatttacagtaaatatgttaccaccggtaacaatagatgcacttgtggaccaagtgtttgtatagcctggtgcctttacggcgcttggaacagaggatgtaataatttcgatattttcgcttgtggtattatagcgagcttgtgccatggatatttcaagattctccaaatcataaaccacgtacgcgttagtcaaaaatgaatcacccaaaatggtacctgtgtcatcactcgttgggataatacctaaaagacatgtagtgccagtactcaagataaaactcgaaagtggtgcattgatgtgaaaaccaccaaaatcgaacactatttccatactatcatcagatggacagtccaatacgtaataccctatcctggaagagtattgcgcacctagttcagtagcgatcatacttaccactgtttgaggtaaataagtcaaagtagtaccggaatccaacaaagcaggtattttagtggtagtcaaggtcttgttactactcccagaatcactaataccgataccattaatagtgacatcaaattgaatgggagagctaaatccactagcactcagagtgtttacgatggggattgtgtataaggtgccggtatatttactgtggtccacggctccgaacaaaatggtgccatgcatagcgtccgagtcgttcaaatacaaagaatatgtgttgcttttgatagcaccagaatttttcaatacaatggggaagttgtcgtatttataagcttttccactatgagacgcagtagagccagaataagtgacttctaattcgggcaaaccaatacctaacacacccatagtagaattcgtttcattggcaacggcaaaagacaacccggtaacgttcaagtcgcttaaatccaaaacatccgtaccaaaagtaccggaggcaaaagtcccatcaccgtagctaatactgaaataggtgttgtttgatctaaatgtagaagagcccgaagtggaaaatgtcccgtattgttgacagtccatggtggcttccgaagcaggcacggattgagttgccgtacctgaaccgcctcctaagcccgtagcagtggggccaatggcactgcccgttcccgtcaaccagccaaatgggtttatatcattaatcaaagatccgccgcttgacgaatcatcacgtttgtcaataacacgtctccggctactacccatactgttcgaagaacagtatggattatccgagcccataatccatagatcagaggagcctgtgtccaccaggaccgttacgttctgtggtggcgtgcccacttccaagtccaccgaatagaaactttgctggttggtaattataatttcttcataaccgtcagccctcttcaataggcgtacttccggttttttgtcgcttcccacattttctagcgagtccccgtaaagcttatgaaagggcaacttgacgaacttggaattcgagtcgtcgtcgcgcttgtttgctgctggtattatcttaccgagaacctgcgatgcaaagagtgacgaaaggaccgcagatcttacagttttcagtttcatatgtggtaggtaatattatactatatgcttggtgttcaccttatctttttattacgctatgtattttaatatacagaaaagccaattgcgttcttcttaataaccgtccaattgcggaaataggaacaaatgcaaaaagaaggaaaaaagtaaatcctctttgacacccttttcttaagtagtcggatttccctgtttctccataaataagtccacgaatttttttatgaaacctcaattttttcggacacatcagtgaaacgaaaactactcatggcgcagtataaaaggagcgaaaagccactcagttgagtggacgagggaggtgaggtggtgacagaaaagaggaggaaggaggcagtgctatgtgagggtgtcttggctgcatgcaaggtctgacgatctaattgacgcgtcagaacgtgtgttttaggaatattcttatttaagtatgcttttcctcttgaaatcgcgcaaagaaggaaaggaaaaagtgtctatatatagtgtctattgtttttttttacgaaaagaaaacggaaaggatgagtaaggaggggactagcagtaaacccaaggtagagcgtatactggaagcggagttggtagcagccctctggagtgccctcttgcttttatgagtcgactttgcagtagtggtagagtttgtcttcttggtggtggttgacctcgtagtggtggcagtactggtgccattgaaagtgcgcacggtggtaaaaatattaccaccggacgtggcggaggcgtagttagaccaagtgttgttgtaactgggggcccttattgcactgggaacggtagatttgatgacttcgacgttctctttccccgtgccatacttggcttgagctagggaaatctcgtagttatccaaatcgtagaccacgtaggcgtttctcaagaaggaatcaccaaggatagcggtggcgttgcccgcttgtggaattattgccaagacacaggtccccacactggtctgcatagtaaagtcggatagaggagcgttgatacggaagccaccgaagtcgaaggccacgctggttttgttgtcgctcgagggacacgtgtactcataataacccaatgtcttggaatacgaggcattcaagctctttgctagcaaagccactgcctgggagggcagatatgttagcgttgtgcctgaatcgagtagggctgggagcttggtggtggtcaatgtgatgttgcgcttgtcggtttgcagtcctaagccctgtaaagtgacatcgaacgccaccgggtgctgataaccctgcgacttataaagattaaccaacgggatagtgtacagttggccctcgtacttgctgtgatctacagcgccgaagaggatgctgccggaggactgtgactcgtcatttaggaaaagagagtatgcggttgcatcgatggctccagaatgttttaggaacaggggaaagttatcatactcgtagcttctcttgtccataatagcgacttttccagaataggtgacttcaagcgtggaaaggccgatcccgagcacaccaaaggttgagttagattcgttggccacggcaaacgatagaccactgaggtctaattcgttgtactttaatttatcttgaccaaatgcaccttctgcataggttccgtcaccgtaagcggcataaaaaggcgaggacttgttggctttgaacgtggacgacttggtcttgtcgaacacgccatactggtcacagtccatcacagaaccgcagtaggggtttcccttgccaggaacccataagtcagctgagcctgtgtctaacagcacagtgaggttttgtgaaggtgtaccaatggctagctcaacagaataaaagctttgctcgttagctagtacaaatttttcatggccgttcgatctcttgctgagttcaccattgtcgccgttctttttttttgtgaagggaatcttgacgtatttcccatcgggaagtactctaccgaatgccggactagttaagactgctaatgtagccactgccgccaattgaagtttcatttttcaatgccgagtaattttgctctatttatcctatataaattcacaaacacacaagttagcggctacagatattcatatataatatatatacgtacatatatatattattatggcgtccagccttcgaccacacaagtttccttttgaggcttatagttctaagttcttcgctatttttaatttcttttccgcgaatagtaatccgatcgccaataatttctactacaaaggaagcgcgaaaaaaataagagatattttcgctatttcttttgcctgtacatggcccggccccaaatatccgattctcgtttctgtgccggattccactaccacgagactcagagccctataagccaggaggccaaaaagcaatctccattaccaacaatatcgcggtagtgaagatttgtatgtatattgaatgccaagacaaaatggtggccaattctgccattccgtcataagggatattgaattttgcttatttcatcaccccacgccattgttttgtcccgcccggaaaaactctgccaaaaaaagagtacatttctggcccatctccgcactaattcccctttcctttaaaatacgctgcttataggcgtcgaatggagaaaaggtagtgagtgattcctcaccctccactcagacgtttctgatatacaattggggaaaggggttcacacacagcaagccggtatgttacaattgtatttagataagtttttcgtttgaatgcgttgaaaattacttgcgctagcttcagctgatgtgccatgtaacgccgttctatccacgctaacttcaatagacttcaatagaaagcaaatagttatataatttttcatggacggtccagagaatgccacaaaagtgcggccatagaatgaagactgtatgaaagagcgccattgtccccacgtgtaactggggcgaagggcaggaattctgagagcaaactttgcttccagcattatgtaaaaaatcgaagcgcacaatcggacgcaaacatctgtgtagacgtagagaaacatgcagttttgatatagacgattcatgttgatgacgagcaaggcaatttcgagatttgactactgaagaatttctgtttaggagccgcttttgcattatcattgccctattacgagcccagttaatgttggttcgcctagtcttgggattgggatatagggttaggacgagtcgatcttagtggtacaaaggaacctctcatcatcctgagtccattgtctgcgttttttcttgaagctgaatataatgttgtaatttgctcgttctagcaacttcagcgaagccagtcttctaatgactccgctgttcccagaaagtgtgagcacttacatatatgaatacagcactatctggagaagtggcgcgctcttaattaaaatgatgcagcgtgttatcacatcttgcgttaccgggccttgcaaaaattgctatgtttttcttgtgcttggtattgcttcgtggagatatatattctcatatcaggacggaattttacaaagtgagaactctaaatggtgtagtaaagagaagaaaaaaaaatgctcagcgatttaccctcattacaaccaccgagattcactaggaaacggagctgtccctcggaatttattgtcaacatatcatccaatgttaatgtagaatgagttaccgtctgttacttttgggacggtttttgcactaagaacagacgagtttacggttatcctcaacaagcaagcaagtatttgctaatctagatgccattccgaatcattactcatacgttactattgagagatgttttacaatagatgagaagaatacaatgtccagagctcctggtatgctagagtgcatattccaggtcttattcgaatcatatcataccgtccatttcaacaatggtgaaatgtggtccacatatatcagaaatcttaacatttagtgaggagagccagtagaaaaatgtgcgcaagcggaaagaagtcattcacagacacgtttaacaaaacaccaccacagcagctttgtctcttgattctgatcagtttgccatcgaagaagcaaaattgtggtgttatttttttcaaacaaaacttttttggcaacagcagttttcttctggatatttgtactttatcatccaaccgatgaaagctggtttcctgtcaacctacatttaaatggcccgtacttcttcaaaaccgctagataagcaaattaacccaacttttgagcgtcctaaattccccttggctcagaagactcgttaatatgggaagtttaagtcctaccatataatcaaattggaagctttctgtgttcgaatggctattctaaccgctgggctattaatcagaggggaagtgaaatgaccgagacgtattatacgtcatgttgacatcaacaatttaaggaaaaaaataaaaaaaagcaatgaaaaagggtttttttaagttgaagacccttttcaaatatatgttgctttgaattgtatctaccgtctcgtttcttctgctttaccgtttttttttgccttctttagatatgtcttttatgcttgaaaggtccggctttaatgcattcatctaaacgtagtattcctatttttgaactgctaccaatccaccatgactttactatgaaggacattattagtgaacagcttcaaaaaaataaacttttcaagtcattaagatatatcttgttgcagcgtaagatgttggtgttcagtgcattctgtacaaaaatccgtgtaataccaagtcatcctcagtttacaaagcttgctagtttcctgcagtttggaatgaaccattaaagacgctaatcttcggatagagatcagctccttgatactgtataatccctatccacttgaattcctgttgcatcccagttctataggcatcacctactgcatcacctacttgtataatcctcgagcaggtatgctagctctgcgtcagtccttgcgatacacaactaatggaatatcttatgggtcaatcaaaaccattcttctagaacgccgagtttccagttttgggatttaagtaatacattaggtgcctgtcacgcaatccgtccgctgtatttctccgcatagaggatttcagtacgagagagtgaagagtcaaactaacgcaacgtagtagtggctttggacattgaaaagaatagtctagtctgccaagcatgggagaaattttagaactaactaataagaatttcatgagccacttgaaaaaggacataacttcgcaagaatccttgaaaagtagaattgaggataaaaatggtgatgtcgctagcccgaaagaggataactatcctctattgaatgaaacagcggcatggccagatggggtgattacctctgaagaaggatgttcatcttcaggtgagaaagagaattcaggcttatgttcagaagaaagttcagaagaagatccagaagaagctgaagaggaatctgcaagggcttttggagagttagttgcagtcttgcgggacaaagacataccactgaatgtattggacgaacctcagatgaaagattggcttgaaaaatacaccggtgtttatagaagctcttggcatggttgattatgaagaaaattccataattttgcgaggtgggagaatactcttgggaaagtgttgagaacaaaaacgccactaaaaacagcaggattattaaaaagtaaaaaaaaaaaattccttttcaagcaggcaaacaatgggttatttgaatggagaagtatgctactatttctgcatgttgtggatctaaggcgatgtgggcctagattctttcctttttttgtttttaccttaattatcttacgttgttctttccgtcagttttacacctgacatgggacaagagaacaaattgtgaaataagttcaagcctctgttgacatttattgatgtatctatttctttgagggttaattaaagataacaaattgctttcttccgctaatttgagcctattgaatttactgggaaatgccaacgtggtcagacatcaattcaagaagtttagttctcagagagtgtaacttgcctgtttggtcgctgcagtgaaactgccattagctctttagaacaacgttctaactatacgaggaccatattacgtaaatcaacaaacctcaagaattagtgtcatattttctcgcagatattactactgacattcagtcagctatatccattatgcatgagcgaaaaaaaagtgcatacaaaaaagcttatttattggacttaataaacgaaactatgtagtgccgaaccttcggatactgatcattggagtgatttgataaagtttctgcagaattctgggaaatgaaggaaatgacgtagcgaggccttcatgcaacactagttgaaattgaaaaaaaaaaaaaccttataagctatctttcctatacgtcctctatcgactatataacccaagcagctgtttcatattttttgcaagaataacctccaaatattcctggcagcttgtatgccattgttatccagctcctggcactgtctttcgtatctattaaactcttcaagggtaagcttgtcttgagacttcaaaagccccttctgagcgacatcactattgaattcagggtgtccttgaaacgtcagcactctgttttgcctgtaaaatccttggttttgacatttttcacttgacgcccaattttggtatccctctgggacatcgaacacgcagtcactgtgcacttcagaaagatttaattcttgagcaccaaataacttttgacccacagagttcagttttagtgacacaaccccaccttcaaaccctttcggattccgtccaactgaacttcctagagcagccgcgataacttgatgaccaaaacatattccagctacgggcggatattcagtcttgctagttagcatctcatttaagaaacttcttaatttcataatccattcaatttcattatcaaatgaatcatattttgaaccagtgatgtatatgcctaaatactcatctttctgaagatctgacaattgagggaacacgtttttttgtacgtggaacacttcatattcgacatcttctgcgatacattccaatttcctggtctgttctaatagcttgatagccatatcaacaaaattgccccatggtttactccattcgttatcttcatctgtataaagaatagctattttttttactgtcattatgatgttttcttagtatttttttgatataattcaattctaatatatgttaatgcataattttcagagctatagcggtatatatttcaaactttctcaattatctatgtgaaattataaaccttatctgtcttttcttctgtacacctcatctgccacttcccactttggcgcgcgttgacattttgcgacaaaaagagattgttcgtggcagtcgtgtaaaaaactgcacctcaatcatgagtttttatgcccatttttcactatttcatatgaaccattggcaatgtacttcagcctaccctcatcggccagagtgtttaaatatccctctaattgttgaagagtaattcggttatatccccaatcttttggcacggtaattttcaaaaaagaatggatcttatgaagtttcattgcgcctaaattagtcagcattccttcgatgaatggcagacttctttgaagtgtcaattcatattttctttctatctcagaatcgttatgtagttcatagttactgttctcaatctccattggggcggtcttttgtgcttgatcaaaatccatctcgctatgttcaataacggaataggttccattttcttttaaaagcacacctttttgaatccagaaatctaacaaatgagttagcctgggaggagcaatatttagtgactcagaaagctgctctagtgataaacaaattggctcatcatttggagaatcaaactgatttattacgctgcattgttctaaagaaacgtctaacactaatttcctaccatctttgaaagctaattgtatttctacttttcctttatctttgcatagttgtaacttgcgcccaggtttcagctgtgagtatatatcagaatacttctgtagctccctttctaaatctattggtaaatgaaatgcaagatcattagaaccttgtgtatcgcagttgtacttccagtagaggagtgagataaattttggaaatattatgggatccagtccggctacttcatgcattttacggcagagctcctcgctacattttatatcccaaagcataacatcaatgctattcaaattcgactggtctgcatctgctgcaggggctgttgtttctaggagtcctaatataccgtttgttatataattggaatgacttgtttctgtgaatttgactattttttctcttattaatttcaaacatcgggtccatttttcatccaacgtataaaatttcaaagtgaataatctgtcggttaagagatttcgaaattctgatatgaaaaattctcttgattcaaatagatccaaaagcacctcaaacaaatttgtcttaatataacttgatttgatgttaccgggaatcatgtcattaggctctggtacccaagctatataataattgagtatatgttcgtatagcatggcgtgtcttattggtaggtccttgttcaattccctctttcctttcaccttgaggttccatagaaaggggctttttttattcttgtcccttttggtgatgttcgtatcttgattgatatcagaatcgtgcaaagtgtctacaagtgagagcagtgccttcatatctacattgaaattaattttctcctttagttcttcttcaggtaagtccaacattgcgtataacaatacatttactaagtgcttccgctcctgaaagtaaggtttaacaaacgtggttattgaatgtaggcatctccctgttggatccaggaccaaaaatgctttgatagttttaacatatctcaacaaagcgtccaccgtagttacgctggggtttagaatgtatttcttgaaatcagacaaaaaagttgttacaatatttgtgtagtctttaaaatctttcataattttcctcaattccaataaagtaacctttgaatcaggataagccaaaacgcatatatcaaagatttcattcgttcttatcctaagaaaattggactcaaaacagttgaaaactgtagtggtcagttcgtgatcatcctctggacaaccgactaatttagagaactgagaccaatattgattaataaatttgttgaatgtttccataatcataaaccttttattccatactctactcatgttatcttcacaaaatttattgattttgctgtaaagagcattgactatcaattccgtagaggataaggaaccattagcagatttgagccattggattaaattgtctgccaggtcgaaatcatcatccattattaatttgtctaatcttgttcttaaattatttttgaactttatatttctattcaacagataatgtcttaaagaattaagttcaagtgcccagtcgtttacatttacgtcaaaaataggaacgtaacgtaaaggaaactcgtaataattttcccatcgttggatatcttttagataattaatgttgttaaaatgtaagaaaaaatgataacgaacctggaaaatataaaactctttgagcgtggaaaaaagttgtagttgtaactctttgtttgtatttccctcattaactattgaattgtttgcctgactagtgtttatcatgctatatggcgatgtggttgcgttattagggaagagaaccttaatgatattcttaatacgaaggcttggaggacgtagttgatggttactcttggcatcattagggctcatccatgtaagtaaagagttcaaatcatcgactatgtttgtgtgaaagatgtatgaggaaagtgtttgtaactcatctgtaataactttcaaatctcgagttggggtaatctgaaatgacatgatggaaaaaccttaactataagccataaatatttacagtcccgctaagtctggctttcgtctagttttcgatattttggctcttttgtctattactgtttttgtaaccaaaggtttgaaaatttagatgcaactaatgaacttacgcagtaacatgcaagtacccaataaaaaaagaaatttttgaagagacgttcttgcattcaggacatggtatgtttttaatttcgtttctttagttctcaggctcttcaaagtactaacactttattggcaaggggcgctcaaatgtgatgcatcattatagagtaataataaaataaaaagaaaggatgcaagcccggaacaagaggcaattgaatcattcacctcattaaccaaatgtgaccccaaggtatccaggaagtacctgcagcgtaatcactggaacatcaattacgctctcaatgattattatgacaaggaaatagggacgtttactgacgaggtttcaactgtggctcatccacccgtatacccgaaggagctaacacaggtatttgaacactatatcaataacaacttgtttgatatagactcactggtcaagttcattgaggagctaggctacaatcttgaagatttagcgacattatgcttagcccatttactggggtacaagaaactagaagaacccttaaaacgagaggacttcctgtcaacatggtttatgcaaggctgttccaccatttcagacatgcaagagtgcatcaagacgttagatgttaaattacatgaagacttacaatatttcacacagatttataactatgctttcaatttgattctggacccaaatcgaaaggatatagatacagacgaaggcatccagtattggaagctatttttccaaccagagtacccagtgcgtatggaaccagatttgcttgaggcatggttccgtttccttcgcgatgaggggaaaaccactataagtaaagacacctggcgtatgctgctcctctttttcaaacgataccccactattcagaaaataataagcgattacgacgaaactgcagcctggccatttattatcgatgagttctatgagtgcttacaggatcagcaataaacatcctttcatatacttaagggtatgctgtttaatattgcatggaatacgttacccttctaagatagatgggaataaggcggaaataaaaaacgcgatgagcagtggaaaatttttcagaaattttcagttccctcataatatagatgtagatattgtataaggtcgtacgtatatcagagtagccactagaaggaccagagaaactggaataagagctattatggtcaaatcataccaacgttttgagcaagcagctgcttttggtgtaatagcctccaatgccaattgtgtttggatacctgcgtcatccggaaatagtaatggtagtggaccaggacaattgattacgagtgctctcgaggacgttaatatatgggatattaagaccggggatttggtcagtaaattatccgatggcttacctccaggcgcatctgatgctagaggcgccaagccagccgagtgtacatatttggaggctcataaagatacggatttattagctgtcggttacgcagatggtgtcattaaagtttgggatttgatgtctaagactgtgcttttgaattttaacggtcacaaagcagctataacattattacaatttgatgggactggcacaagattaatttctggttccaaggactccaatatcattgtatgggatcttgttggagaagttggtctttataaacttagatcacacaaggattccattactggcttttggtgtcaaggagaagattggctgatcagcacctccaaagatggaatgatcaagctatgggacctaaaaacacatcaatgtatagagacacatattgcgcatactggagagtgttggggccttgcagtgaaggatgatttactgatcacaactggtactgatagtcaagtaaaaatttggaaactggatatagaaaatgacaaaatgggggggaaactaacagagatgggtattttcgaaaagcaaagtaagcaacgtgggttaaagattgagttcataacaaattcgtctgacaaaacctcttttttttacatccaaaatgctgataaaaccatcgagactttcagaattagaaaagaagaagaaatagcaagaggtttaaagaaaagagagaagaggctaaaagaaaaggggttgacagaagaagaaattgcaaaatctattaaagaatcctactcctcctttatattgcatccttttcaaaccataagatcattgtataaaataaaatctgcatcatggacaacggtctcaagttccaaacttgagttggtattaactacatcgagtaataccatagagtattattccattccatatgaaaaaagagacccaacaagccctgctcctctcaagacacatactattgaattgcaagggcaaagaacggatgtgcgtagtattgacatcagtgatgataacaaattacttgccacagcatccaatggttcattgaaaatatggaatatcaaaacacataaatgtatcagaactttcgaatgtgggtatgcattaacttgtaagtttttgccaggtgggctactagtcatactgggtacaagaaacggggagttacagctctttgatctagcatcatcaagtcttttggataccattgaagatgcacatgatgcggcaatttggtcgctagatctgacctcagatggtaaacgattagtgaccggatctgccgataaaactgtcaagttttgggatttcaaagttgaaaatagcctagtgccaggtaccaagaacaaattcctgcctgttttaaaactgcaccatgatacaactttggaattaactgacgacattttatgtgtacgggtttctcctgacgatagatatctagccatctcgttgctggataatactgttaaggtattctttttggactcaatgaagttttacctaagtttatatgggcacaaattacctgtactatctatcgatatttcatttgattctaagatgattattacgtcttccgcagacaaaaatatcaagatttggggtttagattttggtgactgtcacaagtctttatttgcccatcaggattcgattatgaacgttaaattcttaccacagtctcacaacttctttagttgttctaaagacgcagtggtgaaatattgggatggcgagaaatttgaatgcattcaaaaactatacgctcatcagagcgaagtttgggctttggcggttgctactgatggcggctttgttgtttcttcatcccatgatcacagtataagaatctgggaagaaaccgaggaccaggtatttttagaagaggaaaaggagaaagaacttgaagaacagtacgaggatacattgctaacttctttggaagaaggaaacggtgatgatgcatttaaagctgatgcatcgggtgaaggcgttgaagatgaagcatccggtgttcataaacagactttagaatcgttaaaggctggtgaaagacttatggaggcgctagatttaggaattgctgagattgaaggtttagaggcatataacagagatatgaagctatggcaaagaaagaagttgggtgaagcgccaataaaaccacagggtaacgctgttctaattgctgtgaataaaactcctgagcaatatattatggataccctgttaagaataagaatgtctcagttagaagatgcactgatggttatgccattctcatatgtcctcaaatttttaaaatttattgataccgttatgcaaaacaaaactttgctgcactctcacttaccattaatttgcaagaatttatttttcattatcaaatttaatcataaagaattggtttctcagaaaaatgaagaattgaaattgcaaataaatagagtaaagactgaattaagaagtgcattaaaatctaccgaggatgatctaggctttaatgttcaagggttgaaattcgtcaagcaacaatggaatctaaggcataactacgaattcgttgacgaatatgaccaacaggagaaagagagtaatagtgcaaggaagagagttttcgggaccgttatataataaaactattatcctacataataccggcattactctgcccttttcacacttcaaaaggatagattaaattatctgtatattatacaattccaatcataaaaattgtcattccgattgcccttcggtaataatgggcatatccaaataacggaatatgtgttttttatacttattggtcgctgacatatgctgttttttgcgagatgtctctcgtctctgcagagcagttgtaaaattataggtcatgcatttttttttttttgataatgaataactatctaatctaacaaaatatacgtgagatactatgcccatttccctagaagagccattaaagcagctccacaacacatgatgagatatgcactaagcatttttttgaggccatcaggtcctttgaattgattagagtataagaattcatgagccattaattcgactagtccagtataaataagaattcctgatgatatcgagtcaaaaacaccattagcaattaatgctcttctagagccaggtatccaagagtgtctgacaccaatacctaccgcgactgctatgggtgacgttaaagtgaaggctaatcccattaaccaaggcatgtacttcttactttctggccaattcgtttcggcaactcttgtgcctagacccaaaccttcgaacatttggtggaaagttaaaacgataaataaggtttcgaattcttcacccgcgacagatagcgaaagacccacaaatacagagtgaaagatgatgccaaattctagaataaaaacagctagtatctgattgagatactgctctttatcttcctcctcgatacgtgtggccaactgggagacatcttgatggtcattttcgtgagaataatgatcttttccaggtacagaagcgagatttgtcgcatgggaactggttggaactagttcattagctagtgactctgtttttcccggttccagatcataattagtaacatttgagccgggttctttttcctttataggagtagcgacaatctcttcatttctagtagtgtacggagttttgtcattatggatggagtaggcagcttcgttattgaaagatacaggatccgagtccatatttctgatgacaaatcccgaactgggagcatcaacatcaatactggtaacttccccatggtccccatgatcgtgtcccagcgttttcgctacaaaataatgcgtgatgatttcagtgaagaaaagtaagaaaagcgacattaaacagatcccaaaagcccatggatattcggcaaatgtgccaccaagacattcatctcccagagcttcggctgcgggctgtagaagatgaacgaacgctgtggcaacaatgacaccagaaccgaagaacttcgctatgaaaaagcaccaatttggtagccttataaacgaataccgtgatgacaaaattgggaaataaactcccaatcctgacgatatcagtataatgaatactgccagaattctaagacctgcgtgcccattgtagccgttagaagcttggcaagtatctacggagtcatccctcgctataagatcaaccatactttcgaatatgcagtgtcacttggaaacgcctgcaatgttttctttggttgatgcaccgttgtattttcggagatcaactttagctttcttccggtctaaccaacagggtgtatgattcaataaacagtatcatcatatatagtgggttttagatcgtgtctcccaaaaggttgcgtcatttaaaatcgtcacactgtgttttaccaaaggatgtgtgaagctggtttgtagtagttaaagggcaatgtaccctaaaggttgtgaaaaattttcattttcgagaaggagtcgcatataacctttagggttatgtccctataaacgatgactattgccttttttggcccttaagactacagtgtacgtaaatcgtaaagaaataaatgtattatattattgttactattatttattatgttaatatcatgcatagataaatgttcgtcagagagcatcagtttcgtttgaaagggtgcggttcgagttttgctcgtgcgctgctgtggatgggggtggatccagtaatccatgtttgcgcatatcatctcgcagctgttcctccattttcattaggacgctcccatctttatcccgggcgatagtttcttttacgggacttgtgtcatgcgggctgtcaagcaggctttttttgggagatgtaagtttcttgttgatcgaatgttctaatttcttaccgccggtgcaaatcatccgacttctatgcaccattagagcatcctccctattaaatctctttccgcatgggcagatgtatttcttggcattatgggagattttgtgtcttattaaatcatgattgcgaacaaacgccttggtgcaaccgggaaagtcgcatgaatacggtctatcttgcaaatgtgtctgaatatgcgaccttatgttgtatctacgcttgaatactttgttacagttagggtataagcactcgaatagtttgtcgggtagttccttgacgtactggtcaatggtacccggaggcagagtagttggtttcttggttattttcattggcgtagtcctaggtattatttcatctggtaaaggagacgtactatgcaaagtggggcttttgtgaatatcatgtgtgacaggtggtacttgcggatagctttccacttcacagtgactgttatttcgtatgggtgtcttaatttctaactgatgatctgttaaatccggtgcatttagaagcggagctaggttacttccgttctttggtggagctttgacgggagtatgttgaaatacatgtttttgtggcaaagaattcttaattggagtgttattgctggaaccaggaataggaggtagtacacttgatgacgctaaagcgtttgcatttcttaatgttgggttctgggtatttcgcatgtggatgggttcagtgtcatcctgcagttgtgatattgtcgagaccgtggaaactacggattcccttttcttgtggataggtgacaactgtgttctaggcgtgaacgtgccagcagcatatcgatcatccctgcttttatctgtgccgacgaggaagggcgatctcaaactatttccatttatccttggagagatacttagcccacccggggaagtcttttcgaacagacggaatatgttatcaccagtactattttttttatcattattgtttttatcactggtgttattatggtcattataagtcaagccgtccaagtttaaattataattttgtggagaaaatgaaagcagttcagaatctctcaaataaccactgttagaggaaaaaaggttcaatccattactttctgggcttttatttggatatcgttgcctatggtatttcctggatggtgaaccatttattgaagtatttgacatccgaggcgatattaacgtcggaggaggaaattgatatccgccatttgcagagttcgttgtgacgattatagcattatctttcattctaccgttttgcatggcaggtgtctttagtattactggagatccaggtttggaattagaatttgtagccccagaaaccaacttctgcgccacctcttcttgctcttctaatactttacgcaacttttcttgctgtatttgattgtctctcaactgcttctccaatttttcgttcacttccttttgtttttcaagagcaattcttaactcctcctgctgtttcaacaaaacttggctcaaatagctattttcaccatcattttcccttatatggtcaaagtcatcattgttattttttaccgtattatgattacccaattcatttatgagttccatgggttgcggatctttagacatatttagaatggattgctgtaaactggaaatactcaatgtcttattatggccgagaaatccaaatatcgctgtgccacttagacctctcttgtgtgaggacattgattttttgctatagtgggagactttgttgttttcatcaccaaggttccaagttctatcaatattctttttatcagaagaaccatcgcccgtcttaggagaaggcactaaaggaatatccagatctcttaactcttgagtcaacaggtcatcgatgttatagtagtccatacctaacaagttatcgaggccatcatcgttttcattattcaaaatataattgtcgggtgggggtatggtaggattgacattatcatgatgttgaacatactcctcatcttgagtgtctttcgcgaagcctgagggatttatataccacggatctacaacgttatccatgattgtattaacaccgtttttggtcctatagatttctttagttatttcttgaatttatgccttgtatttttttcttctagcactttaactgttgcttgagtctccctgcaacgtagcttttgtttgctaggtacaatgccgagagaggttgttataagtttatgtgtactataaaacccttaatgaaagaaaagggacagaaatattgcgagtaaacaaacagtactccctccttaatatttgcccgttaatggctaaatgctttctggagttgatttactagctacaagcatccttatcctttacctgtaaaccaaaagtgtcctgaaattttcccaaagtgccaatgtttacattttgccgttttgagatatatatcgtatattatgacaaccttcacctatctgacgagccgctctcagtgccccggtatttttgggcggctattcctataacactattagttaaaagggattctaatggagtgacggttttcatcacaatagatagagttaactaagaactctagtttgtatgcaaagtcattattgagtagtaaaagcgcccccatcgtctcgtttaattgttgataacgttttaatgtggcttttgaagggttgctagcgatggcaattgaaacatgtaaattttgcctacttacaattaaatcctgatagtttgaaatgcctgatttctgaagtgcctcagctattatcgttttgaaaggagaaatttgtgccttattgggacattctgagacagggagaccgaggtacaaggtgttggctcgttctgatatatataacttcggatatgagcagatttgaagtttaaaaggggttatttcattatttcgtaaaccattacgcatttcttgaatgaaaacatgtctttgttcttcagtttcaaacaacaacgatcgagttaaggaaacgtgtaaaggtttgggggctcccaagtgtgagatgaacaacgggtcaaaatccaccagttgatacggattagtgtattcctgtttcataaatgtttctttatatttacatatgattttctgaagttgtcggtgaatcgctggagtcggacgccactcaaaatatgtgaacgaacgccaaaatcgactcatattcatatcctggtgctcgtacttttgtaaattcggagggatgtggtacttcaatataattgaatccggtattgcaggtaaatcagtggaatcggctttctgtatgcaagttttctccgtgtattcgatttggacctcacttttgttactactttcgctctcggtatcactaccgtcactgctagaatagtctgcagatatgaattccataggccagtcttcttctaagcgattggtaacctccttcactttagaacaccaccaacagatcgttctcttgttctttgttctttatggtataatattcacatggtgctctaccgtttttcttgtcggcccagccggttaaatctcgaagagacagaatagaagctctgtggctgtaagtaaggataagccaaatggaaaagttatagaattaggacaacaatatacagtttttttttgtactcttatagaatacacacacatagatacgcacgtaaaattagagcaaaagatggtacaagaatcacgtccagggagtgtaagaagttactcggtcggttaccaagcaaggtccagatcgagttctcaaagaagacattcgttaacacgccaacgttcctcgcaaagactgattagaaccatcagtatcgagtctgatgtgtctaatattactgacgatgacgatttgagagctgtcaatgagggagtagcgggtgtgcaactggacgtctctgaaaccgcaaataagggaccaagaagagcatcagcaactgatgtcacagatagtttgggttcgacttcgtcggaatatattgagattccctttgttaaggaaacattggatgcaagtttaccttcggattatctgaagcaggacatattaaatctcattcagagtttgaagatatccaaatggtataacaacaagaaaatccaaccggtagcacaagatatgaacttagtcaagatctctggtgcgatgacaaacgcaattttcaaagttgaataccctaagttaccatcgttgctattgagaatatacggaccgaatattgataatatcattgacagggaatatgaattgcagattttggctaggctttcattgaaaaatataggtccttccctttacggctgttttgtaaacggtagatttgagcagtttctggagaattctaagactttaacaaaagacgacattagaaactggaagaactctcaaaggattgcaaggagaatgaaggagttacatgtaggtgttcctctcttgagttcagaaaggaagaacgggtcggcttgttggcaaaagattaaccagtggttgcgcacgattgagaaagtcgaccaatgggtgggggatcctaaaaacattgaaaactctttattatgtgagaattggtccaagtttatggatattgtcgatagatatcacaagtggcttatttctcaagaacagggtatagagcaagtcaacaaaaatcttatattctgccataatgatgcccaatacggcaatttacttttcactgctcctgtgatgaacacaccgagcctatacactgcaccttcgtctacatcattgacttcccaatcaagttccttatttccttcgagctccaatgtcattgtagatgatataatcaacccgccaaagcaggagcaaagccaagattccaaattggtcgtcattgattttgaatatgcaggtgccaatcccgccgcatatgatttagcgaatcatctttccgagtggatgtatgattacaacaatgctaaggccccacatcagtgccacgctgatagatatcccgataaagaacaggttttgaatttcttatactcttatgtttcgcatctaaggggtggtgctaaggaacccatagatgaagaggttcaaagactctataagtcaatcattcaatggagacccactgtacaactattttggtcgctctgggccatcctacaaagtggtaaattagagaaaaaagaagcctccactgccatcactagagaagaaattggacccaatggaaaaaaatatatcatcaagactgaacccgaatcccctgaagaagactttgttgaaaatgacgacgagcctgaagctggcgtcagcattgacacgttcgattatatggcttatggtcgtgacaagattgcggtcttttggggcgacctcattggcttaggcataatcaccgaagaagaatgcaaaaatttcagctctttcaagttcctcgatactagttatttgtaatacgtatacgaattccttcaacaaaggccaaggaaataaagcaaataacaataacaccattattttaattttttttctattactgtcgctaacacctgtatggttgcaaccaggtgagaatccttctgatgcatactttatgcgtttatgcgttttgcgccccttggaaaaaaattgattctcatcgtaaatgcatactacatgcgtttatgggaaaagcctccatatccaaaggtcgcgtttcttttagaaaaactaatacgtaaacctgcattaaggtaagattatatcagaaaatgtgttgcaagaaatgcattatgcaattttttgattatgacaatctctcgaaagaaatttcatatgatgagacttgaataatgcagcggcgcttgctaaaagaacttgtatataagagctgccattctcgatcaatatactgtagtaagtcctttcctctctttcttattacacttatttcacataatcaatctcaaagagaacaacacaatacaataacaagaagaacaaaatgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctgctgatggttacgctcgtatcaagggtatgtcctgtattattaccaccttcggtgttggtgaattgtctgctttgaatggtattgccggttcttacgctgaacatgtcggtgttttgcacgttgttggtgttccatccatctcttctcaagctaagcaattgttgttgcatcataccttgggtaacggtgacttcactgttttccacagaatgtctgccaacatttctgaaaccactgccatgatcactgatattgctaacgctccagctgaaattgacagatgtatcagaaccacctacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataagctaattaacataaaactcatgattcaacgtttgtgtatttttttacttttgaaggttatagatgtttaggtaaataattggcatagatatagttttagtataataaatttctgatttggtttaaaatatcaactattttttttcacatatgttcttgtaattacttttctgtcctgtcttccaggttaaagattagcttctaatattttaggtggtttattatttaattttatgctgattaatttatttactttcgtattcggttttgtacctttagctatgatcttagctaattgaagagggtggtgtgatctttaaccataccttattatctttcagctgcttaccattttcttatattgatttttagcgaaagatttttattcacaagctttttttatccttaatgctcgaatactacaacaaaacaaaaaacattaaacagtttttaattttgtgaacaaactgaattacaaggccttacatcttatttagaatatattaagaaacagaggccaacatgccttcttaattatattgatatggacctctgtccttcctaaaaacgggtttttgttcgatgaaaaatcaccagtagagcaccatatatgaatttacaatcattgtagggaaaagaaaacttgttctgcttcgccaattgatttcatttctttttttcctttgtttttgttgtatactattaatatgcgtagttctttgtcacttagtggttttttgtttaatttataacgcgaaagctgcatactaaaaatatagagatgaatggaactccgaacaagcaagagagatattatctatctctgttccataataataaccagtagttcagttggggaacttaataatggaacttcagagggcacaacggaatttgaagtttttacaaaacgaggattatgtgaacgttaccgatcaaactaacctgaatggagagagccagaatgcttactctttaggaatggaaactcaagtaccggaaatgcagttttccttatcatctgatgatgattcaataggtacgcaagtaaaaagcgtaactgcacaaaaatcgcctatgacgcaagagactacgaaaaacgatacagaaagaaataaagatgttgataaaagttgtaacccagtcagcacttcccatcccgatttaggcggatcaaatatcgaggagaacatattcattaacactcaaattcaaagccgacttgatgacgcagaggaagaaacaaatcttaagttaaaacttgaaaaattcaagtattcgttcaagagtagtaacgcagatgatacccacagcaatgcaaatgtaacagctaaaagaagaccagcaataaggaaggctaattcgaaactcaaaacaaaacctaaaactaaacgagaccctaaaattatcaaaaatataactgatttcaatattaataactacgaacgttcaaggactgccagcttattaaagcaattatcaggtaagcacaagaaggttttggacataataaagacgcaaaatgaaggaaacagtgataaacctcccagagcaaggaataacaagggtgaaaaagctacttttgatacatatagtgaacaggagtggaaagatattatgaaacttcttctacaaaagtttccgcaaagtgaggaaacggatttgaatgaagtccagaaatttttatatggaagcgaaaaaagctcgaattctctagacaatcaagaatcctcacaacaaagactttggacagcatcacaattaccacccgagcttcccgatgaggctattcaaccagagcaggaagaaaggatacgcgatacccaaagtgcagtaaatttcttatcgttgtctcaagtaatggatgacaaaagtgaaattatgaaagacgaagaaagcataattatttcacggggagattctacaagctctcaagaatatggaaacgggttagagccacaacaaccggtaggaaatgttgttggtgaagatattgaactggctgtgggaacacgtataaatgcattttcactgacagattataaagcttgcaaacctatgtctgttgaggtaagtagaagatgcgaaaacagtacggataatgattatgacaatatttctattgtctcagatactacagatgagacatccacattgtttccactagaccagtatcggtatgttttcattgaaaatgatgaaagaccaccattagccaccgacacgataggcagcacacagtttttcactccaaacacatcgcctttggatgggataatcgatttaacacaggaatcattcaaagctgttcgatcgttaatatcacctttgaaagtagaaaacaacaaaacaggggtaacatcacaagcatcaaatcaggttcaggtaccagctacaagaacccctacaattattcctcaaaagaaccttactacaactttaaaaactgaagaagaaaagaataacataggaagttccatcagagttaaattattgcaagaaagcgtagttaagctaaaccccaaactggtgaaacataacttttatagagttgaggcaaatgattctgaagaagaggagacagaatttgatgaccaattctgcattgctgatatccaattggtagattcctccaaaatttcgactaaagattctacacaaaatcctactactagcaacgacattattgatacctctgcagctagttccatagcttctcccgagaaattttgtgagatcatgatgtcccaatcaatgaaagagcttcgacaaagcttgaaaacagtggggttgaaacctatgaggacgaaggttgaaatcattcaatccttacaaactgcatctcaaattctgtccacagctaatccagataataaaggtgagcatggtggggtggcaaatttcagtaagatagaaatatttgatcatttaaccgaactaattgaagccttccctgattttttggagcgaatatatacctttgaacccattccgctaaatgagctaattgaaaagctgttcagcgccgagccatttgtttcgcaaatcgacgaaatgaccatcagagaatgggccgatgttcaaggaatatgtctgagaaacgataaaaagtagtgccgaatgattgagaatttgacaaaacaaaaacaaaacaaaacaaacgttacgtatagatgaagaatacacgtacacaaatatgcatatataccgtcatgaagtagcttaacttaaataaaagttttttttttttagagttaccaatatcgcaaacatgaaaatgagaataaaaaaaaaaaagcagaaaaaaaaaaagcataacatggagaaaaaaataataaataattgagtttagttgagacgccggtcttcgccaggccaggaattgtttcaccaggtcattctctgcaaagcctttactttaacatttagattcttcttcttggcggagccgcgaccattgcttctcttttcgtctgattgtttgctagtcgaagagacgttacagtaagtaccagctttcacgtaaacagcaatgtcgttgtcgtcgccatgtttgaagcagcatcttctgccataaggacaataacctagtttctcccaattcacacagggcttcgtcctgaaattcttgcacgatttcttaacctttaattcgccgagtccgtgagcaaactgacacttactgccataagggcaacttccttttaaagtgaatgattcgcacagctctgtcttgtataattgtttgggagtttcctgcacttggcttttcaccttaggttgagctgaggattccttctctgatgaaaaagaagcatcatttttgggcttttgttgagacaactgttgcaaattctgtgaagttaatggtaattgtgaagattttgggacatagtccggatttatttgtacctctagtttctttttaaaagtagtaggtgccgtgctattcaggtgagcggatgggagaaaagggttcattaactgtggatcatacagtagccccggttgaatagcgtttgtattttttggtggagagaatgaaactgccgaagatatttcactgcttgtttcctgtatgttatcctcgtttaaaatcgtcttgttgtaatactcctccagttccctaatattgatctggtactggtagtcatttaatggattttgctcttgatctgtggaaaacaacgacgttaagtcagtcttctgagattctggtctagtatatgataattgagcccacatattgcgttattttttacgtattgagtttgcagcactgtttcgctttctctcaagatgcacaaatacgacctaccaagagcctccaagtcccaccaacgattatgtcttctctcaaatatatatacaagttacatgtagagaaatcgagacgagattgctggcacaatgcacccaactgcatgtgccattgtgcatctacacctccaaattagggtgtcgattggcgtcgtcttctttaatgtgggtgcattttgcggcggcgcgacaaatatagagaactgaccaaggcagtgctgtcaagaagagagaatggttacggcagcgaagacgcaaatgggctaggcagaatggcattcaagttatggctactggatgaggaaacaatatacgagcacgtgttcgaacggtacacacaattggagggccagtccgggaaactggcgcaggatttgggtattcaggatagaaggggcggtgtgctagagataacgtttgaaccctctgggctggaaggcggcagaaaaaaaaagcgagtgagaagaagaaataaggctagtagtgttgaagaagatcagaatgttgctgtggatagctatcatgttagcgtggggcagtccatatcaagcttgcgctcgtccagagacaacggaaactccaccacaggatacgttttgtggtctaccacacctttcttcatcaactggctgctgtatagtactagcgctgcacctttccgtcttgggagtcaggtggaagtaacctgcgggtcttcttgcgaggggcacaagcttgagttgcccaggctggtcgacctcacgggcgctgatcgcggcaagagaggtatcttggaacttggagcaggaatatcaggtattttgcccgtgattcttggtaacttcgtcgacacctacgtgtcgacagatcagaagggcattcttaataaattaaaagataacatcatggaaaacttatcacagttgaccagaaagcggtgcatttcccgatcactaagattggaacttcccaccgtcgaaccagttggcgacgctgatatcaccgcagcgtcacttccatctaagtctacgttgcatttggaagtagccgctctagactgggagaagataaacttgcaagacaaaaagacccactctctgcatcctgagttgtcactcataggtgaaacatgttcttccgtgtacgttatagctatggatgtcatatacaacgagtacctgatagatccgtttctgaagacgctcaagcaactcaaacactggttacaaactacctacaatttgcaattccatgtcctcgtggggatacacttgcggtcacaagaggtgacaacactgttcttggagaaagccatcatagaatatgacttcacggtttatgatatcgttgaccaggtcatacaagagtcccgttttaacttttatcttatcacctagtcccatatataataatagaaacaatataatgctgataatcttatttttctttgcgatgcggcagtgcctcttcccctccgtacggattgggaagattttcatttttgattagcaagggcactaagccaactctgtgtgatatagctaataatctaaaagctgctggatccgttatcgtcaagataaagcggacttagcgatttacataggatcacactttctacacacatttgatttttaagcttcattttccactgcacttatttttcccaagcatcgtgtttttttgtacattataaaaaaaaatcctgaacttagctagatattatggctatctgggagcaactagaagtctcaaaggcgcacgttgcttatgcatgtgttggtgtcttttcatctatcttctctttagtgtcactttatgtcaaggagaagctttatattggtgagtccaccgtagcaggtatatttgggctaattgtgggtcctgtttgcttgaactggtttaatcctctgaaatgggggaattcagacagtataacattagagataacgagaatagtattatgtttgcaaatttttgccgttgccgtggaactgccacggaaatatatgttgaagcattgggtatctgtgacgatgctattattgccagtgatgacagctggatggcttattattggtctcttcgtttggattcttatacctggcttgaatttttctgctagtttgttgatatctgcgtgcattaccgcaacagatcctattctggcgcagtcggtcgtctccggtaagtttgcccaaagagtacctggtcacttaagaaatctactgtctgcagagtcaggctgcaatgatggtatggcctttccttttttatttctttctatgaatttaatcctacatcccggtaatggaagagaaattgtcaaagattggatttgcgttactatcctgtatgagtgtttgtttggatgcttgctaggttgcttcattggttatgtaggcagaatcaccatcaggtttgccgaaaagaaaaacattatcgatcgtgagtcgttcttagcattttacgttgtcctggcgttcatgtgtgctgggttcggctccattttgggtgtggatgacctattggtatcatttgcagccggtgcgactttcgcttgggatgggtggttttctcaaaagacacaagaaagtaatgtttctaccgtgattgatttgctactaaactatgcgtattttatctattttggtgccattataccttggagtcaattcaacaacggtgaaattggcacaaacgtctggcgtttaattatactttcgatagtggtcatctttttacgtaggatccctgcagtcatgatattaagacctcttatacctgatataaaatcgtggcgtgaggcactttttgtgggccattttggtcctattggtgtaggtgcaatttttgccgctatactagctcgtggagaattagagtctacctttagtgacgaacccactcctttaaatgttgtaccatcaaaagaggaaagtaaacattggcagctgatagcctgtatatggccaataacttgttttttcattgttacttctatcatagttcatggttcttcagttgcaatcataactctaggtcgtcatttgaacacgataacgttaaccaaaacattcactacacacaccaccaatggtgataatgggaaaagttcatggatgcaaaggttgccatcgttggataaagctggacgatcattttcattgcatcgtatggatactcaaatgactttatcaggggatgaaggtgaagcagaagaaggaggaggtcgtaagggactagcaggaggtgaagatgaagaaggattaaacaatgatcaaattggtagcgtcgcaacgagcggaattcctgcaagacccgctggtggtatgccaaggaggaggaaattgtcaagaaaagagaaaagattgaacagaagacagaaactgagaaacaaaggtagagaaatattttcatcaagatctaaaaatgaaatgtatgatgacgatgagttgaatgatctgggacgagaaaggttgcaaaaagaaaaggaagcacgcgccgccacatttgcattgagcacagccgtcaatacacaacgtaatgaggagattggaatgggtggagatgaagaagaagatgagtacacaccggaaaaggaatatagcgataattacaataacacaccaagttttgagtcgtctgaaagatcttcatctctccgaggaagaacttacgtaccaagaaaccgttacgatggagaagagacagaaagcgagattgaaagcgaagacgagatggaaaatgaaagtgaaagatcaatggccagtagtgaagagaggagaattcgaaaaatgaaagaggaagaaatgaaacctggtactgcttatttagatggtaatagaatgattattgaaaataagcaaggtgaaatcttgaatcaagtagatatcgaggatcgcaatgaggcgagagatgacgaagttagtgttgatagtacagcccattcaagtttaactaccacaatgaccaatctatccagtagtagtgggggaaggttaaagagaattttaactcccacatctttaggaaagatacattcattggttgataaaggaaaggataaaaataaaaacagcaagtatcatgcatttaaaatagacaatctgttaatcatcgagaatgaggacggtgatgttataaaaagatacaagataaatcctcataaatctgatgatgataaaagtaaaaaccgcccaagaaacgatagtgttgtatcaagagctttaacagcagtaggactaaagagcaaagcgaacagcggcgtaccgcctccagtagatgaagaaaaagccatcgaaggaccctccaggaagggcccagggatgttaaagaaaaggacattaacacctgcgccaccgagaggagttcaagattccttagatctggaagatgaaccttcatctgaggaggatttaggtgatagttataacatggacgatagtgaagattacgacgataatgcatatgaatcagaaactgaattcgaaagacaaagaaggttaaatgcgttaggtgagatgacggcaccagcggatcaagatgacgaagagttgccgcccttacctgtggaggcacaaacaggaaacgatggtccaggtacagcggaaggaaaaaaaaagcaaaagagtgctgctgttaagtcggcgctatcaaaaacgcttggtctcaataagtaatttattaatacacaaagatatattattttagtatatatataaacgaaatgccttttttatttacatgtgtcggaaatagagtagatgcggtaaagagggggagggggggggggtatgcggttttgtcattactcttttccgttaaacttaaaagcttaaaacatcattgataaaggtttttagtgaggtttcactggggttcacattgatgaaatctaattgtctgtaggagccattgttcaaaaatccgcggctgatatctgaatattgaatgatgtatttatcatcttgggcagtgttcgtaggaaatcgtaaattcaagacacgatgggtcaaaacatcagtcaattggtattgctgtattaggttatctggtaaagaaatgttgatttttttcataagattctgatatttgtttaacttccagtgtgacttgagaagaaattcttggaggcctttttgttcagataaccaagcatccggattggtctggtcgaaatcaggtaaaagatcttgaatgtaatctgacgtgatcttatagtctgtctggcattgtggagttcttaagataacagaattttcttgtaatttcaaaagaggcctcattgaggtggtaacaatgttatcgaattcgtcaatctcgaaccaaatctgcaaaaaaggggacgaggaggagccagaggtgggcggcacaggagtgaagttcagctgtatgaaggattgatgcgcatttgttattagatgttgatcaagaggcacaggcacaggtacggctgatgatgatgattctttgtacattggtagattcagtaattttgaaataaaactcttatgtattagaggttggaaaatactagaaaaagacgcggactgtaaggagtgacctagcgttattgataaagattgggaaatagagtcggaaggggagagagatggtatatttttagacaaggaagattcgaattggctgacctgcgcatctgtcaattctggtgtggcgttttcagtgggagtcatcagatctgtgcaatttttagggacaactgactgtaatcttgcccaatcttgtgacttgtttagccagtccaagttctctagagtattgttgaacggatagagttctgtcttgagtgctggtgaggctattgtgtggtggtgttgagttgtgttaggattagaagcgacggcatttaataaaaagactttggccatggatattttcttggtgcttagggctgaaatcttgtacatttgcaagtccgggaggtattcaaaaaaagtgtgagtttccttctgaataaggttgatgacgtcttttgatggcatgagggaatacatacgcacattttcatgagtgatgtttgaccatattttgtttaaggatatttctgcgtatttgagcaagctaggcgaacccttgacggtcaattcgttatcctgaatggagatgatgaatgtcagcccgagcttattgaagttggtgagtattttaccattttgagtgatgagtaaaaggaaaatttctctaggagaatcgaactggaaagtcaatgatgtggacttgatgcctgtgggagtggtgggtgttgaaattggttggcaattccagattttttcaattatatattgggacagcttgcttttcttccagtgcgtcagatgtgaagaggagtctggctgatgtgtggagatgaactcgcgcagttggtagcgattgtagcttgatgtaagcgattggagaagggcattgtattccagggagggcagactggcgcttgtcggtttcttcaatcggatggagttcaatgcggaatctagtgaattctgcttttcgaagacaaggagtttcgagccgaaatcgaggttgttatctccagtttccttatggctacgtttcttagacggcctgtgtctaggctgcttctgatcatttttcactagcccagattgggtagggttcaagacgacgaatttcagattttgcggcagtttcttcttcccatgaaggggcgagcttgggcctgagcttgaataaagacggtaagtaagacgggcgagctttttgttgaatttccacatatgcttactctatattttctccagtgccttcaagctccgtatatattatgtactagttttattacattaaagatacataactttttttttttttttcagttcactgaaataagaaaaggcgggcgaggtgaaaaacaaaaaaaaaagtatagagaaacagaagtggaagaagagctaggaaagcacagcgcatacgacggtcacctaggatggagcaccaacaattgcggaagtacgtcgaattgtacaataaggaggtcgaggaattctacaatggtgccgcgtcaggccgcccagctgagttccatccttccaaagtacatgtaaagagcatccatgaaaaggcgggtaccgccaatgctggtgtagaaatctctagcgttggtgtagactgggacagcgaggagaagaatacctttttctggtgcctttcacgctatagtatccaccgtgtagacgagtggcgctcattgttgcctcggaagagcgccatggagattctaggttattacaggttgttaaggagagcgagtgcgagcgcgagatcgcgtaaggcgggtgacgacggagcgcccattgcgtacgaaatgagcgctgagtgggttgccctggagacaaaactgagcgagacagtgatggccatcacggaaggcgcagccgaggttgccgatgaggaaggacactgcgagggccttatcgattatgaaagctggaaacgcaggtgggtggccatctactcgcacagccgtatcgcggagataagacccttgccccgccacgcgctgccgctatcgcgcagcgcgacgcagactttggagcgctgcgtaagtcgctacacacgtacattgctgtggtgcacggcccttgcgggtatggcttcccgcagcgtcagcgccagggcggccgaatctcgaggacacaagtcgctaccgacggtggtaactcgccggcaagttgagcgtgcactatgcacagaagcccgatcacgtgacctacacgtgcttccaaggcgcattgttttgacactgcgcaaatgggaactagactatccgcgagagggcaaactgttccgcaccaaggagatggcacatctgtttctacaaagccagttgtccagacgggatgcgcccccagtccatcaagacgaaaatcaagaaaatcaagaaaatcaagaaaatcaagaacaagataacactgcaagtgaaggtgaaagcgaggcagaaagggatgaaatcgacgaagcggacttgttccgatcagcattacatgaaaatcagttgctaaaatggttatccaaatgagacacaatgcgaaaaatcgcgcagggacataatttttgttttcattattctttcgcttattccctccgttagctccaccgcttttttgattggaatttcctttcggcaatggctttccggttaccacgcctcgggtttcgcatcccgaaaagcatatctacacaagaaaaatgaatgataaacaattgatgagtggcgctatttcccttatcatctcattattgtacttagtatcgtctattatcaggagaaatcgcatgaactaagcccattttctcacccttctgccttcttatataaagcttgctgggaaccgaacacaaactccacaagtccgtagcagctcttctcttttgtcttttatatatcataaacatcgctacatagtaataacactaacgcacgctagaaatgatagcttccaaaagctccttattagttactaaatcgcgcataccctctctatgctttcctttgataaagaggtcctatgtgtcaaagactccgacacactctaacacggctgctaatctgatggttgaaactccggccgccaatgccaacggcaatagtgtgatggcacctcctaactcaatcaattttctacagacacttcccaagaaggaactattccaactgggattcatcggtattgcgaccttgaacagcttcttcctgaacacgatcattaagttgttcccttacatccccatcccagtaataaaattcttcgtctcttctttatactgtggcggtgagaactttaaagaggtcatcgaatgcggcaaacgtctgcagaagagaggtatatcgaacatgatgctttcattaactattgaaaattccgaaggtacaaagagtttgtccagtactccagtagaccaaattgtcaaggaaacaatcagctctgtccacaacatcctactgcccaatattattggccagctggaatctaagccaatcaatgacattgctccaggttatatcgctctaaaaccctctgctttggtcgataaccctcacgaggttctgtacaatttcagtaatcccgcctacaaggctcaaagggatcagctgatcgagaactgctctaagattacaaaagagatttttgaactaaatcaatctttgttaaagaagtaccctgaaagaaaggccccatttatggtttccactattgacgctgagaagtatgatttgcaggagaatggtgtttacgaattacagagaatcttatttcaaaaattcaatcccacttcatctaaactgatatcatgtgtcggtacttggcagttgtacctaagggactctggtgaccatattttgcacgaattgaagctggcccaagaaaacggctataagcttgggctgaaactggttcgtggtgcttatattcattctgaaaaaaaccgtaaccaaattatctttggcgataaaacgggcactgacgaaaattacgatcgtatcatcactcaagttgtcaatgatttaatcatcaatggcgaggattcttattttggtcacttggttgtcgcctctcataattaccaatcccaaatgctcgttactaatttgctaaaatctacccaagacaactcttatgccaaatcgaacattgtgttggggcaattactaggtatggcagataatgttacctatgacctaattaccaaccatggcgctaaaaacataatcaagtatgtcccatggggcccaccattggaaactaaagattatcttttgagaagattgcaagaaaacggggatgctgtgagatctgataatggctggccattaatcaaggccatagcaaagtcgattccaaaaagagtaggcctatgagaggactataatatatactccaatttcaaagacaaaccaaaaaaccaaaaaaaaaaaaaagtatgcatacataattctgatgttctagttatacatattatatataagtaatgataataacactaatagtaaagtaaacgcacggatatcaagagttaatatacttgaaccacttaaataacaatctgttggtaaagctttcttcctattgattatgggttcgaatagtaccagatgttttgccaatcctaaatcggtaggaaagtggcttgtcgtcgtcaggcttattatcaactcttatgcacaagaaaggtactcatcttctataaactacataagacctgaatctaatcaaagggagaaagcgcagaacatcagatttaaagcggttttgcttgatacactcagccttgtctctttgtaaggattttggggtacctatgaataatacatctagtagtgttagtaaaccaacgtatgggattttgggatacatagttttccagtgtttcttatccgtgatagtttaatggtcagaatgggcgcttgtcgcgtgccagatcggggttcaattccccgtcgcggagaatttttttaagcttctattaaagaagctttttttcacttatatctgatggatgatgaatagctagttcaaacggaaatctttgataaagctatatcaaaattcaaagcccaataagtcagtatcatgaagtttatagcattaatatcaggtgggaaggactcgttctacaatatttttcactgcctgaagaacaaccatgaattgattgccctgggaaatatatacccaaaagaatcagaagagcaagaattagactctttcatgttccaaacagtaggacatgacttaatagactattattctaaatgtattggtgttccactatttagacgctcaatattacggaacacttctaacaacgtcgagttgaattatactgctactcaggatgatgaaattgaagaactatttgaacttctaagaactgtcaaagataaaattccagatttagaagctgttagtgtaggtgccatcttatcgtcttaccagaggaccagagtggaaaatgtttgttccagattgggtctagtagtgctaagctatttatggcaaagggatcaagccgaactaatgggtgaaatgtgccttatgtccaaggatgttaacaatgttgaaaacgatactaattcaggaaataaatttgacgccaggataatcaaggtggcagcaattggattgaacgagaaacatttaggaatgtccttgcctatgatgcaaccggtgttacagaaacttaaccaactttatcaagttcatatctgtggagagggtggggagtttgagacaatggtcttggatgccccttttttccaacatggatacttggaattaattgatattgtcaaatgtagcgatggtgaagttcacaatgcaaggttaaaggtaaaatttcaaccgcgtaatttgagcaaaagttttttactcaaccaattagatcaattacctgtaccttcgatttttggtaataattggcaagatttaacccaaaatttgccaaagcaacaagctaaaacaggagaacaaagatttgaaaatcacatgtcgaatgctctaccacaaacgacaatcaataaaaccaatgataagttgtacatctctaacctacaatcacgtaaaagtgagacggtcgagaagcaaagtgaagatatttttactgagctagccgacattctgcattccaaccagattccacggaatcatattttatctgcgtcattattaattagagatatgtctaatttcggaaaaatcaacaaaatatacaatgaatttttagatttgtcaaaatacggacctttgccaccatcaagagcatgcgtaggttcgaagtgcttgccagaagattgtcacgtacagttatcagttgttgttgatgtaaaaaatacaggcaaagaaaaaatcaacaagaataagggcggactacatgttcaaggccgttcatattgggctccatgtaatatcggaccatattcccaaagtacttggttaaacgatgatgcaaaccaagtcagttttatcagtgggcaaatcggactagtaccgcagtcaatggaaatattaggaacacctctcactgaccaaatagttttggcattacaacattttgatactttgtgtgaaacaataggagctcaagaaaagttactcatgacatgctatatttcagacgaatcggttctcgactctgtcatcaaaacatgggcgttttattgttcaaatatgaatcatagatcagatctatggatggacaaatctgatgatgttgaaaaatgcctagttcttgtaaagatttctgaattacctagaggcgctgttgcagaatttggtggtgttacttgtaagagattaatagtggacgataatgattccgacaagaaagaaagggaagagaatgatgatgtttcaaccgtattccagaaattgaatttgaatattgaaggttttcataacactacagttagtgcgtttggatataatagaaactttattacgggatttgtagatagtagagaggagttagaacttatcttggaaaaaaccccaaaatcagcccagattaccctctattataatcccaaagaaatcatcactttccaccatcacattggatactatccggtggagaaactttttgattaccgtggtaaagaacaccgctttgggttgcatattcgttcctaactccaaatgtaggccttatattttataaacttaatagatatacgctgtccacgctcctggcggtgtaaatgatagacagatcccaaatatgttagcaaatcataggaacaacaccatattgtgaacacgtaaaatttagaatacgccgcacaattaaggtgtgttctgtaataatttgattattgatgatggtttaggaaccaatattcatataaaaaaatgatcattctataaaataccttatcgtaacacttgtaccatgctactaacactgtatatatttctgacccctaagaaaaagcacctgaataagctaaagaccaagttaagctttgcccattgtctaggaaatttctgttgaaatcaggttggctgaaaaagtcgtacgaaaattttggatcaagcagagccatatttaacatgattattcctttccaaccgtcattcacttgatcaattatcggctgcattttttcttcccactcctctttgacaaaatttggtgttctgacccatgaagatgctgatgttataggaatggcgtgaatcatatgaatgtattgaggctccatgccaaaatacgtggcgtgatcaattttattttcgaataaaataccactaactttattaccaataaattctttcggttggacagtattattgctttcgtataggaagtagctctggaaaacatttctcatgatgccgagttgtaagttcgctatgtcagttaacttagaatttccagttaccaacccccacaattttatcgcatagcaagaattgacatcttctgaagtagattcttcatctttaccgtcaccacttggaaatagtcctttggcccatgaatggccattaaaccaatcaaatgacctaaattgagggaagtacggatcatcgttgtcaacaccagagtaatctctaattaagcactcaacccaatctctattattttctaaccaggagttgttagtaactccacttaaatcagaatcgactaaagagataatggcagccgttatgacatgataagagtaatgaaaatgatgatcattataataagagttaccaaagtcttggctagaagagcctgatgaaattatgcctttccaactaacgtcgtaatttaaaggtaagacttgctgattgctgatgaatctctccattgcaatagtcagtttagataataattcttttgttaaattttcatcatgaaggatgtaatgtgtcacataaagaatccacgcatactttgcaagtatcttaccagagaaatacatagaatctatgtttgattcttgttgagggtcactcaattgaacttcttgaacagcagcttcccgaattttagatagcttttcttgactgtaatctgccttcttattcaaagataacgcgacaggttcaaagcccaattcttgaggtacttgaacctgcatatcaaaactgtttgtgagataaccagtcattaagcctttaactgtggaatccaggcttgaggcaatttcacgttcctgcatttctggtgtgaatgccgctttatgatgtggtaaagcatacattagagtagttccagactgcgagtagcctgcaaccgtatagttaaatctgtaatttgtgaaatgttcatcaacagtttgccctgataggtcacagtatactggataacagcccgctgccatgtcaatactggggacggagtctgcagataattgacagataagaccattgattttatgagatgatattattgtattgctgtcgagtaatgaaatttgaaaatcttgtggaaaagagtaatcaggtgaggtcaaataaagtatccaattcctattattctcaagttgtatattatatttaccatatctttcattcacgcttatgcgctctaagctcctgaaaccaacggcgcttcttaattcaaaacccaaatcgtggtaaatagccgtgacaaagcccatcccctgaaccagcgggaattctataaactgggaactactcaaagacattagtaagcacatggacatatgtttcatatcccggaattcaagcttgatatcatttgaagagacaaattccctggccttgaatacaaatgattttatatttgtgggattgaagtagaatctgggaggatttgtagttgtatcaaaaaccctttgagacgctaaagtatgattggcggccaaaccaaacaattctggatcacgagaaaaccaaattgaataaggatgtgtccatataggttgtgtattatcgtctaataacatgtttgtgtagaacttgtttgtctccaatggatcaacagattgatcatcaatattcggctttggtaccgggtgttgaactttgttgaagacggaaggaggagcttttaagttagaaaggacaggtgattgaaaaatattgtcactattcacctggctgtcagctaaagggttagaactgcttggtgtgcgcagtgattcacctgccaccctattttctcgaggtttactggagttctcagaagaacaaactggtggctgaacatttgcgcgaggtggtaagggaggaggtcctctattggtagtaccgccaggtctattaggaacaggtggaggaatggcttgcctactgtaacacatctttttacttctcgtatttatttatttttgtttttatgatactagcacttttcagaaattcatgaattttatttatggttccaagaaaaaaacttcaaagaaatgagtactagaatgatatatccacaaaaaaaaaaagagcagaaacaaaatggatgagatggataatgtgatacgatctctggagcaagaatatcggttaatattgctcttgaaccataggaacaaaaatcaacatagagcggctagctggtatggatcgttcaatgagatgaaaagaaattgtggacaaataataacgctttttagctcgagaagattacaagccaaacgccttaaagatgttgaatgggtcaagttgcacaggctattacagagagcactttttagacagttaaagagatggtactggcagttcaatggcgtaattgcgctgggacaatttgtaacgttgggttgtacactagtaacattgctggcaaatgtgagggcactgtatatgagattatgggagattaatgaaactgagtttataagatgtggatgcttaataaagaacttaccgagaacaaaagcaaaatcggttgtgaacgatgtcgaagaacttggagaaattatagatgaagatattggcaacaacgttcaagaaaacgaactagtgataacgtctataccaaagcctctgacagagaactgtaagaagaaaaagaaaaggaaaaagaagaacaaatcagccattgatggcatattcggataaatatacaagtaaatagactttttaaaataataatatcaatgctaataaatcattcattaatgaccttgtctgcccaagtaggcaaaacaaacgcactagaatgtatttgaggattatagtacttcagcttcccttgttcttgctcagatatctttctttgcggaatgttcaacggtatattggcgttattactgcaaacaattaaacctaattggccagatgtataggttggaaccatggtatagcaatattctgtattaggaaatacctttttggctgtatttttcaaatcatgtaagtattttaaatttaaccaaaaattttcagagctttgcataataacaacgccattaggatttaaagcatctttcaatagttcgaaatacctctcttgaaaaaacgcttcagctggaccttcaggatcagaactatctgtaataatgacgtcaaatttcttatggacgtcggaagcacctatatcttgtaagaacttgaagccatcgcaaagtttcaagtccaacctttcgtcatcgaaagcaccattactcaatgtgggcaagaacttacgggataattcgatcactgatgagtcaatttctaccatagtgatatcttctacacagctgtgcttggctacttcccttaagacacctccgtccccaccgccaatgataagtacacgcttgggattagaatgcgcaaacatggcaatgtgggtgatcatctcttgataggcaaactcatcaaattccgtacattggacaataccatcgaggaccaaaacagtaccgtataccttgttacggaagattaagatgtcctgaaattcactgcgggcttcataaagtattgagtccacggtcatagtaaaggcctggcccggaaaacttttatcattaatctctctaaaccatccatctttgatgtaaggatgctgtgaattattaaccataatgtataactgaatctgtcactttatcctgcctgtctcatcggcgttttgatattttatttttaactaaaatcagcagcaacttgaaaaattttgagataaccttaaaaaggatctagcaataaagagaagctcgaagtagccatggacactgaagagaaaaaaaagactacagcgtcagtagagcatgcccggatgttgcaaaatgaaatacaacagttatttgctcagttgcgggatacgaattctcaaattcgctgcgatcttaacgagtttgaacaaataaaggaatcatctacaacagcggattcaaccacgaacagtgcgaactgataaatttatattcaaatatattttacataaacaatattaatatatatatatattccccctacaatgatgaatgcgtttctgccgtcacgtttcctattatcaccttctcttaggtcctcttattggtggcataggtcttgatgagttttttttgaataatggtgcattctttaagagatctggaacaacgataaatttgatctgtgacccacgtacgaatatttgatccatgtgtgttacagccccctggggctctgtagctattacatctcttagctgtacgttcatgctatcttcgctttcaacaagtttaccacgataagtcgctcccgttgttagctccagagaaacgatatgtccctgtgcctcatttaataatttcactggtattccattcatagtcattgtttctgatacgtgcctcgcagcgctttctgattctcttcgtattgctcttataagaattttttaacgatttcaaaaatatcaaatctatagaacgaaagaaataagaagctgccatccctagaaaagtaaaaactataaggtaccaagaagtaaaaagagaaatatagggatataatgataaaaacacgtatagaggaagttcagttacaattcctcacagggaataccgaacttacgcatttgaaagtctccaatgatcaacttatagtaacgacacaacggacaatttacagaataaatttacaagatccggccatcgtcaatcactttgactgtccattaagcaaggaactagaaactataatgaatgttcatgtttcaccaatgggtagtgtcattcttattcgaaccaactttggccggtatatgttgctaaaggatggcgaattcactcaattgaacaaaataaaaaatctcgacctcagctcgctacattggatcaacgaaaccacctttctgatgggaatcaagaagacgcccaagttgtaccgagttgaattgacaggaaaggatataaccacgaagctatggtatgaaaacaagaaactctctggtggaattgatggcattgcgtattgggagggctctctgctattaactataaaagacaacattttatactggagagacgtgacaaatatgaaatttcctttagtattaccagatgaatctgagcaatttgaaaggttaaaacatcatgcgataaagaaattcgattcgtacaatggactctttgcttgggtcacatccaatggaattgtctttggtgatttaaaagaaaagcaaatggaaaaagatcctgcttctaataattttggaaaattcctatcttcgtcgaaggttctactcaatttcgaactgcctgactaccagaatgataaagatcacctcatcaaggatatagttttgactgctttccacatcctgcttttgagaaaaaatacggtaacaatggtgagtcaattaaataacgacgtagtgtttcatgaaactataccgagacaccagttgactggctccaacactgatagtaatgagaaatttttaggcctagtaagagattcggtgaaagaaacgttttggtgtttctcaaacatcaacgtctttgaaattattatcgaaaatgagcctaattcggtatggaatttattagttcgggataacaaatttgacaaggccctatcgttgaaaggcttgacggtgagggaaatagaatctgtaaaactttcaaaggcaatgtaccttttccacactgctaaagattttcattccgcggctcaaactttgggaagcatgaaggacttgtcacactttggggaaatcgcattgaattttctccaaataaaagattacaacgatttgaacgtaatattgataaaacagttggataacgttccctggaaatcaactcaagtcgtcttgtcgagttggattatttggaattttatgaaacaattgaatgatattgaattaaagataaacacaactaagccagcttctactgatgaagacaatttgctaaactggaacctgaatctcaaggagaaatcgaatgaactaacgaaatttttggaaagccatctagaaaaacttgataatgaaaccgtttatcaaataatgtccaaacaaaaccggcaaaacgaattattgatttttgctagtctaatcaacgatatgaagtttttattatcattttggattgaccaaggaaattggtatgagtccttgaaaattctgcttacaataaataaccatgacctagtctataagtactctttgattctcttattgaattcaccagaggctactgtgtcaacgtggatgaaaatcaaagacttggatccaaataagttaattccaacaattttaaaatttttcacaaattggcaaaataattctaaactgattactaacatatcagaatatcctgaaaattactcactgacatatttgaaatggtgcgttagagaagtcccaaaaatgtgtaatccaatagtgtacaattctatcctttacatgatgattactgatccgagaaacgatatgatactagaaaatgatataatcaaattcatgaaatcaaacgaaaacaaatatgatcttaatttccagttacggttgtctttaaaattcaagaaaactaagacctcgattttccttttaacacgtttaaacttattcgaggatgccattgacttggcattgaaaaataacttgattgatgattgtaaggtaattgtgaatgacgagattcttatagaggattataaattaaggaaaagattatggctgaaaattgcaaaacacttattactttcaatgaaagacatagatataaagcaattaattcgaacgattttaaatgattccaacgaaattttaacgattaaggatcttttgccattttttaatgagtatactacaattgctaacttgaaagaagaactgatcaagtttttagagaatcacaacatgaaaatgaatgagatttcagaagacataataaactccaagaatttgaaggtggaaataaacacagaaatttctaaatttaatgagatttacaggatactagagccaggtaagtcttgtgatgaatgtggtaaatttctacagatcaaaaagttcattgttttcccctgtggccactgttttcactggaactgtataatcagggtaatactgaactcaaatgattataacttgaggcagaagacggaaaacttcttaaaggccaaaagtaagcataatttgaatgatttagaaaatatcattgtagagaaatgtggattgtgcagtgatatcaacatcaataaaattgatcagccaatatctattgatgaaacagaattagccaaatggaatgaatagtagtattcttttttagtcaggctgaaacactgaaattaaaagagggaagataaatatcattactattatctgactaaaatatgtgtcgagtatttacttacctaaatagccaagaagtaaaaaaaatgcgtatcaaaaatgaataaaacgtaaaattatcggggaaaaaccttgtattttcaaagagtaataaaacgggtgaattaaaatcacaatatatgtatggctgaagttcaacataagtcataactagagaaacttcttcttgcccatgagttaatattccacctcataattccgtaatctgtaccaataatcaaggagctcccattcctatcttcaacccaatcgatacctgatatattgttttcttctgagaattcgttactttcctgagttgtaatcactggtcttctcaaaaaattggatgtgcctctattattcctactatttgcagcaaaattgtcatcatctgacggtaagtctggcgttgaaggtggtctgagaaaactttcaaaagctcttgcggaaacaccatgatagtctgaagaaacacgatacgttgagtgaacatcattgtaagcttcataatattcatcatcttcaaaaacatcattactagcttgctggtgagaaagtattaaggggtcaattaaattttgaggtgcggaatttgacgacgaagttgcgatagaatcagcagcaggtgtgccaagacttgcgttaacattgttattagaataatcggcggttggtgccgaagtcgatactctccttaccctgaatgaacatcgtctcttgtatggatgagctacgtcacttgatgaactacctttcgtagaaaacagaaccgattcgttactaattttatccataactttcggaaaaggtagaatttgcggctccaaatacttttttgggattctttgagccatagttatccatggttctgtggttacatttggcatagagggcagcgaaaatcttcttcttgataaagaccgataatccgccccttgtaattcatttttgctatcattactttcgttttcgttgttattatttgtggtgaaattatgatttgtattatgcttccgttcgtttatatattccatattaactttatcaggaataacaataacttggtggttaacgtagtttcttgtatctacaacgtgtactctgccctgatgttcagaaatgaataataaatcatctaggccataactgaacctacagactctaaatgcaccgttgtgggaatgtggtctagtcgaactaatttctgccatgggagtagccatgtttctgatatcataaattgcgcaagtaccattttgaaataccgtcgcaaattgcaagtcgttttcggaaaaagagttataaaacccatggtctgaatttggagcttcatatatgttttcgatatattctgattcatcaggtaacgcaaaccgtggtatccgtctaacacgattgacagaactaccccaggaaggatgattatcgtaatgtaaggagaattggttggttaattcattttgattgtaaacagcaaatttattagaatcgccagacactaccatcgtttgaccatcatgtgacaaagaagcgttattcaaaggaaattttaaatccgcataacgcttcactagtgttacatctctattacttacatcgcattggtaaagatgaccatcattgttgcatgcaaaaagatcaaactgcatactggccctgtcataaagtgtgacacaattattgatgaactggcccaacgtaaaagtcatcattgtgtccgtttcttgattataaaactccacgatgcccttccagatattaggatttgaataatgtgaatttatagggaaactaatatttttggaaatattaatcggttgggaaggtggcggcaacgaaatatttgcatcttgagctaaacggttccaattagaagggaatcccttatcatcagaaccgattagaccaccacaaacagtcaacccatttaattccgtgaaacatctcggcttaaagttgaactctaccagtttctcggaaggaacatgtaaatttttggagatatacgagcccgttgtcctagaaccttttgtagacgttttttcagtagagtttttaccactgttactcggttgaatagaattatgtcgccttactggagacctcaatacggaagaatccgtatctagtactcttatcgaatgatcgtaaatataatacagtttactctggttcatggagcctggtttgatacaatcccgcaactgccaatggtttatggagaccttggcatcgtagagttctaaagcaggcatcatatagttttggtaaaccttatcagagccagtatttaaccgttcatcttgcagcgcctccttagattgccccgtgccatcaatggtcattctttaacacgtatacttttgtaacttattgctgtttttctaccactttattcgatcttacttgtcgttgcttaatcagcaaaagttttgtactagaataaagttgtaataggcttttaatccagagtctcctcctcctcactttctgatcatcaccccttattgcctcagaaaagagatcatactccgctttaaagccgttcaatgtcacgtgacacaaagttgtagccgtataacatatggcgctaccatgttgttatttagacgggtaacatcaccgtttagaaagataaaggaaagtgaaattattggaatggaaagtgttcccaaaagttcgcaccaacgcaaaaagaaatttttttttcaattttgatatcatcgttgcgtagaggaagccctaactgagtagagaaattatatggtattttccttgtaatatttgattttgagtcgatatcccctttgttcttcttccttccttcgcttgttttagttgtatacttggtttattgtggaagatttttttttctgcttcgtagttttaaattagaagttatttctttgcaaatttctcttccccccacagtattcttttagaggtgaagtagaaataaaccaagaaagcatacacattttattctcaatgtccaacccatttgatttgttaggtaacgacgtcgaagacgctgacgttgtcgttttgccaccaaaggaaatcgtcaagagcaacacttcctccaagaaggctgacgtcccacctccatccgctgacccatccaaggctagaaagaacagaccaagaccttctggtaacgagggtgctatcagagacaagaccgctggtagaagaaacaacagatcaaaggatgtcactgactctgccaccaccaagaagtccaacaccagaagggccactgaccgccactctagaactggtaagactgacaccaagaagaaggttaaccaaggttggggtgatgacaagaaggaattgagtgctgaaaaggaagctcaagccgatgctgctgctgaaattgctgaagacgctgcagaagctgaagacgctggtaagccaaagaccgctcaattgtctttgcaagactacttgaaccaacaagctaacaaccagttcaacaaggtcccagaagctaagaaggttgaattagacgctgaaagaattgaaactgctgaaaaggaagcttacgttccagcaaccaaggtcaagaacgtcaaatctaagcaattgaagaccaaggagtacttggaatttgatgccacttttgttgaatctaacactagaaagaacttcggtgacagaaacaacaacagcagaaacaacttcaacaaccgtcgtggtggtagaggcgctagaaagggtaacaacactgctaacgctactaactctgctaacaccgttcaaaagaaccgtaacattgacgtttctaacttgccatctttggcttaagccttatatatgaataattccaactgaaagaatccaataacagtgttctactttctgtttctattactattattattttaattggttatttactatataatttgcaagtgaagatgatcatgctggcaaaccaaagaataaaattgggttgacatccaatcgagaatatgacatatcattttgttttatttaagcaataaaaaataaatgacttttaatttacttttcaattttctttttttttttttcacttctgagatgtgcaagcgtgtagtttgtttgtatttgtataacaatttcatcattagtcattcttcattaaaaactttttgttatcgattaaggacatccagtatgattctttttctctcatcttgattatctcttgagagtattgttaggcaacgcattataccacagttttttttaccaaagcgagcggcactccagcaggtgcttcatgtagtattcaggtatcacatcgctatattttaagtttctgtcgccgttgatcattcctatctcccattcacttcttccgttcggttgcatctgattaccatagtcatgtagtccaactatcaaatcttcgtgccctagttctccttttaacttttcgtccattagtccattagctatacatgaaacgtcgaataatattttacatgtgagtccccacaaatccctgaatctgaaaatacctccatcaacaccgtcttcgtctgaacttgataaatcctctatggtttgcaaccatggcatttcgttattatttgctacgtgaaaatgataatgcataatcaaccattttattccaccccaattaagcttatactccttccgctcaaaatattctgcttgataactcttaacatcctcatcggcttcaggaagaagatgtataactaagtcattgagtggtacagaaaacaaagaagatgtttctccagggttcagcttaccaaaaaacttacggatatctaagggaactttgtatttatcctcatgtttttctaatttatctttgtaaagaaaacagaccattggcttaacacttaaaaatgttcttgataaatagcatggcatatccatgaccaaattgtctaatttcattccgaactccttatgcaagacctcaggatcatgcggtaacccaatctcctcttcagcttctcttctggctacgctttcaaaggtttcttgaaaataatcagctttacctccaggaaatgaaacatcacctgagaagcttctcaatgttcttgaacgtttagttaaaagcactcgtagttcgcctttcattccaatgaataatagtattattaccgccgaatttcttttgaaaggccatattgagctccgagtatatggtgttttatgaaatttgtatcttatcaagttctctattagttgctttgaactcagcatcctcctctgacttaatatcattacagcttttctgttacatgtgtgattctcttcaaatctacaatattattattgaattgttataaatatacttacgcggatccccccccacaaccctaccccaaaaaataaatacaacgaataaatacgcgattggaattcatcgctacttttgaaaaaacagaatatataagttgataataagctactcttgtatatacctattcgcctagggatataatcaaacttttaaatcgacctttaaggtatatgtaacaacaaacgccacagtgatgaaaagaatcgcatactgcatgacaaataagacggacaaacagttcatttgaatgtgatcaccacatgctggcgtataaaatgctgtgaaatatacttgagcagtagcactcggcatggaccacgttaatatcatgtcaaattttcctatgcccgtatccagccaatcgatcgaatatagtttatttacccataggacgccaataataggaatgacaattaatcgaaagcatgtcatcaataaggcggatttaataaatccaggtggcaatgacttaatttctaatcttgccaacgttccgccaagtaatagaagccccaatggaacacatgcatttccaatatactctgtaaaatccattaaaaaattcagaacaggttctccatcaggcgccttatgaacgtgaacatatgtcgttacgaagcatgctttaacccagggaattaatgcacatattattcctagtattgcccccagagatgctggcctgaggcaatttataataaagtactgcaaccatttgagattgtgtctctctataaagaaggagaggctacccctcccgtcggtggccatattagtgcaattttcttcttcgatggaactttcatcggtataaccagtgtgcacattaccaatacttgcgttcctgcttccaacttcttcagtcaaggatagtggtcttgataaatctaattcaccttgccttattttttcggcggcactgtatttggaaatcaactcattcatatccgctttcctttttcttctataacttctgccatcgctattttttgatatacgactatatgagagggaactgccatctattcgcgagaactccaatgcgcctgggcttgaataagtcgaggaaaccctatatatttcagcatgcggaaggtcactttcaaatttatgggatgcaccatttgattctttatagggtttgatgtagccagtaaaaccttcgtagaatgcctgcggtgtcatttcatttgtagtaatagagttacaagacaaatcgctattacttctcgcatcttccgattgataggcatttgtaggacgtgtgatattaggtaactttgttatttcagtaagtttgcgatcgtcgatagcgggacttactgacggagtaatattctcactatctggttcttttgtatctctaaaatcaagtccgaccactctccacattccaaaattcatcattaggaaactttgaataaataaaaaaatgcaggaataagcaacacctttatcagcttcttcagcagtaaaaatggagccgttacccatgctctgaatataggcaataggtaaatctgatatatttggaaagaaacccgcaaatatgagcccccagaagaattttttgggcacagtcgtagcaaatgtagtaaataaggcgcccgtggcacctaaaacaaacaagataaaagctgaaagtattatcactccaatctcctttatatccctccatgaaatattggacacaattttgttgaaggtcaaacaaggcaaaatagcgttaacaaccatatttgatatacctttcgcattttccatggaaacaatatcgaacttagctaccaaatagccaacaagcataatggtgtaaattttaaatataggttttaatgcaatgtaaatagcggcacccagagaaagggacatcttggttcatttattgtagtactagaaaatcgtttccaccatataaaaatgatagaccttgatcagacacatgtagaattaccgatagaagaaatactatatgagtactgtaacttgttttacctcttatacgttacacactttgatgtaaatatgactcaccttatgtaccagacattgacccaaaaatacagatatacaaaaggtgaaaaaagatatagtagttcctcgacgtatgcctacggggaaaacaatatagatggaattctataacaccgacagtgatgtttctcctgaaatttgtgccaaatagcgccgcggaaagtcggcacattttgcaacatggacttcggaggtctgatatcatcccgtaaccttctcgtaatgcatcagattctggtcatgcttgttcaatatacatcctacgtgcacaacgaacaatagctttctcggtatcttattcgattatccccgaagtttcttgaaacggcaatatccttttaccctatcccgggcgaagaaccccgtcacagtgcattactttattcccactatagggataacaggggcgattgtgtacgaataactagattgtatttagataactaagatatatgataagtgcgtaaaaatggatatatctatacatatatatcactaagtgcataaagtctttgtattttcgctttcctagctgaccagtaaaagatcttgttttttaactgatggataaatagtaatttataactgaatagagcaaaagttgggaaaatagaaaatagaaaacagaaaaggagcgaaattttatctcattacgaaatttttctcatttaagttatttctttttttgagagaaaaattggttctctacagcagaaatgatggcaggtacaacttctgggttggccaaagtagttaggtcacctagctgttcggcttcgttagaagcaacctttcttagaactcttctcataatctttcctgaccttgttcttggtagatctctaactagaataatggtttttggtgaggcgaaaggaccaatctcacccctaacttgtaagatcaattctctacgtaaattatctggtgtgatgtgttctgcatcaccttcagtagcgttgttttgtagataaccatcttttagggaaacatatgcaacgacggtttgaccggtcaattcatctggaataccgacaacagcagcttccgagacgttttcgtgatttgagatagatgcttcaatttctgatgtggataatctatgaccggaaacatttacaacgtcgtcaactctacccctgatccagtagtaaccatcatgatctctaccagcaccatcacctgtgaaatagtgaccaggataaggtttcaagtaagtatccatgtaacggtcgtggtggttccaaacagatctagccattgatggccatggtgatttaacggcaaggacaccttcgacatcattaccttctaattccacacctgtaacagggtcaatgatacaagcgttaataccaaagaatggcacggtagcagaaccaggttttgttgggacagcacctgccaaaggagcaattaaatgagaaccagactctgtttgccacatagtgtcacaaatgacacagtttttgttacccactttttcatgataccattcccataagtctggagagattggttcaccgacggaacccaagacacgtaatgaggaagtgtcatatttggcaatttcggcttcacctacacgtttgattaatcttaaagcagttggagccacatagaaatgggtagccttgtgacgttggataattctccaatatctaccataatctgggtaggcaggagtggattcgaaaattattgaggcggtacccaaggttaatggaccatatagagcataggtgtgacccgtgatccagccgacgtcaccggcagtgaagagaacatcttctgggtgaatatcaaaaacgtatctagttgttaaagcggcacctaataaataaccacctgtagtgtgaacgacaccctttggagaaccagtggaaccggaagtgtataataaaaatagaggatcttcagcgtcacatgaaacaggaggtaggtaagttctctgcttagcggcctcctcatgccaccagtaatctctaccggccttcattggaataccttcagtaccagttctttggaaaaccaagatacgggaaaccaaatcgactccgttcaaaccttcgtcaacaatttttttagtgttgatggtcttaccacctcttttaccttcatcacaagtgatgaccactttagaattagcgtcaacgacacgatctttcaacgaaccagcggagaacccagcaaagacaacagagtgaatagcaccaatacgagccacagccaacatagcaatgaccgcttctggaatcattggcaaatagatagccactgtgtcacctttcttaacgccccagctttttaagacaccagcgatttgggaaacttttctgagtaattcaccaaatgtgatgattttgttgtcggattcgtcatcagcttcatagatcaaagctggcttgtcgggattagcaaaggcatgtctgtcaacacaattgtatgatgcattcaatttaccgttcaaaaaccatgcaacatcaccattgttcaatgaaccagattgaactttggtgtatggagcatcccaatgcaagtattccttagccatcttatcaaagaatttttctggctcattgatagattgttgatacatttcttgataatgttgcatatcagtaacgtaacccttgccgggttggctgttgtaaaaatgttgaggagccttaagagcctttacgttgtgagcttcataaactactttatgttccttgattgtcatattttattattgtattgatttactttcctgtattctgtttgtgtataacaatcactaaccgcggagacacacaattcggaattcgaatactatatatatatatattttaaggtagaggtatatataaggtttgatcaggctaaacgtgcggtgcgatatcgttgctaaaattcagaacactgttttcaatctcgaagtaaaaaacgataaaaattatcaacaaaaccagtgacgaagaagttcagtcacgaaacttttttgcctcgttcaaaaaaaaaaagccagcggaatcggctaccgaatatcggcaataacgcttcggccccgggaaacgcatatgaataattttaagttagttttatgctatacagcgggtggctacgtgtaatgtatttaatgtttatatttactgatttatgacatcgatgagggagatcaattcttgcaatcgcgccaattcgttgcgatcagtgccctctctttcgtaattattcactgaaactatcttgccagttattgtgtttcccgagaggatggcgccattactgaaggtattactagttgtgttatcgctactggaaggcgtcgcagacttttccctcttcagttccttgccacgaaagtaaatagtatcttcgaatttgtaatccttaaactcttcggttggtccttgatactcggtatagaaaggcatgaagctcacggtgtaagcatctagattcacggcatctttggtcattgcgtatttgacctacttactgtattagtacacacttgtattttcgggccttgatggttttgtttcactgcttgtttgcaattggttgttgttcctaacgcgttttgtcatttttcgatgaaggtcgaacggaaagaactaaaaaagactaggggaatggaatgcggaatagcagtgcatatttcaggatgaatggaaaaacacatctgcagcaacaatgaaaaaccttagtggatttaaacttctcacaggaaatatcgatcaaagcaatgggctagccaaataaaaaaaaaactgtaggcacaaaaagcagcatacgtcattcgcaaaaaagaaggtcctacccggattcgaaccggggttgtccggatcaaaaccgaaagtgataaccactacactataggaccggaacttcttgatgatacgaacgattaaaattgttgacgttctcttctttttttcatatttgagtagatctgatgcgcaatgtctatacaacctggcagacaattgtctaaataatattttgtaggaataagagtccactatcgtctatcaactagtagtcacactaccaatatattatcatatacggtgttaagatgatggcataaggtatgagaaactgtcatcgaagctgaaatgcaaggattgatagtgtaataggataatgaaacatataaaacgaaaagagaaataatcataacattatttcctagagtagcgattccccttcgcgtattcttacatcttcgaagagaacttctggtgtaagtataataaatattatagctctatcgaatggtgcaattatttaccaaattctcaataggaatccataatactacatacgatactaatattctagtatttttatacttattatttcttttttattacaccagcaatcgttgcaaattatcttctgatagaatttctgagggtatcctaaacttatgccattttcttggactgtaaatcatacttggatgttgtgcattagtcaataatcggttcttgttccaacgattacatgtaaatgaagggagaaataattatggtaaatcatgcggcggtccttttggtgatgcagtatccatagtcactacataacaatcttagtcaccttgtattgattcaccacataatcctgcagagcccgctatgtccttaatctgcgcgataactctcctacccctgaattttgagagcgccatagcaaaccgataaagctggcacaattaaaggtatcggtgttgtcagaattaggtgcctcctgcttttttttttttcctgctcttatatccgttatatccgaatgatttttatcgcttgtttaaaaaatactttcccgatatatatatatagtctccctttaaatttgtttccggtaagtttttaacaccaataaatgaaaagaaatgactacggtgatgaatatgagccgcgcattgaatcaggttatgtaagtatcagaacccctaattatgatgtcactcttacccttcgatggctaagcggcgactgggatgccgggaaaagctctacaaatctactaaaaaagtcaaatatacagctgtaaacttctttcctcgtctacatcatggtaacgattgttcaatctttacttcgtgtctttttttttttctatgtactttctattccaacctatgtgaagactaaaattcaccttagtaaacgtaaagacaatgacgataggtgcctaaatccaatgaaaagagcacaaacagtttccatataattaggagcagtctacaatcaagcagtaaattttggtatcataaacgacccgctgagacctttccattgggtcaggtcgagaactgtagttactcgaaaatcagatcatccacacgctgttgaactcgaaaacagtagcactgtcactgtaagctagtgttcattttaaacgtcttgccgaattttttcttcgaagaaaagtattgcaatggactctatacttctgagcagcaattaaggaaaacagggtaggtaacctctggggttgatatctggataaactggaaccatattagcgagatgatgcactttacatagattccgcgagtaccttaatactgctggtgcaccacgataatgattacttcttcaatatcaattagtttgccaggatataccttatccaatttagcgtgacgatcttaaaggcgtttttatgtttattcgctaaaacccttcttattgtcattttcgttaacatactatctaacgtatttctgtttgtcagtaattttcagttaatggatggtatcagacgaaaattaaataaatcaccttctgctttataagcaagatataaaaaaaaatatggatcgattgattcatttccataatgatcaatatataataataataggactgctagctaatatatactcaatatgatttgttcatattcttcgcaggtatatataaccatcaagtaatacatatttaacttagctgcatcaccgttgagccttttgttgaacacttcccctctctatcataaaatcaaccatatagaaacgcatagagtgtaaacattgatatgcgatgccaaaacacttgatttgttactatggaacacacagcaatatgcatacactacttgttccattgctgttgcaattccattggatagaactcctgcattgtcctcatttagtgctcaggaaaaggtttacatatttctttctgacttttcagaaaaaaaatttgtgaggctgtcactgtatatcacgtaatacacatataagtaattggatttatagtaaaaagaattctcatgttgggcacaactatctcgttgccaaattttttaccatattaaaacgacccatgtaatataattggaaaaattagtatactgggaacaatcttgcggcacaccgcttgaacgaaacgttcgtaaaaatatttataattcttattattattatttattattattataatatatataatttaataatcttaatatttattatcattgtttcatatttttttttataaatatttatttaaataaaaaatattaaagagtattcaaaaaagtcttactgtgggtaatggatatttcctcatgtttgccgctctgatggtgcggaaaaaactgctccatgaagcaaactgtccgggcaaatcctttcacgctcgggaagctttgtgaaagcccttctctttcaacccatctttgcaacgaaaaaaaaaaaaaaaataaaaaataaaaagaccaaatagtaaatagtaacttacatacattagtaaatggtacactcttacacactatcatcctcatcgtatattataatagatatatacaatacatgtttttacccggatcatagaattcttaagacaaataaaatttatagagacttgttcagtctacttctctctaaactaggccccggctcctgccagtacccacttagaaagaaataaaaaacaaatcagacaacaaaggcttaatctcagcagatcgtaacaacaaggctactctactgcttacaataccccgttgtacatctaagtcgtatacaaatgatttatccccacgcaaaatgacattgcaattcgccagcaagcacccaaggcctttccgccaagtgcaccgttgctagcctgctatggttcagcgacgccacaaggacgccttattcgtatccatctatattgtgtggagcaaagaaatcaccgcgttctagcatggattctgacttagaggcgttcagccataatccagcggatggtagcttcgcggcaatgcctgatcagacagccgcaaaaaccaattatccgaatgaactgttcctctcgtactaagttcaattactattgcggtaacattcatcagtagggtaaaactaacctgtctcacgacggtctaaacccagctcacgttccctattagtgggtgaacaatccaacgcttaccgaattctgcttcggtatgataggaagagccgacatcgaagaatcaaaaagcaatgtcgctatgaacgcttgactgccacaagccagttatccctgtggtaacttttctggcacctctagcctcaaattccgagggactaaaggatcgataggccacactttcatggtttgtattcacactgaaaatcaaaatcaagggggcttttacccttttgttctactggagatttctgttctccatgagccccccttaggacatctgcgttatcgtttaacagatgtgccgccccagccaaactccccacctgacaatgtcttcaacccggatcagccccgaatgggaccttgaatgctagaacgtggaaaatgaattccagctccgcttcattgaataagtaaagaaactataaaggtagtggtatttcactggcgccgaagctcccacttattctacaccctctatgtctcttcacaatgtcaaactagagtcaagctcaacagggtcttctttccccgctgattctgccaagcccgttcccttggctgtggtttcgctagatagtagatagggacagtgggaatctcgttaatccattcatgcgcgtcactaattagatgacgaggcatttggctaccttaagagagtcatagttactcccgccgtttacccgcgcttggttgaatttcttcactttgacattcagagcactgggcagaaatcacattgcgtcaacatcactttctgaccatcgcaatgctatgttttaattagacagtcagattccccttgtccgtaccagttctaagttgatcgttaattgtagcaagcgacggtctacaagagacctaccaaggccgtctacaacaaggcacgcaagtagtccgcctagcagagcaagccccaccaagcagtccacaagcacgcccgctgcgtctgaccaaggccctcactacccgacccttagagccaatccttatcccgaagttacggatctattttgccgacttcccttatctacattattctatcaactagaggctgttcaccttggagacctgctgcggttatcagtacgacctggcatgaaaactattccttcctgtggattttcacgggccgtcacaagcgcaccggagccagcaaaggtgctggcctcttccagccataagaccccatctccggataaaccaattccggggtgataagctgttaagaagaaaagataactcctcccagggctcgcgccgacgtctccacattcagttacgttaccgtgaagaatccatatccaggttccggaatcttaaccggattccctttcgatggtggcctgcataaaatcaggcctttgaaacggagcttccccatctcttaggatcgactaacccacgtccaactgctgttgacgtggaacctttccccacttcagtcttcaaagttctcatttgaatatttgctactaccaccaagatctgcactagaggccgttcgacccgaccttacggtctaggcttcgtcactgacctccacgcctgcctactcgtcagggcatcatatcaaccctgacggtagagtataggtaacacgcttgagcgccatccattttcagggctagttcattcggccggtgagttgttacacactccttagcggattccgacttccatggccaccgtccggctgtctagatgaactaacaccttttgtggtgtctgatgagcgtgtattccggcaccttaactctacgttcggttcatcccgcatcgccagttctgcttaccaaaaatggcccactaaaagctcttcattcaaatgtccacgttcaattaagtaacaaggacttcttacatatttaaagtttgagaataggtcaaggtcatttcgaccccggaacctctaatcattcgctttacctcataaaactgatacgagcttctgctatcctgagggaaacttcggcaggaaccagctactagatggttcgattagtctttcgcccctatacccaaattcgacgatcgatttgcacgtcagaaccgctacgagcctccaccagagtttcctctggcttcaccctattcaggcatagttcaccatctttcgggtcccaacagctatgctcttactcaaatccatccgaagacatcaggatcggtcgattgtgcacctcttgcgaggccccaacctacgttcactttcattacgcgtatgggttttacacccaaacactcgcatagacgttagactccttggtccgtgtttcaagacgggcggcatataaccattatgccagcatccttgacttacgtcgcagtcctcagtcccagctggcagtattcccacaggctataatacttaccgaggcaagctacattcctatggatttatcctgccaccaaaactgatgctggcccagtgaaatgcgagattcccctacccacaaggagcagagggcacaaaacaccatgtctgatcaaatgcccttccctttcaacaatttcacgtactttttcactctcttttcaaagttcttttcatctttccatcactgtacttgttcgctatcggtctctcgccaatatttagctttagatggaatttaccacccacttagagctgcattcccaaacaactcgactcttcgaaggcactttacaaagaaccgcactcctcgccacacgggattctcaccctctatgacgtcctgttccaaggaacatagacaaggaacggccccaaagttgccctctccaaattacaactcgggcaccgaaggtaccagatttcaaatttgagcttttgccgcttcactcgccgttactaaggcaatcccggttggtttcttttcctccgcttattgatatgcttaagttcagcgggtactcctacctgatttgaggtcaaactttaagaacattgttcgcctagacgctctcttcttatcgataacgttccaatacgctcagtataaaaaaagattagccgcagttggtaaaacctaaaacgaccgtacttgcattatacctcaagcacgcagagaaacctctctttggaaaaaaaacatccaatgaaaaggccagcaatttcaagttaactccaaagagtatcactcactaccaaacagaatgtttgagaaggaaatgacgctcaaacaggcatgccccctggaataccaaggggcgcaatgtgcgttcaaagattcgatgattcacggaattctgcaattcacattacgtatcgcatttcgctgcgttcttcatcgatgcgagaaccaagagatccgttgttgaaagtttttaatattttaaaatttccagttacgaaaattcttgtttttgacaaaaatttaatgaatagataaaattgtttgtgtttgttacctctgggccccgattgctcgaatgcccaaagaaaaagttgcaaagatatgaaaactccacagtgtgttgtattgaaacggttttaattgtcctataacaaaagcacagaaatctctcaccgtttggaatagcaagaaagaaacttacaagcctagcaagaccgcgcacttaagcgcaggcccggctggactctccatctcttgtcttcttgcccagtaaaagctctcatgctcttgccaaaacaaaaaaatccattttcaaaattattaaatttctttaatgatccttccgcaggttcacctacggaaaccttgttacgacttttagttcctctaaatgaccaagtttgtccaaattctccgctctgagatggagttgcccccttctctaagcagatcctgaggcctcactaagccattcaatcggtactagcgacgggcggtgtgtacaaagggcagggacgtaatcaacgcaagctgatgacttgcgcttactaggaattcctcgttgaagagcaataattacaatgctctatccccagcacgacggagtttcacaagattaccaagacctctcggccaaggttagactcgctggctccgtcagtgtagcgcgcgtgcggcccagaacgtctaagggcatcacagacctgttattgcctcaaacttccatcggcttgaaaccgatagtccctctaagaagtggataaccagcaaatgctagcaccactatttagtaggttaaggtctcgttcgttatcgcaattaagcagacaaatcactccaccaactaagaacggccatgcaccaccacccacaaaatcaagaaagagctctcaatctgtcaatccttattgtgtctggacctggtgagtttccccgtgttgagtcaaattaagccgcaggctccactcctggtggtgcccttccgtcaattcctttaagtttcagccttgcgaccatactccccccagaacccaaagactttgatttctcgtaaggtgccgagtgggtcattaaaaaaacaccacccgatccctagtcggcatagtttatggttaagactacgacggtatctgatcatcttcgatcccctaactttcgttcttgattaatgaaaacgtccttggcaaatgctttcgcagtagttagtcttcaataaatccaagaatttcacctctgacaattgaatactgatgcccccgaccgtccctattaatcattacgatggtcctagaaaccaacaaaatagaaccaaacgtcctattctattattccatgctaatatattcgagcaatacgcctgctttgaacactctaattttttcaaagtaaaagtcctggttcgccaagagccacaaggactcaaggttagccagaaggaaaggccccgttggaaatccagtacacgaaaaaatcggaccggccaaccgggcccaaagttcaactacgagctttttaactgcaacaactttaatatacgctattggagctggaattaccgcggctgctggcaccagacttgccctccaattgttcctcgttaaggtatttacattgtactcattccaattacaagacccgaatgggccctgtatcgttatttattgtcactacctccctgaattaggattgggtaatttgcgcgcctgctgccttccttggatgtggtagccgtttctcaggctccctctccggaatcgaacccttattccccgttacccgttgaaaccatggtaggccactatcctaccatcgaaagttgatagggcagaaatttgaatgaaccatcgccagcacaaggccatgcgattcgaaaagttattatgaatcatcaaagagtccgaagacattgattttttatctaataaatacatctcttccaaagggtcgagattttaagcatgtattagctctagaattaccacagttataccatgtagtaaaggaactatcaaataaacgataactgatttaatgagccattcgcagtttcactgtataaattgcttatacttagacatgcatggcttaatctttgagacaagcatatgactactggcaggatcaaccagataactatcttaaaagaagaagcaacaagcagtaaaaaagaaagaaaccgaaatctctttttttttttcccacctattccctcttgctagaagatacttattgagtttggaaacagctgaaattccagaaaaattgctttttcaggtctctctgctgccggaaatgctctctgttcaaaaagcttttacactcttgaccagcgcactccgtcaccataccatagcactctttgagtttcctctaatcaggttccaccaaacagataccccggtgtttcacggaatggtacgtttgatatcgctgatttgagaggaggttacacttgaagaatcacagtcttgcgaccggctattcaacaaggcattcccccaagtttgaattctttgaaatagattgctattagctagtaatccaccaaatccttcgctgctcaccaatggaatcgcaagatgcccacgatgagactgttcaggttaaacgcaaaagaaacacactctgggaatttcttcccaaattgtatctctcaatacgcatcaacccatgtcaattaaacacgctgtatagagactaggcagatctgacgatcacctagcgactctctccaccgtttgacgaggccatttacaaaaacataacgaacgacaagcctactcgaattcgtttccaaactcttttcgaacttgtcttcaactgctttcgcatgaagtacctcccaactacttttcctcacacttgtactccatgactaaaccccccctcccattacaaactaaaatcttacttttattttcttttgccctctctgtcgctctgccttaactacgtatttctcgccgagaaaaacttcaatttaagctattctccaaaaatcttagcgtatattttttttccaaagtgacaggtgccccgggtaacccagttcctcactattttttactgcggaagcggaagcggaaaatacggaaacgcgcgggaacatacaaaacatacaaaatatacctttctcacacaagaaatatatgctacttgcaaaatatcataccaaaaaacttttcacaaccgaaaccaaaaccaacggatatcatacattacactaccaccattcaaactttactactatcctcccttcagtttccctttttctgcctttttcggtgacggaaatacgcttcagagaccctaaagggaaatccatgccataacaggaaagtaacatcccaatgcggactataccaccccaccacactcctaccaataacggtaactattctatgttttcttactcctatgtctattcatctttcatctgactacctaatactatgcaaaaatgtaaaatcatcacacaaaacataaacaatcaaaatcagccatttccgcaccttttcctctgtccactttcaaccgtccctccaaatgtaaaatggcctatcggaatacattttctacatcctaactactataaaacaacctttagacttacgtttgctactctcatggtctcaatactgccgccgacattctgtcccacatactaaatctcttcccgtcattatcgcccgcatccggtgccgtaaatgcaaaacaaataccatctatgtcttccacaccatcattttactatgcctgccaccatccatttgtcttttgcaccatatcttcataacctgtcaccttgaaactacctctgcatgccacctaccgaccaactttcatgttctgtttcgacctacctcttgtaaatgacaaatcacctttttcatcgtatgcaccttattctccacatcacaatgcactattgcttttgctttttcacctgtcatatcctattgctattagatgaaatataataaaaattgtcctccacccataacacctctcactcccacctactgaacatgtctggaccctgccctcatatcacctgcgtttccgttaaactatcggttgcggccatatctaccagaaagcaccgtttcccgtccgatcaactgtagttaagctggtaagagcctgaccgagtagtgtagtgggtgaccatacgcgaaactcaggtgctgcaatctttatttctttttttttttttttttttttttttttttctagtttcttggcttcctatgctaaatcccataactaacctaccattcgattcagaaaaattcgcactatccagctgcactcttcttctgaagagttaagcactccattatgctcattgggttgctactacttgatatgtacaaacaatattctcctccgatattcctacaaaaaaaaaaaaaaaaacactccggttttgttctcttccctccatttccctctcttctacggttaatactttcctcttcgtctttttctacaccctcgtttagttgcttcttattccttcccgctttcctgcactaacattttgccgcattacactatatgatcgtagtacatcttacaactccgcataccgcgtcgccgcgtcgccgcgtcgccaaaaatttacttcgccaaccattccatatctgttaagtatacatgtatatattgcactggctattcatcttgcacttttcctctttcttcttcccagtagcctcatccttttacgctgcctctctggaacttgccatcatcattccctagaaactgccatttacttaaaaaaaaaaaaaaaaaaaaaatgtccccactgttcactgttcactgttcacttgtctcttacatctttcttggtaaaatcgtagttcgtagtattttttttcatatcaaaggcatgtcctgttaactataggaaatgagcttttctcaattctctaaacttatacaagcactcatgtttgccgctctgatggtgcggaaaaaactgctccatgaagcaaactgtccgggcaaatcctttcacgctcgggaagctttgtgaaagcccttctctttcaacccatctttgcaacgaaaaaaaaaaaaaaaataaaaaataaaaagaccaaatagtaaatagtaacttacatacattagtaaatggtacactcttacacactatcatcctcatcgtatattataatagatatatacaatacatgtttttacccggatcatagaattcttaagacaaataaaatttatagagacttgttcagtctacttctctctaaactaggccccggctcctgccagtacccacttagaaagaaataaaaaacaaatcagacaacaaaggcttaatctcagcagatcgtaacaacaaggctactctactgcttacaataccccgttgtacatctaagtcgtatacaaatgatttatccccacgcaaaatgacattgcaattcgccagcaagcacccaaggcctttccgccaagtgcaccgttgctagcctgctatggttcagcgacgccacaaggacgccttattcgtatccatctatattgtgtggagcaaagaaatcaccgcgttctagcatggattctgacttagaggcgttcagccataatccagcggatggtagcttcgcggcaatgcctgatcagacagccgcaaaaaccaattatccgaatgaactgttcctctcgtactaagttcaattactattgcggtaacattcatcagtagggtaaaactaacctgtctcacgacggtctaaacccagctcacgttccctattagtgggtgaacaatccaacgcttaccgaattctgcttcggtatgataggaagagccgacatcgaagaatcaaaaagcaatgtcgctatgaacgcttgactgccacaagccagttatccctgtggtaacttttctggcacctctagcctcaaattccgagggactaaaggatcgataggccacactttcatggtttgtattcacactgaaaatcaaaatcaagggggcttttacccttttgttctactggagatttctgttctccatgagccccccttaggacatctgcgttatcgtttaacagatgtgccgccccagccaaactccccacctgacaatgtcttcaacccggatcagccccgaatgggaccttgaatgctagaacgtggaaaatgaattccagctccgcttcattgaataagtaaagaaactataaaggtagtggtatttcactggcgccgaagctcccacttattctacaccctctatgtctcttcacaatgtcaaactagagtcaagctcaacagggtcttctttccccgctgattctgccaagcccgttcccttggctgtggtttcgctagatagtagatagggacagtgggaatctcgttaatccattcatgcgcgtcactaattagatgacgaggcatttggctaccttaagagagtcatagttactcccgccgtttacccgcgcttggttgaatttcttcactttgacattcagagcactgggcagaaatcacattgcgtcaacatcactttctgaccatcgcaatgctatgttttaattagacagtcagattccccttgtccgtaccagttctaagttgatcgttaattgtagcaagcgacggtctacaagagacctaccaaggccgtctacaacaaggcacgcaagtagtccgcctagcagagcaagccccaccaagcagtccacaagcacgcccgctgcgtctgaccaaggccctcactacccgacccttagagccaatccttatcccgaagttacggatctattttgccgacttcccttatctacattattctatcaactagaggctgttcaccttggagacctgctgcggttatcagtacgacctggcatgaaaactattccttcctgtggattttcacgggccgtcacaagcgcaccggagccagcaaaggtgctggcctcttccagccataagaccccatctccggataaaccaattccggggtgataagctgttaagaagaaaagataactcctcccagggctcgcgccgacgtctccacattcagttacgttaccgtgaagaatccatatccaggttccggaatcttaaccggattccctttcgatggtggcctgcataaaatcaggcctttgaaacggagcttccccatctcttaggatcgactaacccacgtccaactgctgttgacgtggaacctttccccacttcagtcttcaaagttctcatttgaatatttgctactaccaccaagatctgcactagaggccgttcgacccgaccttacggtctaggcttcgtcactgacctccacgcctgcctactcgtcagggcatcatatcaaccctgacggtagagtataggtaacacgcttgagcgccatccattttcagggctagttcattcggccggtgagttgttacacactccttagcggattccgacttccatggccaccgtccggctgtctagatgaactaacaccttttgtggtgtctgatgagcgtgtattccggcaccttaactctacgttcggttcatcccgcatcgccagttctgcttaccaaaaatggcccactaaaagctcttcattcaaatgtccacgttcaattaagtaacaaggacttcttacatatttaaagtttgagaataggtcaaggtcatttcgaccccggaacctctaatcattcgctttacctcataaaactgatacgagcttctgctatcctgagggaaacttcggcaggaaccagctactagatggttcgattagtctttcgcccctatacccaaattcgacgatcgatttgcacgtcagaaccgctacgagcctccaccagagtttcctctggcttcaccctattcaggcatagttcaccatctttcgggtcccaacagctatgctcttactcaaatccatccgaagacatcaggatcggtcgattgtgcacctcttgcgaggccccaacctacgttcactttcattacgcgtatgggttttacacccaaacactcgcatagacgttagactccttggtccgtgtttcaagacgggcggcatataaccattatgccagcatccttgacttacgtcgcagtcctcagtcccagctggcagtattcccacaggctataatacttaccgaggcaagctacattcctatggatttatcctgccaccaaaactgatgctggcccagtgaaatgcgagattcccctacccacaaggagcagagggcacaaaacaccatgtctgatcaaatgcccttccctttcaacaatttcacgtactttttcactctcttttcaaagttcttttcatctttccatcactgtacttgttcgctatcggtctctcgccaatatttagctttagatggaatttaccacccacttagagctgcattcccaaacaactcgactcttcgaaggcactttacaaagaaccgcactcctcgccacacgggattctcaccctctatgacgtcctgttccaaggaacatagacaaggaacggccccaaagttgccctctccaaattacaactcgggcaccgaaggtaccagatttcaaatttgagcttttgccgcttcactcgccgttactaaggcaatcccggttggtttcttttcctccgcttattgatatgcttaagttcagcgggtactcctacctgatttgaggtcaaactttaagaacattgttcgcctagacgctctcttcttatcgataacgttccaatacgctcagtataaaaaaagattagccgcagttggtaaaacctaaaacgaccgtacttgcattatacctcaagcacgcagagaaacctctctttggaaaaaaaacatccaatgaaaaggccagcaatttcaagttaactccaaagagtatcactcactaccaaacagaatgtttgagaaggaaatgacgctcaaacaggcatgccccctggaataccaaggggcgcaatgtgcgttcaaagattcgatgattcacggaattctgcaattcacattacgtatcgcatttcgctgcgttcttcatcgatgcgagaaccaagagatccgttgttgaaagtttttaatattttaaaatttccagttacgaaaattcttgtttttgacaaaaatttaatgaatagataaaattgtttgtgtttgttacctctgggccccgattgctcgaatgcccaaagaaaaagttgcaaagatatgaaaactccacagtgtgttgtattgaaacggttttaattgtcctataacaaaagcacagaaatctctcaccgtttggaatagcaagaaagaaacttacaagcctagcaagaccgcgcacttaagcgcaggcccggctggactctccatctcttgtcttcttgcccagtaaaagctctcatgctcttgccaaaacaaaaaaatccattttcaaaattattaaatttctttaatgatccttccgcaggttcacctacggaaaccttgttacgacttttagttcctctaaatgaccaagtttgtccaaattctccgctctgagatggagttgcccccttctctaagcagatcctgaggcctcactaagccattcaatcggtactagcgacgggcggtgtgtacaaagggcagggacgtaatcaacgcaagctgatgacttgcgcttactaggaattcctcgttgaagagcaataattacaatgctctatccccagcacgacggagtttcacaagattaccaagacctctcggccaaggttagactcgctggctccgtcagtgtagcgcgcgtgcggcccagaacgtctaagggcatcacagacctgttattgcctcaaacttccatcggcttgaaaccgatagtccctctaagaagtggataaccagcaaatgctagcaccactatttagtaggttaaggtctcgttcgttatcgcaattaagcagacaaatcactccaccaactaagaacggccatgcaccaccacccacaaaatcaagaaagagctctcaatctgtcaatccttattgtgtctggacctggtgagtttccccgtgttgagtcaaattaagccgcaggctccactcctggtggtgcccttccgtcaattcctttaagtttcagccttgcgaccatactccccccagaacccaaagactttgatttctcgtaaggtgccgagtgggtcattaaaaaaacaccacccgatccctagtcggcatagtttatggttaagactacgacggtatctgatcatcttcgatcccctaactttcgttcttgattaatgaaaacgtccttggcaaatgctttcgcagtagttagtcttcaataaatccaagaatttcacctctgacaattgaatactgatgcccccgaccgtccctattaatcattacgatggtcctagaaaccaacaaaatagaaccaaacgtcctattctattattccatgctaatatattcgagcaatacgcctgctttgaacactctaattttttcaaagtaaaagtcctggttcgccaagagccacaaggactcaaggttagccagaaggaaaggccccgttggaaatccagtacacgaaaaaatcggaccggccaaccgggcccaaagttcaactacgagctttttaactgcaacaactttaatatacgctattggagctggaattaccgcggctgctggcaccagacttgccctccaattgttcctcgttaaggtatttacattgtactcattccaattacaagacccgaatgggccctgtatcgttatttattgtcactacctccctgaattaggattgggtaatttgcgcgcctgctgccttccttggatgtggtagccgtttctcaggctccctctccggaatcgaacccttattccccgttacccgttgaaaccatggtaggccactatcctaccatcgaaagttgatagggcagaaatttgaatgaaccatcgccagcacaaggccatgcgattcgaaaagttattatgaatcatcaaagagtccgaagacattgattttttatctaataaatacatctcttccaaagggtcgagattttaagcatgtattagctctagaattaccacagttataccatgtagtaaaggaactatcaaataaacgataactgatttaatgagccattcgcagtttcactgtataaattgcttatacttagacatgcatggcttaatctttgagacaagcatatgactactggcaggatcaaccagataactatcttaaaagaagaagcaacaagcagtaaaaaagaaagaaaccgaaatctctttttttttttcccacctattccctcttgctagaagatacttattgagtttggaaacagctgaaattccagaaaaattgctttttcaggtctctctgctgccggaaatgctctctgttcaaaaagcttttacactcttgaccagcgcactccgtcaccataccatagcactctttgagtttcctctaatcaggttccaccaaacagataccccggtgtttcacggaatggtacgtttgatatcgctgatttgagaggaggttacacttgaagaatcacagtcttgcgaccggctattcaacaaggcattcccccaagtttgaattctttgaaatagattgctattagctagtaatccaccaaatccttcgctgctcaccaatggaatcgcaagatgcccacgatgagactgttcaggttaaacgcaaaagaaacacactctgggaatttcttcccaaattgtatctctcaatacgcatcaacccatgtcaattaaacacgctgtatagagactaggcagatctgacgatcacctagcgactctctccaccgtttgacgaggccatttacaaaaacataacgaacgacaagcctactcgaattcgtttccaaactcttttcgaacttgtcttcaactgctttcgcatgaagtacctcccaactacttttcctcacacttgtactccatgactaaaccccccctcccattacaaactaaaatcttacttttattttcttttgccctctctgtcgctctgccttaactacgtatttctcgccgagaaaaacttcaatttaagctattctccaaaaatcttagcgtatattttttttccaaagtgacaggtgccccgggtaacccagttcctcactattttttactgcggaagcggaagcggaaaatacggaaacgcgcgggaacatacaaaacatacaaaatatacctttctcacacaagaaatatatgctacttgcaaaatatcataccaaaaaacttttcacaaccgaaaccaaaaccaacggatatcatacattacactaccaccattcaaactttactactatcctcccttcagtttccctttttctgcctttttcggtgacggaaatacgcttcagagaccctaaagggaaatccatgccataacaggaaagtaacatcccaatgcggactataccaccccaccacactcctaccaataacggtaactattctatgttttcttactcctatgtctattcatctttcatctgactacctaatactatgcaaaaatgtaaaatcatcacacaaaacataaacaatcaaaatcagccatttccgcaccttttcctctgtccactttcaaccgtccctccaaatgtaaaatggcctatcggaatacattttctacatcctaactactataaaacaacctttagacttacgtttgctactctcatggtctcaatactgccgccgacattctgtcccacatactaaatctcttcccgtcattatcgcccgcatccggtgccgtaaatgcaaaacaaataccatctatgtcttccacaccatcattttactatgcctgccaccatccatttgtcttttgcaccatatcttcataacctgtcaccttgaaactacctctgcatgccacctaccgaccaactttcatgttctgtttcgacctacctcttgtaaatgacaaatcacctttttcatcgtatgcaccttattctccacatcacaatgcactattgcttttgctttttcacctgtcatatcctattgctattagatgaaatataataaaaattgtcctccacccataacacctctcactcccacctactgaacatgtctggaccctgccctcatatcacctgcgtttccgttaaactatcggttgcggccatatctaccagaaagcaccgtttcccgtccgatcaactgtagttaagctggtaagagcctgaccgagtagtgtagtgggtgaccatacgcgaaactcaggtgctgcagttgttttttttttcgcgcacgaatacatcacgcagcctcgccttgacactgctcaagggataaggggaaggagctgagatagaactgagttggagcgttgcagcggcacgagcagtgaaaagagcgaagagaagagaagcagataaaagaccaaagtagcgatgatacttcgatgtttggagcgatttttcctatgtgaatattagaaatcatatgttttgtatcagctgaacagtgaatgatgtgctcaatactcaaattcatctttttgtttgctaaaaatagcttaactggcacatcatgaaaaggatgtagaaattatagagtatatttactactaagaactatataaaaacacagtgtgatgaaaagtcactgatcaggctttaaccaccgtagacgccagaaaaaacagacctaatctgatccatgccgtagccggagtacaaacataattgtagcaaaatacgcgatttttgagggtttaggtagccagatccaatggcgtactctggggcatcatctggaggaactgtaccatctgctgttcttctgctgtgaacaattggtataccatactcttcataaagttgttcgtttacaatactacccgtagcagtccaggaaccagctccagaacccgccaacacgataccttttgcgcccaggtccttgacggcctttactattagctcaggattcaagccttgataggagtacagaataatgacttctggaatttccgaagggtctgtgaggttggaaatgtcaaaaaattgccatccatttggcttgactggtgggtagtaaaactccacgtcatcatttgaaaagtaacctaaatatccctgttcatccgctctgaatgtatctaaagagttggcattcattttcgttgtccaaaacccagaggcaatacgatcgtttagagtgatcatcgtgccacgacccagtgatttctcagaagcagcaatagacactgcttgatataaattcattgggccatcagcagacgtggcagtggctggacgcatagcgcctgcgatacatactggcttctctgaatttatggtcaaatctaagaagaaagctgtctcctccatagtgtcggtcccatgagtgacaaccgcaccagcgtagtcatcagaggctagtgcctcggagataccgtgatacaatgggatcagatgcgtatagtttaaagaatttgaaccaacgttagacacttgaagatagtccagatttgccttctcagctaaagatgggacggcttctattaaatcatttacggttaatcccacgctataacccgccgttgttgcacttgtcgaacccttggaagcgatagtaccgccggtaccaaaaattttgattgatggcaaagaagaattcttctcttcacgaatttttagtagtggagcaccactggacattgcgacaaagagagaaagtaaaagggtatttaaagatctcatagttggaggttggtgagtaccagattgcttacaaaagaatagcgagccaacatttgctctgcctcaggcctcttggtgctgcttgaagactcatcttatatggcttttgtatgtcatgatttgttcttgtacattatgtgttgatattaaacaaattgatttttttttttttgcgatagcaagcagataatgaaagagacaaggacttggaacatccgataagactgcgccgatatcgatcttacagtccttcccttgtgtcatgactttcggaaaagcatcctcgtcgactggtagtttgctgtctgtcacgtgctgaagggtctgatacatttttttaaagataagagacggggtttacccttcggaggactaagcgagatctccaagtaaagatctcgcttatcaagaaagcagccaagtgtggaacgtccttttttttggtttcaaaaagatattcaacagtttacactgcagctttaattgcctcaaaaggatatcatgaggtgatctagggtcagaagggaaagattacagcatcttgagttgaatcacatctgcaaaaggtggtattattgacgttgctcttccttaatggaaactcatggggtttggaaaggaggtgcggtaatctatttttttcgaacacaaaacctaaccttgaaaagaaactgtccaatttcattgaacttacctcagaacgggccggagtctttgctttcagtctaacatggtctaatttcttcgaaaagcttcatttaattgttagactgtggttttacaaggaaaaaaccagtgctatactgaagcgatacccagaactaattaccttgtgtgacgattcggctcagcgaaacggacatggtaaaattgggaatttgaaagcaggcagcagccttgtacagcgacatgacgataggtttagaatccccatcacgtacgagttgaagaattctacgaaggctctatgcgttattcctctatcggtataaagtgtagcgttgtaggggggatattggtggtttagttgaatttgcgcaacgaaattatagaactcataaaagttcaattcaatacttgaaacccttaacgttggttcgaccatcaattgtttggacataatagttttattctgcggccgatttcaaaatttagtaaatcaaatgttgaagcatcaccagtaggatgaccactcccatgacaaaactccgtcccaaagatagcttgatcatcctaagcgggtcgcattttactatccccagttccgaagaataacaaggctcaatgcatatgctgtttatcgtgctcacaaggcggtatgacgtttttagcaatgtaattatattaaaaagatcttcagtcactatgagtggttgattgccccatagagagctataagccgacgtgaaagctgctggttccagcttggctcatgtcgtcaccagtcactagtcacttggtcgcattcattgctactcatctgcgagtgagcatatttgagatctgacttgccaagggattagaatcacgtaagactcttgatccttagaagatatttctgacaaagaaccacctaagccatgcaagttttttttttcatttggtggcgaaacaaaggtgatgaaagtttcttcttgtacaaacgccaatcccgataggtgagacaattcttgaagtaatggacctctgagtaagcatatcagtcgaatgaagttccaatatgcgttggccaaggaacagctaggcagcaactcgcgcagtggcgtcaaaaaactaataagtaaacaccactggcttccggaatactatttctctgatctctcattttctgttgtacagcagtgggacagtagagccattgaaaaaactacaatcatatcttgtatgcggcccgcaaaccaagagatttatcctttgagacattgtgagaccctccgttcgcaaccgtgctctctgttttcatcactatatgcacgctctttccaaagctcctgcactttgcacgtggcggagccatcgcccggcttccatatgtacggctgccacacctaactatttcggttgcggccatatctaccagaaagcaccgtttcccgtccgatcaactgtagttaagctggtaagagcctgaccgagtagtgtagtgggtgaccatacgcgaaactcaggtgctgcagttgttttttttttcgcgcacgaatacatcacgcagcctcgccttgacactgctcaagggataaggggaaggagctgagatagaactgagttggagcgttgcagcggcacgagcagtgaaaagagcgaagagaagagaagcagataaaagaccaaagtagcgatgatacttcgatgtttggagcgatttttcctatgtgaatattagaaatcatatgttttgtatcagctgaacagtgaatgatgtgctcaatactcaaattcatctttttgtttgctaaaaatagcttaactggcacatcatgaaaaggatgtagaaattatagagtatatttactactaagaactatataaaaacacagtgtgatgaaaagtcactgatcaggctttaaccaccgtagacgccagaaaaaacagacctaatctgatccatgccgtagccggagtacaaacataattgtagcaaaatacgcgatttttgagggtttaggtagccagatccaatggcgtactctggggcatcatctggaggaactgtaccatctgctgttcttctgctgtgaacaattggtataccatactcttcataaagttgttcgtttacaatactacccgtagcagtccaggaaccagctccagaacccgccaacacgataccttttgcgcccaggtccttgacggcctttactattagctcaggattcaagccttgataggagtacagaataatgacttctggaatttccgaagggtctgtgaggttggaaatgtcaaaaaattgccatccatttggcttgactggtgggtagtaaaactccacgtcatcatttgaaaagtaacctaaatatccctgttcatccgctctgaatgtatctaaagagttggcattcattttcgttgtccaaaacccagaggcaatacgatcgtttagagtgatcatcgtgccacgacccagtgatttctcagaagcagcaatagacactgcttgatataaattcattgggccatcagcagacgtggcagtggctggacgcatagcgcctgcgatacatactggcttctctgaatttatggtcaaatctaagaagaaagctgtctcctccatagtgtcggtcccatgagtgacaaccgcaccagcgtagtcatcagaggctagtgcctcggagataccgtgatacaatgggatcagatgcgtatagtttaaagaatttgaaccaacgttagacacttgaagatagtccagatttgccttctcagctaaagatgggacggcttctattaaatcatttacggttaatcccacgctataacccgccgttgttgcacttgtcgaacccttggaagcgatagtaccgccggtaccaaaaattttgattgatggcaaagaagaattcttctcttcacgaatttttagtagtggagcaccactggacattgcgacaaagagagaaagtaaaagggtatttaaagatctcatagttggaggttggtgagtaccagattgcttacaaaagaatagcgagccaacatttgctctgcctcaggcctcttggtgctgcttgaagactcatcttatatggcttttgtatgtcatgatttgttcttgtacattatgtgttgatattaaacaaattgatttttttttttttgcgatagcaagcagataatgaaagagacaaggacttggaacatccgataagactgcgccgatatcgatcttacagtccttcccttgtgtcatgactttcggaaaagcatcctcgtcgactggtagtttgctgtctgtcacgtgctgaagggtctgatacatttttttaaagataagagacggggtttaccttcggaggactaagcgagatctccaagtaaagatctcgcttatcaagaaagcagccaagtgtggaacgtccttttttttggtttcaaaaagatattcaacagtttacactgcagctttaattgcctcaaaaggatatcatgaggtgatctagggtcagaagggaaagattacagcatcttgagttgaatcacatctgcaaaaggtggtattattgacgttgctcttccttaatggaaactcatggggtttggaaaggaggtgcggtaatctatttttttcgaacacaaaacctaaccttgaaaagaaactgtccaatttcattgaacttacctcagaacgggccggagtctttgctttcagtctaacatggtctaatttcttcgaaaagcttcatttaattgttagactgtggttttacaaggaaaaaaccagtgctatactgaagcgatacccagaactaattaccttgtgtgacgattcggctcagcgaaacggacatggtaaaattgggaatttgaaagcaggcagcagccttgtacagcgacatgacgataggtttagaatccccatcacgtacgagttgaagaattctacgaaggctctatgcgttattcctctatcggtataaagtgtagcgttgtaggggggatattggtggtttagttgaatttgcgcaacgaaattatagaactcataaaagttcaattcaatacttgaaacccttaacgttggttcgaccatcaattgtttggacataatagttttattctgcggccgatttcaaaatttagtaaatcaaatgttgaagcatcaccagtaggatgaccactcccatgacaaaactccgtcccaaagatagcttgatcatcctaagcgggtcgcattttactatccccagttccgaagaataacaaggctcaatgcatatgctgtttatcgtgctcacaaggcggtatgacgtttttagcaatgtaattatattaaaaagatcttcagtcactatgagtggttgattgccccatagagagctataagccgacgtgaaagctgctggttccagcttggctcatgtcgtcaccagtcactagtcacttggtcgcattcattgctactcatctgcgagtgagcatatttgagatctgacttgccaagggattagaatcacgtaagactcttgatccttagaagatatttctgacaaagaaccacctaagccatgcaagttttttttttcatttggtggcgaaacaaaggtgatgaaagtttcttcttgtacaaacgccaagcccgataggtgagacaattcttgaagtaatggacctctgagtaagcatatcagtcgaatgaagttccaatatgcgttggccaaggaacagctaggcagcaactcgcgcagtggcgtcaaaaaactaataagtaaacaccactggcttccggaatactatttctctgatctctcattttctgttgtacagcagtgggacagtagagccattgaaaaaactacaatcatatcttgtatgcggcccgcaaaccaagagatttatcctttgtgagaaatgggtgaatgttgagataattgttgggattccattgttgataaaggctataatattaggtatacagaatatactagaagttctcctcgaggatataggaatcctcaaaatggaatctatatttctacatactaatattacgattattcctcattccgttttatatgtttatattcattgatcctattacattatcaatccttgcgtttcagcttccactaatttagatgactatttctcatcatttgcgtcatcttctaacaccgtatatgataatatactagtaatgtaaatactagttagtagatgatagttgatttctattccaacataccacccataatgtaatagatctaatgaatccatttgttagttaatagtttaaatgtttttatcggaagaggttttgtcatcacatcagcaatgttcttcttggtctcgatgtagtatacgtataaattattacctgatacttcatctctaagtctcattgcctttgtgccaaaaaatctgtttctaaatttctcttcatttgtagacttaattatactgatcgttgatctactatcagtaagtaagcctttaataattggtttcttgttaagttcttgtatcaggtaacttagattatttaataatgggacagattcacttatcgcgtgtatttctgcttccgtagttgaagtacatgttaatgaagccttggtggactttcctccaattacctttccattaagtaaatatatgttgccaatttgtgatttataatacggttggttgccatacgaagcatcacttattgcgactagtttattatctggctcggtaggtttgtttttgtgccatatcagttgtttatctctagtgtcccacatgaattgtatcaactcatatgtcatgtctaaaacttgcctagaggggaatagtatatgttgagcaagtgtgttgatgtagtatagtaagtcaaatctaaatttatatccaacatatgaagctagaccaatcaacttttgcatttcatgtaccttctctttgtattcatcttcatctatttctagttcatcctggtctatataaagacctggttgacctggagcgctaagttttcttccttttggattcaaaggtacgtttaatttgggtattttctcagttaatgagttttccatacctaatttcatgtatttacctctttgatatttgatttctaagccaagtatgtcgtactgaatttcgttatcactttcacccagatttattatctttgtatcgtattgtttcttgagtgttgttatgattttcttatttgcatttaagtctttgctgaataaaatcatgtcgtcaacaaataaacatattgttacttgactattcttaaatacgcatgaccatccacgaacttcttccataccacactgttttatcaggtatgatttgatagtttcgtaccagttcgctccactttgtttcaatccataaagtgatttcttcaaacgtatcaacttatcattcattcctaaatgtggtggaggtcttatgtataattcttctttgatgtctgcatacaaatatgccgaagatatgtctaattgtgtaatatagtagttattgtctaatgcaagtgacagggatgtcattaatgcatagtgatgtacggtattggattgcatgcctgagtcgtaagtgtcaggatgctgaatatcacctcttgcaacaaatctagctttatgagtaccgtcacgtttcttgttgaagataaacattgagtttattactcttttagggtctatttcttttctgtcataatattcgtcagtgtcccaagttttcatcttcaacagttgattgacttctttgtggtatgcctcgatatatttttctttttctttaatatctttattataggtgattgcctcatcgtatcgtaaggttgtccgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgacgagaatttatcggtgggagttctttaaatgggtcagggaattcggtaggagattctggaggtagatcagggagtgggagatcagcgatgatagattcctcggtattctgttcagaaacagtagttggcgttttgataggaacaatattgtgcgatgaattattttccggtggagaagcatcgattgaaggtgaacggtgtataatccttttctcagtctcttggtcacttatctgcggaacagttttgttgttggtaccacccgtactggatattggtacgtttgtatgattagtctcattttcactgtacgagtctgagtgtctgaaatctttagatttactggcgtgcgacgactcatgtgtgttagattgggacatgggagcaagtaaaggaacatttaatttatgcataccacccgaaccggtactctcgatattggaaatttggggggtgctagatctcttctttgatggaagaatattagattcagatatgttggggtcaacttctctgggtgcgcgaatattggttttagaaacacgtttcgaatcttcagtatgagttgacggaggtgtggaatcggttggactcacagcttttgaaaggacatttctcggttgctcaggatgtagttcaatgtcggattggaagtcatggtcagattctatgttaagatcattggattcttggatctcatttgacgcaatgaacgaatgatatgaagcagttaaacggtttaagtcttcatcgaaagtgagtgcgtcgtaattgaattgatctaatctggattccttgccctgaagaataacatagttagttgtatctactgtcttctttaaggatggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggttgagccgttcagcgactccatgtgctcgggaatccgctgtggttgtatagcatggagttataccatttttttcaaggaatttatggagagttctgttagtatactcagaaccacggtccatttgtataaccaagacactggcctgaaactggttcttaataaaagctagtatcgtagtaaaaacatcgaggatagagtcctcgcgacggtcgtgtaatggataaacccaacggaattttgttgtctcatcagtaaatgagatgaaataggatggtgcactatttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtcggtgcattggcatgcgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagatcgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgtcaggattagatgatgctgagtgtatgtgatgagcagatcttataagggttcgtgatgctcctgaatcgagaaggaggtgtccagggagttcatcatcagaatgattagtgtgatttaccgtagattcagtaagttcctggcctaaggtgaaggtcgtgcttattgttcaattgaatcggttcagtagttgatttactgatggaatcgttgtccgtgctgggagagttattagatgtggatacattgtgagccctggctgttttcgatttcgaattatttgttttttgaggattccgagctataactttgggtttggttgtattcgtatagctgcgagaatcattcttctcatcactcagatttctcctgtaattaggtttgctgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaagtcattaggtgaggttaacattggtggtggtctgacatattttttagtggatgtcatatcagagtccgctgaggatgaatcagtaaatgtattacctgactcaggtgatggagtgctcagaggcgttccaactgatgatggatactgcggaaactgtgattgtggcccaggtggaaagtacataggcgacatttgataaggtgtatacggaatcatagatgggtgtccgtaaaatgaccaaccagatggattggcttggttttgggtcatcatgcactgctgtgggtacggcccattctgtggaggtggtactgaagcaggttgaggagaggcatgatgggggttctctggaacagctgatgaagcaggtgttgttgtctgttgagagttagccttagtggaagccttctcacattcttctgttttggaagctgaaacgtctaacggatcttgatttgtgtggacttccttagaagtaaccgaagcacaggcgctaccatgagaaatgggtgaatgttgagataattgttgggattccattgttgataaaggctataatattaggtatacagaatatactagaagttctcctcgaggatataggaatcctcaaaatggaatctatatttctacatactaatattacgattattcctcattccgttttatatgtttatattcattgatcctattacattatcaatccttgcgtttcagcttccactaatttagatgactatttctcatcatttgcgtcatcttctaacaccgtatatgataatatactagtaatgtaaatactagttagtagatgatagttgatttctattccaacactttgagacattgtgagaccctccgttcgcaaccgtgctctctgttttcatcactatatgcacgctctttccaaagctcctgcactttgcacgtggcggagccatcgcccggcttccatatgtacggctgccacacctaactatttcggttgcggccatatctaccagaaagcaccgtttcccgtccgatcaactgtagttaagctggtaagagcctgaccgagtagtgtagtgggtgaccatacgcgaaactcaggtgctgcagttgttttttttttcgcgcacgaatacatcacgcagcctcgccttgacactgctcaagggataaggggaaggagctgagatagaactgagttggagcgttgcagcggcacgagcagtgaaaagagcgaagagaagagaagcagataaaagaccaaagtagcgatgatacttcgatgtttggagcgatttttcctatgtgaatattagaaatcatatgttttgtatcagctgaacagtgaatgatgtgctcaatactcaaattcatctttttgtttgctaaaaatagcttaactggcacatcatgaaaaggatgtagaaattatagagtatatttactactaagaactatataaaaacacagtgtgatgaaaagtcactgatcaggctttaaccaccgtagacgccagaaaaaacagacctaatctgatccatgccgtagccggagtacaaacataattgtagcaaaatacgcgatttttgagggtttaggtagccagatccaatggcgtactctggggcatcatctggaggaactgtaccatctgctgttcttctgctgtgaacaattggtataccatactcttcataaagttgttcgtttacaatactacccgtagcagtccaggaaccagctccagaacccgccaacacgataccttttgcgcccaggtccttgacggcctttactattagctcaggattcaagccttgataggagtacagaataatgacttctggaatttccgaagggtctgtgaggttggaaatgtcaaaaaattgccatccatttggcttgactggtgggtagtaaaactccacgtcatcatttgaaaagtaacctaaatatccctgttcatccgctctgaatgtatctaaagagttggcattcattttcgttgtccaaaacccagaggcaatacgatcgtttagagtgatcatcgtgccacgacccagtgatttctcagaagcagcaatagacactgcttgatataaattcattgggccatcagcagacgtggcagtggctggacgcatagcgcctgcgatacatactggcttctctgaatttatggtcaaatctaagaagaaagctgtctcctccatagtgtcggtcccatgagtgacaaccgcaccagcgtagtcatcagaggctagtgcctcggagataccgtgatacaatgggatcagatgcgtatagtttaaagaatttgaaccaacgttagacacttgaagatagtccagatttgccttctcagctaaagatgggacggcttctattaaatcatttacggttaatcccacgctataacccgccgttgttgcacttgtcgaacccttggaagcgatagtaccgccggtaccaaaaattttgattgatggcaaagaagaattcttctcttcacgaatttttagtagtggagcaccactggacattgcgacaaagagagaaagtaaaagggtatttaaagatctcatagttggaggttggtgagtaccagattgcttacaaaagaatagcgagccaacatttgctctgcctcaggcctcttggtgctgcttgaagactcatcttatatggcttttgtatgtcatgatttgttcttgtacattatgtgttgatattaaacaaattgatttttttttttttgcgatagcaagcagataatgaaagagacaaggacttggaacatccgataagactgcgccgatatcgatcttacagtccttcccttgtgtcatgactttcggaaaagcatcctcgtcgactggtagtttgctgtctgtcacgtgctgaagggtctgatacatttttttaaagataagagacggggtttacccttcggaggactaagcgagatctccaagtaaagatctcgcttatcaagaaagcagccaagtgtggaacgtccttttttttggtttcaaaaagatattcaacagtttacactgcagctttaattgcctcaaaaggatatcatgaggtgatctagggtcagaagggaaagattacagcatcttgagttgaatcacatctgcaaaaggtggtattattgacgttgctcttccttaatggaaactcatggggtttggaaaggaggtgcggtaatctatttttttcgaacacaaaacctaaccttgaaaagaaactgtccaatttcattgaacttacctcagaacgggccggagtctttgctttcagtctaacatggtctaatttcttcgaaaagcttcatttaattgttagactgtggttttacaaggaaaaaaccagtgctatactgaagcgatacccagaactaattaccttgtgtgacgattcggctcagcgaaacggacatggtaaaattgggaatttgaaagcaggcagcagccttgtacagcgacatgacgataggtttagaatccccatcacgtacgagttgaagaattctacgaaggctctatgcgttattcctctatcggtataaagtgtagcgttgtaggggggatattggtggtttagttgaatttgcgcaacgaaattatagaactcataaaagttcaattcaatacttgaaacccttaacgttggttcgaccatcaattgtttggacataatagttttattctgcggccgatttcaaaatttagtaaatcaaatgttgaagcatcaccagtaggatgaccactcccatgacaaaactccgtcccaaagatagcttgatcatcctaagcgggtcgcattttactatccccagttccgaagaataacaaggctcaatgcatatgctgtttatcgtgctcacaaggcggtatgacgtttttagcaatgtaattatattaaaaagatcttcagtcactatgagtggttgattgccccatagagagctataagccgacgtgaaagctgctggttccagcttggctcatgtcgtcaccagtcactagtcacttggtcgcattcattgctactcatctgcgagtgagcatatttgagatctgacttgccaagggattagaatcacgtaagactcttgatccttagaagatatttctgacaaagaaccacctaagccatgcaagttttttttttcatttggtggcgaaacaaaggtgatgaaagtttcttcttgtacaaacgccaagcccgataggtgagacaattcttgaagtaatggacctctgagtaagcatatcagtcgaatgaagttccaatatgcgttggccaaggaacagctaggcagcaactcgcgcagtggcgtcaaaaaactaataagtaaacaccactggcttccggaatactatttctctgatctctcattttctgttgtacagcagtgggacagtagagccattgaaaaaactacaatcatatcttgtatgcggcccgcaaaccaagagatttatcctttgagacattgtgagaccctccgttcgcaaccgtgctctctgttttcatcactatatgcacgctctttccaaagctcctgcactttgcacgtggcggagccatcgcccggcttccatatgtacggctgccacacctaactatttcggttgcggccatatctaccagaaagcaccgtttcccgtccgatcaactgtagttaagctggtaagagcctgaccgagtagtgtagtgggtgaccatacgcgaaactcaggtgctgcagttgttttttttttcgcgcacgaatacatcacgcagcctcgccttgacactgctcaagggataaggggaaggagctgagatagaactgagttggagcgttgcagcggcacgagcagtgaaaagagcgaagagaagagaagcagataaaagaccaaagtagcgatgatacttcgatgtttggagcgatttttcctatgtgaatattagaaatcatatgttttgtatcagctgaacagtgaatgatgtgctcaatactcaaattcatctttttgtttgctaaaaatagcttaactggcacatcatgaaaaggatgtagaaattatagagtatatttactactaagaactatataaaaacacagtgtgatgaaaagtcactgatcaggctttaaccaccgtagacgccagaaaaaacagacctaatctgatccatgccgtagccggagtacaaacataattgtagcaaaatacgcgatttttgagggtttaggtagccagatccaatggcgtactctggggcatcatctggaggaactgtaccatctgctgttcttctgctgtgaacaattggtataccatactcttcataaagttgttcgtttacaatactacccgtagcagtccaggaaccagctccagaacccgccaacacgataccttttgcgcccaggtccttgacggcctttactattagctcaggattcaagccttgataggagtacagaataatgacttctggaatttccgaagggtctgtgaggttggaaatgtcaaaaaattgccatccatttggcttgactggtgggtagtaaaactccacgtcatcatttgaaaagtaacctaaatatccctgttcatccgctctgaatgtatctaaagagttggcattcattttcgttgtccaaaacccagaggcaatacgatcgtttagagtgatcatcgtgccacgacccagtgatttctcagaagcagcaatagacactgcttgatataaattcattgggccatcagcagacgtggcagtggctggacgcatagcgcctgcgatacatactggcttctctgaatttatggtcaaatctaagaagaaagctgtctcctccatagtgtcggtcccatgagtgacaaccgcaccagcgtagtcatcagaggctagtgcctcggagataccgtgatacaatgggatcagatgcgtatagtttaaagaatttgaaccaacgttagacacttgaagatagtccagatttgccttctcagctaaagatgggacggcttctattaaatcatttacggttaatcccacgctataacccgccgttgttgcacttgtcgaacccttggaagcgatagtaccgccggtaccaaaaattttgattgatggcaaagaagaattcttctcttcacgaatttttagtagtggagcaccactggacattgcgacaaagagagaaagtaaaagggtatttaaagatctcatagttggaggttggtgagtaccagattgcttacaaaagaatagcgagccaacatttgctctgcctcaggcctcttggtgctgcttgaagactcatcttatatggcttttgtatgtcatgatttgttcttgtacattatgtgttgatattaaacaaattgatttttttttttttgcgatagcaagcagataatgaaagagacaaggacttggaacatccgataagactgcgccgatatcgatcttacagtccttcccttgtgtcatgactttcggaaaagcatcctcgtcgactggtagtttgctgtctgtcacgtgctgaagggtctgatacatttttttaaagataagagacggggtttacccttcggaggactaagcgagatctccaagtaaagatctcgcttatcaagaaagcagccaagtgtggaacgtccttttttttggtttcaaaaagatattcaacagtttacactgcagctttaattgcctcaaaaggatatcatgaggtgatctagggtcagaagggaaagattacagcatcttgagttgaatcacatctgcaaaaggtggtattattgacgttgctcttccttaatggaaactcatggggtttggaaaggaggtgcggtaatctatttttttcgaacacaaaacctaaccttgaaaagaaactgtccaatttcattgaacttacctcagaacgggccggagtctttgctttcagtctaacatggtctaatttcttcgaaaagcttcatttaattgttagactgtggttttacaaggaaaaaaccagtgctatactgaagcgatacccagaactaattaccttgtgtgacgattcggctcagcgaaacggacatggtaaaattgggaatttgaaagcaggcagcagccttgtacagcgacatgacgataggtttagaatccccatcacgtacgagttgaagaattctacgaaggctctatgcgttattcctctatcggtataaagtgtagcgttgtaggggggatattggtggtttagttgaatttgcgcaacgaaattatagaactcataaaagttcaattcaatacttgaaacccttaacgttggttcgaccatcaattgtttggacataatagttttattctgcggccgatttcaaaatttagtaaatcaaatgttgaagcatcaccagtaggatgaccactcccatgacaaaactccgtcccaaagatagcttgatcatcctaagcgggtcgcattttactatccccagttccgaagaataacaaggctcaatgcatatgctgtttatcgtgctcacaaggcggtatgacgtttttagcaatgtaattatattaaaaagatcttcagtcactatgagtggttgattgccccatagagagctataagccgacgtgaaagctgctggttccagcttggctcatgtcgtcaccagtcactagtcacttggtcgcattcattgctactcatctgcgagtgagcatatttgagatctgacttgccaagggattagaatcacgtaagactcttgatccttagaagatatttctgacaaagaaccacctaagccatgcaagttttttttttcatttggtggcgaaacaaaggtgatgaaagtttcttcttgtacaaacgccaagcccgataggtgagacaattcttgaagtaatggacctctgagtaagcatatcagtcgaatgaagttccaatatgcgttggccaaggaacagctaggcagcaactcgcgcagtggcgtcaaaaaactaataagtaaacaccactggcttccggaatactatttctctgatctctcattttctgttgtacagcagtgggacagtagagccattgaaaaaactacaatcatatcttgtatgcggcccgcaaaccaagagatttatcctttgagacattgtgagaccctccgttcgcaaccgtgctctctgttttcatcactatatgcacgctctttccaaagctcctgcactttgcacgtggcggagccatcgcccggcttccatatgtacggctgccacacctaactatttcggttgcggccatatctaccagaaagcaccgtttcccgtccgatcaactgtagttaagctggtaagagcctgaccgagtagtgtagtgggtgaccatacgcgaaactcaggtgctgcaatcttttttttttttccgcgcgcaagcacgttacccggaccccgtcttagcacacgcacacgcacacgcagcgctcacagaccagcgaaacagacctgagagccacgatgcagcacacgcttacccggaccgcctctctgccagaacgctcgagcagcgcccacagcgccgctactgcgttacccgcacttcgccgcccgccagacagctgcgagactctcgtcccgctactgtgtatcttttggttcgtcttcgttagtatgagcccgctcccgccggctcgtgccaacaaatcagacaacaaaggcttaatctcagcagatcgtaacaacaaggctactctactgcttacaataccccgttgtacatccaagtcgtatacaaatgatttatccccactcaaaatgacattgctatccgccggcaagcacccaaggcctttccgccaagagcaccgttgctagcctgctatggttcagcgacgccacaaggacgccttattcgtatccatctatattgtgtggagcaaagaaatcaccgcgttctagcatggattctgacttagaggcgttcagccataatccagcggatggtagcttcgcggcaatgcctgatcagacagccgcaaaaaccaattatccgaatgaactgttcctctcgtactaagttcaattactattgcggtaacattcatcagtagggtaaaactaacctgtctcacgacggtctaaacccagctcacgttccctattagtgggtgaacaatccaacgcttaccgaattctgcttcggtatgataggaagagccgacatcgaagaatcaaaaagcaatgtcgctatgaacgcttgactgccacaagccagttatccctgtggtaacttttctggcacctctagcctcaaattccgagggactaaaggatcgataggccacactttcatggtttgtattcacactgaaaatcaaaatcaaggggacttttacccttttgttctactggagatttctgttctccatgagtcccccttaggacatctgcgttatcgtttaacagatgtgccgccccagccaaactctcctggcgaaatttattgtttttacataaactgtattatgaacagaaggtagtagtgcattagaggtattacatatcacgtgatgtttatttctttttacctatatatggattgaatattagagttaccctacgttcaatttctagattctatggtgttacccctgatgagttctgcatctgtcctatctacctattttaccgttttggacgaatattaaagggcgggtaacacaaatactgtctgcgtaatcaatctttttaggactaattaagggtagttccatagttattagaatcgtatttctcgaattgaatttccttccctatgataaacttctacactggaaggtcatcattattttttgttaagtactttacgaatgagaaggtagtttatcagcttatatttcaggtccgttgactttttctggctacagttgttttcaactggtgctgctgcaggatataggaagtcgaagatttatttttttgcacagcttaatgttcctggcgaaaaagcagcgaaatcgagaggtatttactgctcagagatatgaagaggtaggtacatattcattggcagatattctacaatgcaattattatgacccaatcacacagtattgtgctgacctccattgagcgatgactaaaaaaacttttagtagcacgtttattattgctttcccttgctgctataagggaaaattcagtaaataataccgaagatataatggtgtttatcagatcagtgtgatgtgttcagctaaatggaaagctacagatgctatctgatcgagatattgcaagaaaaggtctcacagtatttttttcacgtgcttttttttcaaggcaatgaccaatatgaaacgatcgatgagcatagtaaacagtattatctggataattctgtatgcaatggtaacggataacttaaaatctttatgttaagtatatacaattgcatcacttttttttttttggcttgtggcttatattaacaaatttattgtgcattttttgcaatctgaagggctgctttaatattgaatacgggaagggccctttcacaccccactataagtgcagttttaggaagaaagtattaatgtatccttcaaaaaagaaaatacacgtgctgttaatataccgacatcgtgttttggggaatgggtactagagccgccgatatctattcatattttttatgtagcaacatctcatttgaacaagaatttattgacatagaactttatacaagtatgaagagaaattagaaattagcagagatgtgaaatgaacttactaataaatcggcgtggtcattggttcagtttttcttcgatataggatacattagggacagtggatgtatttcctagggcaaccattgaaactggtttgttttgtaatctgtaatttgcccacataataatatcatccttagtgattttatcaacctgctcgaaaacttcttctggtgataatcttttacctgtggtcaccacttgtctgcctatatcttctacaatggctgtcgatccatccaacgatagcaacagagctgcctttagctgagcttttgccctattcacctctgcatccgatattttgccagattttattctcttccactctttcaggatctcattaacaattaactgcacgttatgctcattagaatcagttactatgtacattccccacagacctgaatcagcgtaagaggtggaaaatgacatataagaattagccaaagaaccattttgacttgctgcaacagctaatggagagggggagtttgtacctgtgccaatggctctgtcccagttaccaacaatcgcttgtgttgccagagctacaaaataatcaggtgcagaccatgacacgccttctaatgcgatagcaatatgtgttgtaggtaacgtgttttctttgataaacctttcacctctacaaaaaactggtaatgggccccttggtgatcccaacgggacaggcgattcagatttgggcacatggccaaagtatttttgagcatactgtaccaatttttcatgatcaacagcgcccgcacctgccaataccattctgtcgcctttatagttcttggttatatagtctttcaaatcagttcttgttattgattttatgttttttataggacccagaatggttcttcctaaaggttggtccttatacgtaatctcatgaagatggtcaaaaacaacttcatcatacatcttgtccacctcttcactttctctgatgatgacatccctttctctctcaatagcactattatctaaaactgacttagtcaaaatatcacttagaatatcaacagcctttgggatatcttcttgtagggacttagcataataaactgtgttttctcttgatgtatatgcattcaaatgagatccgatattttcaatttccaattcaattccttgttgtgacctattctgagtacccttgaaagccaagtgttctagaaaatgcgctgtaccattgttttttacgttttctgccctagaaccagcatcgacaaatattccaacagtagccgaagatgtgttggggatgtactctgtggcaattgtcaacccattaggaagtttagaggttctggttcctggaatttgtgaggaaattgtacttaaaagcctccgtgtattacggaacttggatgctgttcttgaaaacattgtatgatcacctatcactttgcgcactagtttgatgcctgagagcaagatatcatgatttatccatagcgttcaaattcacttcttattactaaagagatgagtccagctcgattacgaatatcactaaatacgtgaaaataatattggtcatctaatctgtgcactgaacagtagtatcacccattgttggctgagaaattaagctcagcattttagctttcctcactacgtgttgaggaatttaatacgtaaatatagtcttagtaaagccgtgcattttacttcttaactcctttggacgggatcaagtttaaggagaataaaaccctgattcgcaccttcaacgcggctctaacatggtactatcagactctcacatccagattggagtacccttatccgaagtaacgattttttattacggtttaagataataagggacgcgtatgataactaaaaatcgtcagttgaagggcgctggccataggtatcccttaattttgacgtcgaatttcatagaagcaaacctatatattttcagtccccagtggacagaccgtttatcagttctaatgaatcagcaacgattctcaaaaaggttgccccaattcttaggaaagtaggaatgtcatcgactaagtttttgaaaccactctgcagaataagggcttttcatacttcaattgccagatcctttaccattccttttctgccaaagattccacagaaacctggaggtgtgagtgggaccgcaaatgattcctcttatatgccgcccgaaagcagagctcagggttcgtaccattggattgtcgagcgcggactgtccttagcggttcttccgctgatcgcagttcccttggtcactacaggccctatttccacttttaccgacacatttctttccttggtcctgctaggtcattgtcatatcggatttcagtcttgcattatagactatatttctgaaagagtctatggaaaggtacatcattacgcgatgtatttattgagcttgggctcctttttatcgttcgtcggtatatataaattagagagtcaagaagctggtcttattgcctctttaaaatcattatgggataacaaacctgtggaaaaaaagaggcagtaatcatcaattaatcaatatggtttggttagtggtgactaccttttttattctcgttatatatgtgtattagaaataatttaataaccgattatttattgcttattttactggtcccagttttccaacaggacttcttttatgggcaaagtgaactcaccctcttcattgacgtattttcttgaccaaagttggccagtattattgtgttccataggtatcaagtgcgttttagtttgcaggccaattttcgttattatgcacgctgaatgcaacgctatttggtcattgaacaactctggaaaattgacagtgctgccatgtctcttgtcgtttaatatgggctgatttaaaatttgagagacgtgatttcgaatctgatgtttttttcctgtaaccaattgtaaaacaatacaattttcgtcaacttctttgaacttagtaatctccctaccaccatgtgaaatcaagaaattatatttaggaccatatttaatttcatagttatttggtttgttgaaacgaccggacgactcgacaatagctacatactttctttgcaacttataaccgttgttgccgcccttttgtaaaaatctagagaattttacacttccgtctttagtctttgcaatcagcatcccccccgtaacacaatggtctaacctatgtacagtacgacataattctacttctctatgtgaataataaatagccttgaatctttctagtagtggagtagggtcaagattaggatgtgtcctgccccatgttctgcagtctggtggttgagaaggtatgccaggtggtttattaactatgaagtaatgcgtgttttcaaagattattggtatctgctttttcagagacattaaaatatatcctaactgatcctgatcttatagccattcatacattgttccttttttttttcctcttaagtaacttcgtgggcctaagaaaaaggtaatatgcaaatgataaaaatgcaacagttctcaaaaaaggcattctgccaaaaaacgtgaatactctatgtacgctatctaaaattcaatttaacgctattaatgaaattgtcatgattgaagtcctctctgttggaaatgtagctttgaataatatcccttccaatgtctgctaaatgaccctccttagttagtgattctaataattcaggttgaacagtaaatagatttgcaagttctctcaaagtagcaaatttgtcaatcaaggacgctactccccaatcttctattgcagtttggtagcctatgatatccttcgtaactacaacaccgccaatggaattgacttgaaagtgtgaataatgtgacagtagtaaaccgtataactcttccccaatcaacgttaaaaatgtctgtaagttttttcctttaagaaacttggaagactgttcaaagattaagtttaaaatattgacaatctcaatagccggtaaggtgtcttgatccaatagctcttgagattttggcacaaaatccttcttcttttgcttgcacaaaattgcggaaaatttagtcgaaattaccgtaatggtctcttgcaaaattatattaataagtatttccatcttttgaatttgtgaatttgtcatctcaataatctgagctttaatttctggcgaattatttaataatggtaagaaaatggatttgattgaaattgacaataaatctaatatctccgtgctcattgaaataaatttcaagaaatttaagtttaccactcctgctgttttattaatatcaactttacaaattttccagtaagcgacttctaacgcaatttccatgtacgaatcaacaattcccaaaaacattatttttaatatttctaggatgtatagatgtgctttgtttggaattagttccattactcttgcagtagactccaccacacattttaacatagaatcaacatcgttcaaagaatagttcgccggactgtttggactgttatcaatatcgcttgctgtaaaactagaatttaccaaacttgaagagttgtttgctacatcatactgcgtagaagaagagctgttgttaaacgaatcgctcaaagtatttgtacggtttagactcaaatgatctttatctaaatgagttttcaaaaaggaattaaattgtgacaatttactccttgatgttgaatcttgacgagagtgtgtattccctctaggagaatgcatgaatgcatccacattagttgatagtttctccttatacttatctaataaaaccctcttgttgatttctttatcatagtttacagtaaacttggatgtcatatccactagaatcgcttccaaggatcttttctcaataccgaaatatttggacctatcatatagataatgcgaaaacaaatcagcaaaacattgttctagggttgttgataagatttggttactgtcgtcaatttctaatagttgaaagtaatcaattaaacttttagtgaacttaccaaataaagtgaacagtccgtgtaatattctcacataagccaaatttgagattgacagggaattcctcaataaaacctcaaatcttggttcaattttttgagcaaaaactctttgaataaacaattgtatcacatgagttgccttttcttcaaatacccttttaacaatcttggattcattttttattacagtttccacatcatttatcaaattttgcatggatgtctcgatgataacactgtggttctcaaaatcaatcagctgttccttaaacttcacgttttttatgaaaacattctcaaattcattttccaagtcaatctgcttggtgtcaatgaaataatcgtgctgattgatgaagctttgaatgacattaacaccgccattaaaattgttgagaatgatggcaatttcatttaatttagtaaaattattctctctatatgcagaattaaaattctctaacagctcattttccatcatttcagagtacttttcaataaccagctttgtgtttattgtttttggtattgaacttgtctctagtttggatgataatatcaatagattcttcattaatttcacggactttaagtttaatttccagtttttagacagccttaattgttcaacaatatctgattttcccatggaataaaagtcattgtacctgcgaatcaattccacactttgaatatagttttgctttttcttgattgcggtttctaatttatctcccaatggcgaaacaacttgagtaacatttgtcaagcgatcatctagcttgtcgaatgtaagtaaagtagtatgcaaatccttggataattttatcacattctccgaatgaataacttcctgagtagccacttgctcggaaaaatactgtcttttatttagtgtttcctcatttaagttttttagttcctttaaggtagattcaaaagttctaatgtaaggttttggatctaattgtttccaaatagcctctctgattgcatcctgatccttttcattggttggaagatttttcgtgtttgcatcaatcaacacgtcattacgatggtctttgctcaattcctgaacgaattcattgactgttaatccgcccaggaaattgtccgttttcaatagtttcttccatttcggatcgagttcatataatgagttcatgttgtaacaccacttgatgacaaagcaaatttgctcaattttctatatccctttaatgcatgaacggttctttattttgttttctgtcgacattctagtttttcggaatctcaaaataattaattacatatacgtacataagtagcccagataaacaaaaataccttaaaaaagagttactagccgtatatggatgtttgaagatacatggaaaccgtctctggtgtcgtgtatataagaaacttctagttttattcagacgcactcattatctttgctacataacatttctctctgatttgactgcgcatcttacccctcccccatgcatgtggagtcataggagtaattttaaaggtagaatttcatattaaatatcgctgcttgattattttgtagcaaatcaaaagagtgtttcaagtaagtaaaaacatttgagcctccccatttgttgaaaggagagaaattaaacttggttggggttaattatttgatgggtatattaatttgcaaccgcaaggtatcgataataaatattctacaaaacctttatcaatagtggtgaagtctttagtgcgatctacctggggttaatgaacgagaagttcttgagatatctttcctgtttacctccgtgcatcctgtaaggaattgggtttatcatttatcatttattttagtacaaacttttttttttggcccgggcgcactttttcaagcggtgggaactcatcaaaatgaaaaactagatacttttagacttattaaatggtttaaatattttgagatgttcgttatatcagaaacttccttacttctatcttttattccaatacaaagaagtcacaagattacttggtaagaaagaagcagttaatttttaattttgccgacaagccaagatgcaaattttcgtcaagactttaaccggtaagactattaccctggaagttgaatcttctgacactattgacaatgtcaagtccaagatccaagacaaggaaggtattccacctgaccaacaaagattgatctttgctggtaagcaattggaagatggtagaactttgtccgactacaacatccaaaaggaatctactctacacttggtcttgagattgagaggtggtggtaagaagagaaagaagaaggtctacaccaccccaaagaagatcaagcacaagcacaagaaggtcaagttggctgtcttgtcctactacaaggtcgatgctgaaggtaaggttaccaaattgagaagagaatgtagcaacccaacttgtggtgctggtgttttcttggctaaccacaaggacagattgtactgtggtaagtgtcattccgtctacaaggttaacgcttaagtaaagtatttttaaaacttatatattttaattgatcgttaaattttgaaaaaggcttttaatattgtcattatttacttttctatttacaacaaaagaacaaatgaatagatagacagtagaggaatataagtagtatgcagtgccatgcgggatcaaggaatttgtatctctaattttcgtggttgtatgcgtctctaaacaagtcaatattttgctgtaagatggttctgccgctcctttcagttcctttaagaagcgtacctgcagatattttaacatcctccatggtttcattgactttactgacaagttgattgctcaagtcatcaacatgtttttcccaattttcactaaatacttgcaaaacagcatcgaatcccattttaccctttttagcgttctcgcaaaacctttgaactgaccaatcttccatcttattacacagctttctaatggatccatatgctgtaatttgggcttcctgctggaaaagtgttttattagccgagtcatcgggatgcgggctatatgttacagtttcgtagacttttaatagattgcacatcgttaaattacagcttctcatggtcaagctctttttatttaagtctaccacagaaacttctctgacatgactcatattggtccctcctagcatcatcatgatccatttgggaacaccttgttttacagtaatcaaccgttcagtaactaagaccttaccttgatccttcaattctcttcttaaaacgtccactgcgatgacatgtgtagatatttcatttgggtattttttccagttagcggcggttacctggtcccatggatagttgaaatcgtaactgttttgaaacaatttcattatcgtcttttaattattctcgattattttatcttagtctgaaatctattctttcgtcctattgatgcttaaattcaaaaatatgtacatcacttcgcatgataattttatcgcctatatattctttacatttttcacattcattcctttttaccgctctgaccaatcaacgttgtgccgatgctcgcaaaagatatttttgtccgggcaacggcttttgcgacagacggtaataatagtagggccccttgcccccttctcatcttattcttctcctttcttcttcattccattgttttttagtggtcctaactcaataccctttcaagattatcgttgctctccatggtgtccatcacggtcacatggtgcagtacttccttcctactgctctctgcgatggagccatcgcacataatcatctcattcaagatatcgtagaccttactgaagttaaatataatgtctagctcacaaacattgccgaaatatgtgtccattgtttcgacaaaccgatggataatttccaaggtcagcagttcattgtcaacatcgggcgtcatcccaacaataaaatatagactagcatatcgcttgtatactactttgtggtcattatactcgatgatgttacacattttgggttttcttgctaatatcgtaggtgtcaagtctttcacaatttttgccttttcaccagcggacattgccgtgtaccatttctttaatctgatttttccttgcctagaaaccagcaacaaatattttaattgcgtcatcttgtgtacctgtgtatccgtatataatctcctccaggatcgctcttgttcttggctgaaattgttgttataacttcttgttcattcattgccatttttacacatatcgttagggcccgattcgtttgggatcgaattgttacccgactgaaaggatctattcaatatacattataaaaaagaaactacacatgagcgtgtgcattacctttactcgtcgctgtcgtcttctgtgggtgggacccatgccgcaggtttgaagtactcttggtcatttgccacatctttcccaaacttttctttgtcgtcggcaaactctagcaggtattccagctccaattcatgacattgtctgccgaggatgacaagcgaatgaagtggctctcctgaatcgtaattggctaactcacttatggtaccagacttaaagctttgggagctcgagcctaatctactaattgcgactgctggagtatcaggagtgtatgcctttgtacctcttttctcttcaatttctaataattgttcacaacattgagcgatagacatgtatcttggtggttcgtagattagtctgccacgggccatattttcaatgctttgttccttaactttgatgtccaataacactaaagtatgaaggccaatttttctattttcccagatcttgtcgtaccatgagtctggtctccaattatcggtaaagaaaaccatggaaacggtttgaccgaaattgtatagttgtaggccacatgccccaactgcattcataacggacgcattatgaataatttcgacgggaattgcctcacgtttagctctgagaactaaatctgtgtgtgtggtggcaccaaatggatcgcccacgaccaagaaagcaacgtcttccttatcggcgttatttaggatctgcttagaaccagtctcaactaattccctatcagccaagatgatctctttaccatagtaagattctaactcttcttggcttgcagccattaggatactggtatagtgttctagataaactctagaacatttcttaatagcttccaaaccacgaacggtaatgtctgatttgtacgagagaccaagtccgatcaaataaagcatttttctcactgtcctttattcactctatatcctgttcgtttttactttgctaacaaccaccagaaaaaaatttcatcccatcgcttagttaacttttttttagaatcgcatgcatggggttatttaattttctctaaaggtaaatgcgaagcccagaatcaaaaagatgaactgtctaggggaagaagacacaagatcctcctgtttttgggattttttattgcttagtgtagtgcattactccttgaaccttttaagatgcacactaactcacccttacgagcggataaccaagatctagaaactcaaccactgttgagaccaaacactgaagaaagccaactcctcaatgatgaagtgagaatcaacgttgcaaatgagacccttattaaatctcgttggcggagtataaagtgcttaattatatatctgctaggtattgttttattaagtttctttggcgtcagcatagtgcagtatattaggggacatgtgccgcccacagatgtgatagaaaagaatctagttcaagtaacaaatttcaaactggtggagtttcagcttgatggttggaaagataatatgggctctgacctgaacaatgatacaggtaagtatttgcaggtgtctatacactctcaaatttggttcgattatgacaaatggccaggaacggaaaatgactcggacgccagaagccaacgtgactggatacggtacatcaatgaaaaagttcttaaaaccatttgtatagatctgaataacgtgaccacattcgatggagatctagtgttcaagaataaactgggagatgttgttggcatggaacccatttgttttaatttggctcaccgacagattaataacctacagttcaaaattttagttaaaccgtctatttggaaaatcgtaaaagttttgaaaaaattttggaatagggattttgaatccttaaatataaaatcgaatttagatatgactatcttcaagagaaaatttggcacgaggtttaatttattgaaacttaatgacgaaatcttagattggaaagatattattgattgggaaaaaatatcggcaacgccccttcggatgattcaaaatatgatcgatggaatatctcttcaaggatttacattgcgggactccagttctgatggatttcatgccgatatgagactgaatccgatcacgattcttggaggggtggactggcttcaccttccgccaggcacgtcaatccctttcatcaattgggaaatcaagctaccggactgtaacggtgagcctgctatcgcaattccaaccttgtcttgctttaacgaaccgattaatctgcaccacgacaaggataatatcgtcgtctgtttacaaaatgaaattgaaggtcctctgcccgatgaactactataccaagaatgtcctcaaaatagtcttacaccaatgagccaaatagtgaatgcggtcctgaaccagaacgagactgttacgttcgcagcaagaggccatgtccttgaagatggtatagataataactcattgattccagcagacatgctggaggatattttccaagaagcatcgtttattcccattactaccaatgctacgtttaactccagtgaattgattcaagagtttcagatcaacgatcttcagctacggtgggcagcgcgcaaaaagctcagtcttgtggggacatttttaggattctttgatctatccttctacgagacgcaccagcaagaccgagttcgcatcgataccattcggggacagatcgatctgtaccataacgacatcaatttcttaaacttacccatgaagcaatggatcaactcttcatcgcacattctgcacgatgaggacacaggaaatacgcagatgaagcttcaatttgatctagaaaatgacgacatggaagtcgtcaatagcttggaactaacacgaaccctgaacgaaatactattccagggttttacagttattcactttaatgcgacgatagatgcgtcacttacgacggcattgggcccgtgggttctcaccgggttagccggagagggtgacactttggtcacgtgaacgtctatctatttatttttataactccgggatgtcattgccggtggtccgaaaatcggcaaataaggaaataagggaagaatatgcagtagtcaaatcatcagtgttctctttgatacctttcagggctaggaatagtgggggtggagtataatatcaaaaaccggacttaacattattggttcggttggaattggctataggcaaactagtctccggcatgatatataaatgacagcctgcaattgtatgttactacactcttgacttgtcgactacagtcgctgctcaggcacgagaataggaggtaagaaggtaacgtacgtatatatataaaatcgtaatgacaaagattaaggtagctaaccccattgtggaaatggacggcgatgagcaaacaagaataatctggcatttaatcagggacaagttagtcttgccctatcttgacgttgatttgaagtactacgatctttccgtggagtatcgtgaccagactaatgatcaagtaactgtggattctgccaccgcgactttaaagtatggagtagctgtcaaatgcgcgactattacacccgatgaggcaagggtcgaggaatttcatttgaaaaagatgtggaaatctccaaatggtactattagaaacattttgggtggtacagtgttcagagaacctattattatccctagaattccaaggctagttcctcaatgggagaagcccatcatcattgggagacacgcattcggcgatcagtacaaagctaccgatgtaatagtccctgaagaaggcgagttgaggcttgtttataaatccaagagcggaactcatgatgtagatctgaaggtatttgactacccagaacatggtggggttgccatgatgatgtacaacactacagattcgatcgaagggtttgcgaaggcctcctttgaattggccattgaaaggaagttaccattatattccactactaagaatactattttgaagaagtatgatggtaaattcaaagatgttttcgaagccatgtatgctagaagttataaagagaagtttgaatcccttggcatctggtacgagcaccgtttaattgatgatatggtggcccaaatgttgaaatctaaaggtggatacataattgccatgaaaaattacgacggtgacgtagaatcagatattgttgcacaaggatttggctccttggggttaatgacatctgtgttgattaccccggacggtaaaacctttgaaagcgaagccgcccacggtacagtaacaagacattttagacagcatcagcaaggaaaggagacgtcaacaaattccattgcatcaattttcgcgtggactagaggtattattcaaaggggtaaacttgataatactccagatgtagttaagttcggccaaatattggaaagcgctacggtaaatacagtgcaagaagatggaatcatgactaaagatttggcgctcattctcggtaagtctgaaagatccgcttatgtcactaccgaggagttcattgacgcggtggaatctagattgaaaaaagagttcgaggcagctgcattgtaaacttactcaatgacagattgatttatttatattatatattccctttttatcgaaaaacttttagtattttctactcgtaacatatgatcttctgttctcactgaaaatttttctttcttcttttccctcttcgcaaaaagaaaatgctgaaaaaatttgaaaaattttcaaatgatgagatgtttagcttaggaaaaatataatgtaaagatagttttcagaacattttttattggtttttttttttaaagattcattatcatctggagttcgttacaacctacacagaggaccgatatacacaatgtcaaaggaggatttcgttattaagcctgaagctgcaggtgcttccactgacactagtgaatggccattacttttgaagaattttgataagttattagtcagaagtggtcattatacccctatcccagctggtagttcaccactaaagagagacctgaaatcatatatcagctctggtgtcattaatctagataaaccttccaacccatcatcgcacgaagttgtagcttggatcaaaagaatcttacgttgtgagaagactggtcactctggtacattggatccaaaagttacaggttgtttgattgtttgtattgacagagctaccaggttggttaagtctcaacaaggtgctggtaaggagtatgtgtgtattgtcagattgcatgatgctttgaaggatgaaaaggatttgggccgctcactagaaaacttgaccggtgcgcttttccaaagacctcctttaatctctgctgttaagagacaattacgtgttcgtactatctatgagtcaaacttgattgagttcgataacaagagaaacttaggtgttttctgggcttcctgtgaagctggtacttatatgcgtactttgtgtgttcatttaggtatgctattaggtgttggtggtcacatgcaagaattgcgtcgtgttagatccggtgctctgtctgaaaatgacaacatggtcactttacatgatgttatggatgcccaatgggtttacgacaatacaagagatgaatcttacttgagatccattattcaacctttagaaactctattggttggttacaagagaattgtagtgaaggattctgctgtcaatgcagtatgttatggtgcaaagttgatgatccctggtttattgcgttacgaagaaggtattgagttatatgacgaaattgtcttgataactaccaagggtgaagccattgccgttgccatcgcacaaatgtcaaccgttgacttagcttcctgtgatcatggtgttgttgctagtgtgaagagatgtatcatggaaagagatttatacccaagaagatggggtttgggtccagtcgcacaaaagaagaagcaaatgaaggcagacggcaaattggataaatacggccgtgttaacgaaaacaccccagaacaatggaaaaaagaatatgttccattagacaatgctgaacagtcaacttctagctctcaggaaactaaggaaactgaagaagagcctaagaaagctaaagaagattctttaatcaaagaagtcgaaactgagaaggaagaagtgaaagaggatgacagcaaaaaggaaaagaaagagaagaaggacaagaaggaaaagaaggaaaagaaagaaaagaaggacaagaaggaaaagaaagagaaaaaggagaagaaaagaaagtctgaagacggtgattctgaggaaaagaaatctaagaaatctaagaaatgattctcatcactccatctcatcctatatatttaacagctttctttttttcaaaaaactttttctattattagattagattttttttagtgtgtatattaataacgtaaaatttctttatcaacgacttgtagtattcttttacttttattttttttacatatgcaacgttatattcttttttaaatatccccatatactaatgatagaacttttaaacttttaggccattgacgaatttcatgacttcaaaacagtagttcagcaattggcccatgacattatttagaaacaaccatgatagcaaattctcatttgattttaagctaatatcgccgattattgcattcctgaatcttgtgctgcaatcaattaatttcaagcacgaaaatttgctttgtagggaaataaaggaacaaaaatctttaatcatttcatttaaggacttgcattcgatagacacagagggatcattgctaacgctcatagaggaatttaagaactttgttacgaaaacttgacagaacccttgtaaatgttgcattattgtgtttgtctctgaatttgtatcgtcttcattaatcatcatttccaaaatatcgtctaaatttacaatattcttccagtcattattcatgccacttttaaatataggaaaacttttcaagaagtttagaatgaattttaataactttattagttttttcactagtttggtaaaattattaataattgataacttcctttgcactagcgcttttggtaattctaaaacagccttattaatttgttcgggcaatagcttgatcatactttccagtttttgaatgattgagtcactgatctcattagaatgaattataaattgtgaaaaaaatttgattaaccctgtataggtgattaagtcacatttagttacccaatcaatcaatggctcagaaatgaatagattaaacatcgtgggcgatatagagttagagttagagaagaataatgcatttgatatattatcactcttcagaaacttgatgcattcataaacggagttgcaatggatatgatataatgactccaaggatgatataacatccgaatcagtgtctgtggggagtacacctgcgggaatttttgggaagtctaacttatatgatgtcaaaagcggatgttctgtgttcgataatatttgggtattatagttatctgatagcttgtcattacaattgaaaactttttcaattaaatcatgagtgaaagttaattcatctgaagacagtgttccggtagggttatttgccgctggtggcagcgaatctagtttatttgcttctgtttcgtttggatgctgtgattcgagttctggttcgttagggttgtcattactactctgtttaacgggcgacccagttcgagaaagactttttctatttaatgagaacggcgatgaaacgttaggtacctgcggcgaaggtgaagagggcgatggagacgataggggcgatatgggatcgttattgtgtactaaggataacgaagcattgttgttattaagggacacggagccgctttcgttgacagttagtttcaatccgcagtagtggtatttggattgacctctcatacccagccttctagtcgttaaatcaggaaaaactgttcttatcaacttccctaatgacgcctgtgataagggcttcaggttgttttgggaacaagatgaagcgtattgagcaaatattttgcctcttggtacgtaactatcgtgctgagatttacaatttttcattaaccaaagtaacgcaaacacttgtctttctctttctctgttttgttccgccagctgcaaagctgcctttgaagtgttctgtgagtccatgctcaggactttgatttctgcatgcttcacgatctgcgcatactcctcgatggttttagatttgttattttctgcaatttgcttagcaattatttcttgcgtgtttctccttgaaatggaagagattcgtttctcttggcttgttttctgttttttcgtactgcttggaattgaggggaaggtattggtacgtttggcagcagtaggaggattattgtttaaggtttcctctgacttgaaagaaagtgggtaagcagatgaattcgatctattcaggctgatagacgctggatacactgagtatgtggcaggttgccgttgtgttgcgggttgtgcaggaggctgtgtaggggtaggagatggtttatgggagccgggaccactaccgataagtggcggtaatattggatttggcgtctccgggcggggggaactttggtgtagcaggctgtatattgacgatgatttgctcgctatgggcgggatattcactgacatggggggcaaataagtgtgtgatgctggcggtggttggctgctgtacttgggtgcgtttaaactgtaccgattactgtttaccgaagatccgttacttggaccgttgctattgtcgttcgagccccgactagtaggttcaatgttattatcaccggacatgggcaaataaaattcaaaataatgaacagacaaaaaactaggcgagaagatgaagtacttggcaggtatttttctagtgaaaaggttttctgttggtttgcgttctttgaagattaccatttactgctattttttttttcaactttttcccaaatcgccatgacaacacgaaacgacaggagaaaaattacgaaatcaaaaacaggttcaactgttgcagcaatagacaccacaaacgtgcgcaagaaaccgcaacgaaggggaggtgaccgtgcttgaaataaaatccgaagatccataggtgagccacgagtttgattccaaactcgtggttttaccaacgaagctgtatatcgtggagtggcgctaccattggaccttcgtttcttctttccctcttccgcaccgtaccagataggaaaaaccgcaccttcgtttttgcatacctagatggtcctgtaacaagaatagagctaaagaaacaagtatgcgtcgactgctgccacgcccggctgatttaggtgcacatcagctacccagcatacaaaggggcttccgtacggttgatggttatttttcttggtgtgttggtgctgctgtatcgctggtgctgtctgcgttattacgactatcgtaggacaaggcctcgagaggtgtagggtaaatcccacttgcacaaagtatgtacacacttgattatccaaataccaagagagtgtggttcaatttacgggcagctcgagctgcccgtaaattgaaccttccccttccccacgctcaaggggttcctgcgccggtgtttcaggggcaggacacgcggggatcgctggcacagtatataaacaataaaagaacaatggagagaggaggcgccattcaatatcagctcactagagtgcatagacgtatagacacaggaataaagatagaaatagggtaccatggagctgccttcaataaatagcaccacaagtatatccgacaaccaggagttaaggaattactatgacaagttgctgttcaagaacaatagtggcaagtcgctagcggatttgccaggaaaaatggcagattttaacgacaacagcgctgctgcgcatccccgctccagagttgactttatcaacggttacatcggtttcagagaggataagcagtctcttctggggcagaagaacactaaaagggcctcgttcagcgcatttgcggacgaaggaaggaaacagagcgagatgagcattaacgggaagagccctaatttgtctcttttctcatttgagtttaacggcaccccgactcaggacagaaagccatacaaacaggattacttgaatgtgatgaacacttcgcctaacaatattctttctcccttaaacaacagctcccaaaaatactatccacagaaacagcagcagcagcagcagcagcagcagcagcaacagcaacaaagcatctttgacccgggaagaagatcttcctatatttctgatgcgctgattcatggcaatgcggctacccagcaaccacaatactcgcaacctgtatatattaacaacaacccatctttgcaagtaccatacactgctccttccgagtatactcagcagcaacagtactcgtcacccttcaatgctaggcgcaacacccagccagtgctgaacttgcatccggcagccgctcccacaaacgatgccggattggcggttgtcgacggcaagaatttgacgtcatccaaggagctgcatgacttatatcttgactgcgggtcaaactattttgctagtgataaagtttataaatttattgacagcataaagggaactttacgcggggataatgtctccgcctccagttccaggattatagagtttttggattttttgaaaaattgtaatctgaattacaacccacagtctgacgcattcatctccactgctgtttcaaacgcttcgtcgaccggggcggccaaatccaagaacagcacttcaatgcatttgcactataagccattagtgttagtatcgttgaaaaatggtaagctcgaactgttgtctaaaccacaaacggccacacttatactgaaaaggggcgatttggtcattattgatggtgatcgtggtaaagatttagttttggtggtggaaccggttgtagatataaatttggcactatttataaattttttgaagaaaaaaattcactttgattctctaatcaccaatagtcaacagcatttccccaatgaccagtttatcaagactctggttgatacaaccaatggtaagccggtcgctcatgagttgaatccgaagttatatgatatcattgaactaacgcaattgatcatcccatcaaagcaggttctgagatttgccaccccgtgggaatcctccacgaatttacacaacaaattccaggatgagctaaaggctcttcacattgcacagctaaaactgaggtcgctaaataacaataactccggtggcgggttgaacatcaaaatattgaatgcagagttccaattcgacagaaagaaattgactttctactacatttgccaggagcgtaatgatttcagagacctgatcaaagaactctttaagttttacaaaacaagaatttggctttgtgctataccgaacaatttatcgatagattccaaattttatgattcaaacaagtttgagtgggagatgtatcaggatatgatgtcccactattccatggacaacactggaattgtcgtggcccctgaactgaatcgcttgaaactggacgacttccagatcggtgtttatatggaattggtgaaggttttgttcggctaacccaaacttatataatcattataaacattttataaacttatacacttttttaataatctcaccatgtttttcttatgtgttttgtttgacaatgacattactccctacaaacatgtgcgcgtttgtgacaaaaacataaataaaacaaaaataataaaaagtcaagtgaaaagcactgaaatctaaaaaataaatacatatacatatatatatatatatacctatttcgtttccgcatagaagaaattggaggcaactagttgcaggttgttttccttagcccatttgccaacaccggtggcaggggtgccgtaaccccagttcggtctatccttaattttcgagaacttagatgagtccacgcccttaggctgcttatataacaagaaaacatatctgtggggaccggatcccttgggtggagctggtcccatatattctattagtgtgttcgagcccttcgtattgaactctgatgcaaaaaattcggttgctccggaggtctcgtgagtagcctcattcaacagctttaagtcgcattctaccaagtggcagaattcagaccacttgtgatctgtcttagagggagcatccggatcggtcattaccagtgtgaacaaatcgtcgtcttggggaacgtacgcattcgcctgtggtacgcttttttgcatttgcttattgaacgtgaactggaattggggcttggaacgtgccttctcagtgggcagcgtgttacccatggcaacaggtgcacttgatgagtactctacggcaagtatcccggagggttgaaagcttgtgtcatgaattacatcctccagaatgccgtgcttcttgtaggagtcaatgcttgcttgtgcgaagtctattgcttggttcatgttttttgcttgttctcttgttcttgtattgatgcactggtagggaaaaggagcactgcaattcgtttcttgctgccccctttttatataccaattgagatctttccttccctgaacagcccctctatcccttaaaagatagaaaagttcaaagggataggaaaaatcaacgagccaaaaaaaaaaaaaacggaaccgttcggcatgtatatattcactatttcatatacgcgtttgcacaatatactctatcttatccgtatctatacgagccggttgctgcaccttacatgtcatagttgaaatcaacggtcgtgttttcgaccatgtaataattggcaccgaccagttgcagattgttctccttgatatagtcataggcacccgcaccaggagtaccgtacccccaggagataatgttctcaaccttggtaaaagtggacgaatccgctcccttgggttgcttgcacaggaagaacacgtatctgtgataaccggagttctttggtggaccaggcccaatatagttatttctcacgacacccttccccgaaatggcaatatctcccccaggtccgtactcgacaggaatatcagtgatgatgtagtgacaaacctccgaccacttatgttctgttctagagggcgcgtccgggtcagtcatcaacaaagcgagtttatcctcggctgacaattggcttttatcgaagggcgtgaacttgatggtaggagcggcttgcgtagcttccattggcatgggattgcccaatttgatgtcgtcagaatcaacgtacgaaaccgacaactcaccaagaatctcgaacgccaagtccttgacggtgtccttaatgatgtcctctttgttcagtttagcaacgatggcactagacataatatatatttctattactaagtactcggatgggtaccgaaagtggcagatgggcagtgtttactcaaacaattgatggcaacattcaattcctcacctggtgcgcacttccaataatgagcacgcttggcacttttatattgttcaaaaaaatgtcaggcaagatcttttgaaaaaaaggtaccgaaacggacgtaagacggaaatagaatttgaagataaagttatatatcactacacacgaatactttcttttttttttttcacaggaaaactgtggtggcgcccttgcctactagtgcatttcttttttcgggttcttgtctcgaggaaattttagcctcatcgtagtttttcactctggtatcgatgaaaaagggaagagtaaaaagttttccgtttagtacttaatgggattggtttgggacgtatatatcgactggtgttgtctgttattcatcgttgtttttcggttagcttcgaaaaaaaaatagagtaaaaaccaggaatttaccctaaaaacaagaaaaaataagataaacgaaaatatggccggtacatttttattcacttctgaatccgttggtgaaggtcacccagataagatctgtgaccaagtttccgacgccatcttggacgcttgtttagccgaggaccctcactccaaagttgcgtgtgaaaccgcggcaaagactggtatgattatggtctttggtgaaattactaccaaggcacagttggattaccaaaaaatcgtcagagacaccatcaagaagattggttacgatgattccgccaagggtttcgactataagacctgtaacgtccttgtcgccattgagcaacaatctccagatatcgcccaaggtgtccacgaggagaaggatttggaagacatcggtgccggtgaccaaggtatcatgtttggttacgccacagatgaaactccagagggtttgcctttgactattcttttggctcataaactaaacatggccatggctgacgcgagaagagatggctctttagcgtggttgagaccagacaccaagactcaagtcaccgtcgaatacaaggatgaccacggtagatgggttccacaaagaatcgacaccgtcgtcgtctccgctcaacatgctgacgaaatcacgaccgaggacttaagagcgcaactaaagtccgagatcattgaaaaagtcatcccaagagacatgttggacgaaaacaccaaatactttatccaaccttccggtagattcgtcatcggtggtcctcaaggtgacgctggtttgaccggtagaaagatcatcgtcgacgcttacggtggtgcctcatccgtcggtggtggtgccttctccggtaaggactactctaaggttgatcgttctgccgcttatgccgctagatgggttgccaagtccctagttgccgctggtttatgtaagagagttcaagttcaattttcttatgccatcggtattgcggaaccattgtccttgcacgttgacacctatggtactgcgaccaagtctgacgaagaaattatcgacattatcagcaagaactttgacttgagacctggtgtattggtcaaggagttggacttagctagaccaatctacttgccaaccgcttcttatggccatttcacaaaccaagaatacccatgggaaaagcctaagactttgaagttctaagcttttttccttttggacttttttctgccttcaacctcccatgttttcatttgctcaacacaagtcaacatgtacattataccgtatttgatgcagggacgcaataccatcatattcttgatatagactcatttttctcaaatcaaatttgtatcgatttcattttgcattatacaggattccttttcctttctaacatttaatacgtaactactaatattaatatatacctccttcaacggatcaacaaaccaaactttatcttattcaaatagaatttaacagatccaacgccttagttaactcatctttggcggtgggcaggtcttcataattcaatgcgcttatggcgtatttggcaagtttttgaatttgctctattttactggccctgtccataatttttgtcaactcatcctttgtatacgatttatgctctgctgcagcaggttctgatggtgcagaagggcgcgtaagatccacttctttcttcacaacttgttgttcgtcttttgttattgcatcttcgttcttgtcgacggtctgttcttcttcgtttacgctatcggcatcatcaataaattcaggtacctcatccacaggctcgtatgatgttgtttggtcttttggggctaggccttcgactttatcattattattgttttccaaatcgcttgtctggtgatcaacatcttcatccttaatctcctcgctatcatccgcaaaatctgcataatctaacgttttctcgtcgctggaaccaatttcaccctttgccaatttactcaaataaattttgcaatacttaattcgtttttgtaatgaatttgtactcgtttcacttatattttccttccacaggtgtaaaatgcatgaaaataaatcaatacaacaccaaagtgatctttttaacataacatcccagggaccatcttttagctgtttcagtttctcgttatacaacgacattgtaaaatttagcatataaattttggctttttcttgatcatgtattagcgtgttcataacgtgtaagcttttgtcactgtcttctgcttcactctcgccgccaatctccttcttaaacgcttcaatagtatcaagaagttctgtcgctagtgcggtcatctcttgcgaccgatcttcttcactcagtatcaattccaccgcatataactgaagatagtatccgatgatccctaacccaactttgtcaaaatccttcgctgtagcgacaacccttgcagcgttactagccatagaatttatttaaaatgtggacaattagtttctaaaaattgaatcaaataaaataagaaagcttattgttcctttttttgtcttcatctggaccgtttggataagatcattcaccaaatcttagtttttttttttagtttccttctccaacgatttcataataataaaaaaaaacaacaaaaaacacgattgagaaacatcaatatgaactaagcaatagctaaaaaaaaaagaataataaaggggaacacagtataattctcgagaggatggcgttggaagaagtggtacgatacttaggacctcacaatgagatccctttgacactcactagagactcggagactggccatttcctcctgaaacattttctgcccattttgcagcaatatcatgacacggggaatattaacgagaccaaccccgatagtttccccactgatgaggaaagaaataaattactggcacattatggaattgctgtaaatacagacgaccgaggtgagttatggatagagctggaaaaatgtttacaattattaaacatgctaaatttattcggtttgttccaggatgcattcgaatttgaggagcctgaaacagatcaggatgaagaagatcccagccattcgaaactaccagaaaacaagaccaaaagtgaaaattctaaggataatatcagctcaaagaggattaataatttacaagatatgagcctggattctgatgcacacagagaattaggctctcctttaaaaaaactaaaaatagatacctctgtaatagatgctgagagtgactccactccgaatactgccagaggcaagcctaacgatgatattaataagggccctagcggcgacaatgaaaataatggcactgatgacaatgacagaaccgctggacctatcataacattcactcatgacctaacttctgactttttaagcagtccactgaaaatcatgaaagcactaccttctccagttgtaaatgataatgaacagaagatgaaactagaggcattcttacaacggttgttatttccagaaattcaagaaatgcctacatcccttaataatgacagcagtaatagaaattcagaaggggggagctcaaaccaacaacaacagcacgtatcatttgatagccttttgcaagaggtaaacgacgcttttcctaatactcaattaaatcttaatattcctgtagatgagcatggaaacacaccattacattggctgacttcaatagcaaacctggaattagtgaaacacctggttaagcatggttcaaacagattatatggtgataatatgggggagtcatgcctagtgaaagctgtcaaatcagtaaataattacgactctggtacttttgaggcacttctagattatttatatccatgtttaattttggaagactcaatgaatagaacaattttgcaccatatcattattacgtctggtatgactggctgttcagcagctgcgaaatattatttagatattttaatgggatggattgtcaagaaacaaaatagacccattcaaagtggtactaacgaaaaagaaagcaaaccgaatgacaaaaatggggaaagaaaggactctatactagaaaatttggacctgaaatggataatagcaaacatgctcaatgcgcaggactctaatggcgatacttgcttgaacattgcagcaagattgggaaacatttcaatagtagacgctttattagattacggtgctgacccatttattgcaaacaaatcagggttgagacccgtggattttggggcaggtacttcaaaattacaaaatacgaacggcggtgacgaaaactcgaagatggtctctaagggtgattacgacggtcaaaaaaatggaaaggccaaaaaaataaggtctcaactgttgaaaaacccacctgaaacaacttcgttaattaatgatgtccaaaatttactgaattcaatctcgaaagattatgagaatgaaacagtgcaatataatgagaaattagaaaaactacacaaggaattgaacgaacagcgagaagaattagctaattctagagaacaactagcaaatgtgaagcaattgaaagatgaatactcactaatgcaagagcaattgaccaatttaaaagcaggaattgaagaagaagaggaaagttttagggaagagagcaaaaagctaggaataattgcagatgaaagttcaggtattgattgggactctagcgaatatgatgcagatgaacccttcaaagtagagttcctttcagatttcttggaggataaattacaaaagaattatgaaggcgatatttccaaactattagaagcggagtcgaaagagcagataatggaacagatacgaaatcaacttcccgcagaaaaaatccaatcgatgcttccaccaacggtcttattgaaggcaagaataaatgcatacaagcggaatgataaacacctaaccaatgtattggatacaatcagcaccaaacaatcagaattagagaataaatttagaagagtgttatctttatgtttgaaaatcgacgaaaataaagttgacaatatgcttgatggtttgttacaggccatatcttctgaagacccacaagacattgacactgacgaaatgcaagattttttaaaaaagcatgcttcatgagggcatgtgatttcattgcattaacttttatgactttatttgaagttatttttttgttttagcgctttatttacttttattttactacataactgtattcttacaaaatttttacgtactcagatgggatatataggcacttgatgttttattttcttgttcttatcatatatccgatggaataaaatgttctattttgctggctttttccaaaaatattgtttatgtgtccttctacaagatcttaagcctgtccttccaccttttaatgaactcaccaagtttcttctctcgtaatcatcatcgttttctaaatcgtagaaatactcttcgtccaatggtttgccggcggcgtccttaccatgacggtaaatgacaccgacacatttcgcgtcgctcaaaatcgaacgtaattcatctcttgaaagctcagaaatttgtgagttcacctgctgtaattggaataatggcgtctgctggacgtttgcaaaagctaggtgattggttaaaatatgctgtagatgcataacatcaatatttcttctagatagctcatccaaattctctttcaccgatttttttggctttgaaggtaagaccctcttgttaagttttggtttcttcatagtcataggatttttatcagatgatagtgaatcttgtctcagggtttgttcctcgtgatcaacagaggagacggatgaaagtggggacgatttagaatttaggaagtggtttagcatcctttctgcaacgccagaatcactaccaattgagattttgttgctatccttaagtatttttttgggtctgtccatcgaagtgtcagtaaaaatcaatggatgcttccttatactacccatatgtttcgtttcactttcactttcaaattcagctttcttctcgaatcttaacggctctgaagaagagtttttttcttttaacgaaatgcgaagtaaaacctgcctaaaatccaacatgatacccttgtaatatgtcatataaacggtgtctccctcttccagagtgaaattaatgaatcctccctcgtcttgaatttctttaacacatttttcgttagagaatctgggaacaagcctatatgccctattattgttattcatggtatcctttaattgataacaatcaaattgcttacgataggtaacgattaatccgttcatactgaagcagtgaatcttcacttcatttgtttgtggtaaataagttatactagcgtgtactctggatatgaacttattcttacagagcgcaacatcacattgcgaactattgcgccctacagtaatggtgctgatcttgctaggatctagttcagcattgatgactctagtatgccttgaaggagaagaaagtttggaagaaaacttgggtgacgtttctgccaactggccaggaaaagctggagaggaagggatggcgtcaaccttattcgacctaacgggagacgaaacccttcctatactggaagaaggaaatggagttggataatctcctttcccgaaatttccaattgattctgacgcagttttaccagctttctcataattggatgagggacaattaggctgctgtttgtaatttggtggagagtacggatccactgtcctgtagggggacgaaggaaattgcgagctcatgccttcttgtgattattaatctttgatgtgtcgtggcagatgtatatggacttttgtacgtaaagtagattgctataattcaattctaaatgaatgaaagtagagaaagagtttccattgatgaattttagtttacgtcgactgccgctgttcattctcatcaaaacacgaaagcaaaccatagagatgaacttaagaaaaaagggccacgggatttttttttcgcgttttggcgttttcatatcaaaaaaaaaaaaccatattaacatctgtacattattattaactaaacatccgtacacaaaaggttttccaagacaaaacgttgtcgagactattctctttcgaagaaattctaaaacacacttcggcaggccggcaacaagaaggcggccccttggggaaagggaagtcaatccgtctgcccgttctctaggctgatggtaggcagggcgatgccatactggtgaagtgtggtccgtcggtctgtctcctccaaacgttgatgttctcctggtagctttctcatcaccgtcaatattacaagtgtaagaatgagaaatgctctatatgagggtactattaaatttcaaaaatgtttacttttaagaggtatttgctaaagcctcatacaaataatatagacaaaaatgggtagtatgtagtaggacattgagaataaaactgtgaacctgttattgacgaccgtggagaaatgttatgattatctgaagagaaatatcggaacgcatgcacaccaaatttatacttagcaagactggacgatacgagactggtatacttgtatgaagacagaatagtgaacgaaagacatgcgcatgacaacaaatttaccgtatagaagaaatattctgcttgtatgcctgagggaactcgaaaggatcaatttcaatggcgttgtaacagtcacgaaaaaagtgtaactataagataaagcaaattgtactaacaaacttaaccaaattgcacaacaatttgattttctttttaaatagagggtactccttcattcggtaaacgtcacaacaagtcccacactttgtgtaacagatgtggtcgtcgttctttccatgttcaaaagaagacctgttcctcctgtggttatccagctgctaagaccagatcttacaactggggtgccaaggctaagagaagacacactactggtactggtagaatgagatacttgaaacacgtttcaagaagattcaagaacggtttccaaaccggctctgcttctaaggcttctgcttaatttttatactaagatctatttctttaaatgaaaactcaataattagagaccttatataataaccaactgcaaaaaaacttctaaacaattagttaacaaatctccagcctttttttaatatatctttattcatatgtaacgcctttgagtgcttacgggaaaagtagaattgatagtttcgtaattcatgaccggaaaaagtgaaaaattattgttcgatgaatatatacagagatgtcttgaactgtttttgccagcatcattcgttatagggagcaaagttagtgcaacccagttaccagatatctagtcaccaagaagaaaacccgtaaaatcgtaggtcatggtcgaagattccagagttagagacgccctcaaaggtggtgatcagaaggcattaccggcctctttggttcctcaagcacctcctgtcttgacatcaaaggataagattactaagcggatgattgtggtattagcgatggcatccctcgagacacacaagatatcgtccaacgggcctggtggtgacaaatatgtccttttgaactgtgacgaccatcaaggtttattaaaaaaaatgggtagagacattagtgaagcaagacctgatattacccaccaatgtcttttgacgttgctagattctccaatcaacaaagccggaaagctgcaggtctatattcaaacaagtcgaggaattctgatcgaggttaaccccactgttcgtataccaagaactttcaaaagattttcaggtttaatggttcagttactacataagctttctatcagatcggtaaattctgaagaaaagttacttaaagtcattaagaacccaattaccgatcacctacctactaagtgccgtaaggtgacattatcctttgacgcaccagttatccgcgttcaagattacatcgaaaaactagacgatgatgaaagtatatgtgtctttgttggtgccatggcaagaggtaaagataactttgcggatgaatacgtcgacgaaaaagtcggcttgtccaattacccattgtctgcctcagttgcatgttctaaattttgccatggcgctgaagatgcttggaatattttatagtgtttaagtctacttggcatcctctttgtataataaacagtcaatatacgatatagaaacaatcgagttagcgattaattcgactgcacctctatccttcccccacgcgaaataatggttcggaagtcatctgaacgaggctcagtctttgaatatttcacctaattcggaccctgaacggtgaacaaaatttcaatatgatataaacaaaacgtggaagaactcttggcaaagacaaaggataaagagctcgttggaaaagtttttttacaactgcaaacggcacttaatattgctaattaacttgccagtatcatttccctagcgccttgccgatttggtctttttggcactgtttattcttactaaacgatattcgtaaaacggaaatcaaagaaaaccaaaattgaagtcccaaagcgtggcaataaaagaacaagtaactgcaagaacaccaagaagctacagtaagaaatgaaaaggattttctctggtgtgaagtccccaaagttatctgctcccccaaaagttttcaaaaatgatgagagcccatccactccgagctctcccaaattcgaccaagggcttcgaagtttatcagcatcagcttcaagactcttcagtaactcaatatccactcctgggagccctacgttagatcttccgcaagaacactctattaatggtgatatctcaccagaactagtaccaatcgttactttactctctgcacaggctcataggagataccattatggtatattcttgatattacatgatttgaagacagacggaacacctgccgcgcgtcagtgggaagaatgctatggtgtgttgctaggaactcagctggctttatgggatgcaaaagaattatcagattccaagaataataagaacacatcaaccatgaaaaaagccgcatcgagaccttcttttatcaattttacagatgcttctgtgaggagtttggacgctaatgatcaggtaatcattgcatcagagaacgaaaagacaaagaaagatctagacaatgttcttgttgtttcaacaactttaaaaaacaggtatttcttaaaattcaaaaattcaaaatcattcaaaacttggaacgcagcaattaggcttagtttgttcgagtttacggcgttgcaagaggcctacacgggctcatttttgtcaagcagaggtgttaaacttggtgatatcaaagttgttatggcagatacaaaattcacttatgaggactgggttagcgtaagattcgggacaggtatgccatggaaacgttgttatgctgttatttctccacagtctggcaaaaaaaagaaaaattcgaaaggttcaatatgtttctatgaaaataacaaaaaaaccaaaaaatcaaacataatgacaacggtagtagatgcacgggctttatatgccgtttatccttcctcgccgatattaatcgacacatctacaatcataaaattggaaggttttgtctcttttgacaaaagtgaggaacctcaagaaaccaacctatttatcatgcctgaaaagcatcaaggtgttccgggatatgacactattattcgcttcttaatcccagctatgaacgcgttctacttatatggtaggccaaagggtttgattgccaacagaactgacccagactccctgctgtttgccttacccactcttccgcatatatattatttgcaggtggatgacgttttatcattaacaaaagacaaaaattacatacattggagtgctgctgattggaggaataacattgttcaagtattacagaaaaaattaagtaagggctataaaggctgtggtaataaaactgtatcagtttcatctgggatgatgaagtcgccggcaattagttcagctgaattatttgaagggtacgattctctccctgaaagacaaatggaaagtccgcaaaaatctaagatgaagtctcctacattagcatcgaccgatgatattaattccgcttctgcttccgtaaactcacatgctacctcagtaaaacaaactgaattatttgtgactgataattcttcaaaaatcaatgactctgtgtcggcgcagtccagtgtcactactaacttcaaagatacttttaccaccccaatgacatcaggaatgctcaaccatgaaaattcagagagaagctttggttcaggattaaaactcaaaatcactgattcaaatttggaaaatatggaagacgttgaagcgaaatctgctaacgaattctctacgacaccagaagacaaacatattcacctcgccaatgcagccgaattatccgccctttacgacaaatattccacatctccgtttggtaaatcggaggctaattcaagccctaaacctcaaaaattggaagttaaagatcggtcaaaaaatgaaaacagaagcccctatgagagatacgtaggtacatccgctgaaagcaagacatttgaaataggtaacgtcagagagtcgaaaagtacgataaatacttccctttcttcgcctttgagggtagaagatagtagacgttcaaaaaatgaggacctgggatctttgaaagagtttgaagagttatctcaaaagattagcaatatgggaatggcaaatatttcttcagaagctttaagtgacacagcagaaaacagttcttttgttacggacctgaacttgaatatcaataacagttcatcggtcaatctcaatgaagaacaacgtgtgccggattttggggaggaaaacgtatttgatccagattatatggaacaaaaccaaatgttggaaacagaaagtaggtacactacggatgagtttgacttttcagataatcaggatgcagcatccagtaattatagcaatgggcaaaccaaccgaacagtaactgaaaccctttctgccagtgacagaaatgacaagatcccacattcttctttatttacaaacttaaaccagcttacttcgaatggaggaaactatcaggatagggaagatttctctggtgatcaaataaacaaacctcaacaatctcaaccacttcatgtgaaaggaccacaaacttcgtcatttggttacagaaattcttcagccaatagctcgcagcctcaagcaccatacccggttggtcgcccgttaggtaagataagaacgggtccgctgaccgtccagcctatgcaacaaggtggaaactcatcaatgtattctttccaatcttcgcaacatcggtttcattcgtcgcaacagcgccaaaaccaatcactttccttcagaaacaatacctatggaagtggtaacaatcaaaatacattccatccatcgccgcaactgcaacaacagcctcaaaatatgagatatttgaataataagttaccaataaatgatagatctccaataccgcaaacacagcaccatgtaccagatggccgtcccagcctccatataaataccactaaccgcacaaatccgcttactgcacaaagtggattttctcaatttatgcctcccaatagcacatcaaccaacccatattccagctgattcatttatatttcatcttttcttttttttttttttacaattcagtagttttatataacttcccataaatgtattatttttttaatacgactataatatacctctatacccttatttatctctttacctttgcttttaagctaaacaaatcttcattaacaggtattatattactggcgtcgcgtttcgtttaggcgcatcgagccgagacttcagaatcacaaatgctttgtatatatgttacgtattcagtattgcccaacatgcaactagattcaactaagcagacgtgggtacttacatgagaagcagatcattgaaattttactaagttaaagaagaggaagggctccaatgattgtaagaatgatacgtctttgtaaaggtccaaagttgttgcgaagtcaattcgcatcagcaagtgcactatattcaaccaagtcattgttcaaacctcccatgtaccaaaaagcggaaattaatttgattattccacatagaaagcactttttgttgcggtcgattcgattacaatcagacattgcgcaaggaaagaagtccaccaagcccactttaaagttgtccaatgcaaattcaaaatcctcggggtttaaagacattaaacggctattcgtcttatctaaaccggaatccaagtacattggtcttgccctccttttaatcctcatttcaagttcagttagtatggctgtaccttccgttatcggtaaattattagacttggcttccgaaagtgacggcgaagatgaagagggctcaaaaagcaataagttatatggttttacgaagaagcaatttttcacagcattaggagcagtatttataattggagcagttgctaatgcaagcagaatcatcattttaaaggtcaccggtgagagactggtcgcaagattaagaacgagaacaatgaaagctgcattagatcaagatgccacatttttagatactaatcgtgtcggtgatttgatctcaagattatcatctgatgcatctatagtggccaaatcggtcacacaaaacgtctctgatggaacaagggcaattattcaagggtttgtcggttttggcatgatgagcttcctctcgtggaaattgacttgcgtaatgatgattttagcccctcctttaggtgctatggcactgatatatggtaggaaaatacgaaacctatcaagacagttacaaacctcagtaggtgggttaacaaaagtggcagaagagcaattaaatgctactaggacaattcaagcatatggtggtgaaaaaaacgaggttcgccgctatgcaaaagaggttagaaatgtatttcatattggtctgaaggaagcggttacttccggtttattcttcggaagtactgggctagttggcaacactgcaatgctgtcgttattattggttggaacaagcatgattcaaagtggttcaatgactgtcggtgaattatctagtttcatgatgtatgccgtgtataccggaagttcattatttggtttatcgagcttctattcagaacttatgaaaggtgctggtgcggctgccagggtttttgaattaaatgaccgtaagccattgattcgtccgactattggaaaggatcctgtgtcattagcccaaaaacccatcgttttcaaaaacgtgtcattcacttatcccactcggcccaaacaccagattttcaaggatttgaatattactatcaagcctggtgaacacgtttgcgctgtcggtccatcaggaagcggcaaatcaacaattgcgtctttgttgctcaggtactacgatgtgaactcaggatcgatcgaatttggtgatgaagacatcagaaatttcaacttgaggaagtatcgaagactaataggatacgtgcaacaagaaccactacttttcaatgggactattctggacaatatcctctactgcattccgcctgaaattgcggagcaggatgatcgtattagacgtgctattggaaaagctaattgcacaaaatttttggccaattttccagatggattgcagactatggttggtgctagaggcgcgcaattgtccggtggtcaaaagcaaagaattgcattagctagagcgtttttactagatcctgccgtccttattttagatgaagcaaccagtgcccttgactctcaaagtgaagaaatagttgccaaaaatcttcagagacgtgtggaaagggggttcactactatatcaattgcacataggctttcgacgatcaaacacagtactagggtgattgtgttaggaaaacatggctcagtggttgaaaccggttcattccgagatctaatcgccattcctaatagtgaactaaatgcgctgcttgccgaacagcaggacgaggaaggaaaagggggagtgatagatttggacaatagtgttgcccgggaagtataagaagttgccgcagtatggaatcacttttctatgccacagttatggtatgtgttggaagacaattaattatcgcattatgtttgctgaatatgaaattgtgtattctataatttaaatgatgcccaatgtaatttacacaaacagtttttttttaaagctccttgtacgcctttatacacattaaattaatattagatgcacaacatacggtacgtttaggaaactcaaattaagctttatttttttacttttttattattgttactattattcttattatcaacattatcgttttcatatctttcctgagtacaaatatgactgaaacttacaaaaaaaaaattaattatttattactattaatgattagatgttacgcttttttataaaagtgagagtgatactcggtttaaatcatcgtccacccttcatccgttgtttcagcaggtgtcagtttggttgcatctacattttcctctttcttgcgcggagttttcactcttgataaagtaacgcttcttgcatactcaagttcgttgtaaattgcacttattgcagttttaatcccatcttctttggaaattttcttctttattaatccagctctatccttcattattttgttcgtcgtagctacttttaaagcatctgctaatgtttgagcgttaagtttctttaaagcaataccaactccaatgtcttctactctacctgcataaaagaactgatcaccaaagaaaggttttataacagtaggtaaaccagcacgtaatgaagctccagtagttccagaaccaccatggtgaacggcagcatcgacttgtgggaacaaccaatcatggggaacgtttccgatatttaaaatgtttcttggaagatctacctctgtcttctttgccgccttatcgcccaacctttctgaccatcccttatttaaaatgcagtatacatctgcttccataactgcttcgacaagagcttccgtcatttctttggcattagagactacaatcgaaccaaacccgatataaaccaatttttttccttttgatcttgcctcagaaataaattcttgtaattctgctggcggtttgaaagtactcttatcatcaagaaaccaatatcctgtaactctcacccactcgctaaaatcaattgatggcggaaaaattgtaggagaaacattgtataagaaaggaacattattctgctgtaaaagaaaaagatttgttttccctaaacctagagtttcaactctccacttgtttacttgcccactaattcccttccagaaaacgttttcgaaaaggacatgtgtcaggtagttatagttaccgccccttttttgatctggtacaataaatgcatgtggatatgctcttgttcttgtccatggcatggtaaatgctcgaaaataaggaatttgcaatgcttcagtaatatgaataccaaccatagctgagggtgattcaatcagaatatcaaattttcttctgttacaaacctcccaagatgtctgtaaaagagcatcgatccatcccctaaatttgctcgaagcttctctcagcattttaacattcattgattcattttccaccatcaaggacatcaactccactgggttaccagcaatctcttcaaactggattccatgactttcaacaaagtctctaaattccgaatgtgtaattattaccacttggtgaccttcttttatcaagccctttccaagtgcaatatatggttgaacatcccctcttgagccaatcgtcaataatccaaacttataactcttgtttggttttatgcttgttttatagtgcggattctcatcaatcattaacggtacctcaaagccctcggcattaattttatcttcgaaaagcttcaacttcgctgagtcagggttatgctgaacatcgccaagagaagcactcgatatattcgatccttctgcactgcttgcatatatgttatctaagagctttaaaagaatgcgttcaatatcatccctggcgacctcagtgctaaattcaaaaaatagctcctcgtgaccgtgaattactataaccaatacaaaataaccaaatcgaaatcccttttctttatagcatgtctccacatcaaccaatggcaaaaccatgtatgtattagaccctggtaataacgatctgaagcacaccgtatcattggatacgtaaatcttaccataaacgggaacatttctattcaggtatgtgtagtaagtactgattagtgacttctctttattaaacttgaaatggtacctgaaccgctcgttagcagaaacctcttctgtttctttaatcaaataggtatcatccttttgaaacgggataaacttgttccggtagtgtattggtttggcagcccacatttcggcaaaatttttgaggtgacttggcttccaagctacggtttgctcttgactatcttcttgttcatgaatatgaatcgtggaatgcacagaagagtctatatcattcgccgcatctttatatatttcctccacatcctcaacttgagaatcttcaagaggtttagctctacgaaaccaactattgcttctttctctaaatctgaatcgactctttttcccattttccgaagaaggcacagccgaagttggaacattcaaatattttgaatcctcgccgttattcttttgctcaactgtagctggtgtctcttttccaaaacttgattttgatttcttggctggaatatcataataaagtgtattaacaccggatttctgcaatatagccaactgttcgccaaggctctctttgacctgactaccggacccatccatgaaaacaaacatgaaatcatcgatagcataggtctgtgagctctccaaagctcttaatctcaatgttaaagctttgttgactataggttgatcatctatctctataatgttgggcagcggaatttttaaacttatcgaattgttttcagaattctgagctgcgaactgctcctttttcaaagcgttcacccacgatttagcggagaactctgaatctgcattgaatttgaatgtactttcatctgtgtaaagcttaaatgttttcgtagcactcccgtttaaggtatgtttttgtgtttcaattttttggacctccctcaaatctatggttaaaaccggaaagtatagctcagttgatgaggtatacatagaaaataaatgattctttagtacgcaccaatacctggtagacctaattagttttgtcctgatattaaggtttccagacattttaaccgaccgaggattcttaggtaaatatgcaaagaataggaaatgttttgttgtaataaaaatatggccttgaaccaacacatctttaagtagccatgcagggaaatcattcaaaaatggttcctgttcgtctaaacaaaaccgctgtctcaacttagccacattgtcttttgacagtttttccctagttattgagaagtcgaataaagttggctttcttttgtctaatcttggtacttccggatgcgatttagttttgagattttcctttttgctttttacctcatttcgaccaatgttttcctggaaactatcactggaatcagattcttcagaatcaacttgcgacaacacattcatttcttgagcattattcatccctgcatacacactagcagtagttaataaaccggcaatacttttcatcatatacttggatttcgccaagtcatctgcattatcgttattgtaaccgttttcgtcatcatcactacgggcttcatttggactgtcctgcagttcttgctgctcagacgaccccatcgataaactgctatttgatcttcctctccagcgcttgaacttcgaaagtgaccttgaaaggcgatgatgcctaggggaagtttctggctcagatggcttatcaggtaccaacgaaatgcttggttttggccccgcctcgctatcagacgctgatatgatttgagtgatgggcattcttttaagttatacggattttcaccaaagcataaagtgcaactgaacttctgatgtttactttttgacagccatgactttatcagtgataaatgcaatgactttccgatctactccttctgttgacttttagtcccttttttcttagatgttatgttacagtcacatcagggttaagtttttccaagtcatctcaaaacaatgacctattttatttctagataaaccctggtgtaagcagggttaattttgtcccaaacgggcaaaatataaatacccctttcgggaaataaactaaaaagagttctaattagccaattggcaagaaagctcgatgaagaatcattatgggtttagaaatcagatttccttactttacaagttctctcacgcaagcttgatcgtttttaaattttctacgttcattcaagacaaagtggttacagatagaagtttttctcacatttagattattttttcctgatagtattaaataacacgtacgatcaacaaattgttgctcagtttaagtgagcctagagaattaagctttattactgctgtattttctgttattttgattgccttgggaataaaggaaaggtttggaggggcacatcttcctaaatagcagtaaggaaaaagaatcgcgtgtgaagtcttttaaatcaacatagttatcctcggttccaactattttactttcgtttcaattccgttgttcttaactaatcttcttttcttttaacttgttacaagccagtactcattgcaaaatcaaaaaaaaaaaacacaactaataaactaaacaactaaaaaaatgaattctccaacaatgaaatcggaacaacttactccaaaactctcaccaatgtccttttgtttggatgaccaaagaaatgcaggctcttttcaaaatctattgaactcacctacgaagctaaaattagacactggcccgattggtaattccttgttatatccaacatcactctctaaattgagcgagttatcaagaggtggacgttctaaacaaagaaggggctctgacactatgaggtctgtatcgcctattaggtttcagtttttgaacaacactccaaagatgttaaaacccgagtacctatctcaaacaaccagtaatctgccattgctatctgccctattgaagaatagcaagaaaactactagtgaaggccagaattcaaaccctgatccattgaacatagagaaaaacatcattaaacaaagcatcaaggacaaactagagcagctgcgcagttcagaatccgttgcgcaagtacaaaagaaagaacgcaatcccccttcatttgaggccaaagtctgtgcggaagaaccgatattacggaaaaacgccgaagggttgctcccctcatacgttcctgttcctgctactcctttggaagatccagaaaatcatggggtgcgaaaggtcgaggacaaaggacttagagtcgtctccggcggctccactcagtgtctaagcaccgaagtgaacgaattgcctaaggatctgaatctagacaatttacctacggataataacgggttcgttcaatatggtctcaaaggcaataacaacaacaacagatatagctttatctcgtctacgtcgacggactatgagcccgaatggtgtgacggacaacaacatatttcaatgcaaatggcctctatggccaatgcagaggaggcaaatagtcgtgaaaaatcgaatttagacataaagatcaagcagctagaacttgaaattacagaattaaagttgcagaatgaaaaattagtgcattccatgacgacgaacagatacattgaagaaagatttatgcttgaggttatgaaggatcctagtatacaggctcaaagatcccaaagagatattgagagaaaagtcaagcaactggagaaaaaattcttcaattgtaaaaaagttcttaagaaattgactgaatcctccgcagtagtggccacctccacttcaaaaactgaaggaaattcagcaagaatcccatgccctaagactagactggcacgcgtttctgttttagacctaaagaaaattgaagaacagccagattcttcttcgggaacttcgtccgaggaagatcatctaacaaacgatgatacggatgctaatactagcgaagatttaaatgttgcttttgaagaggagccaacttctgctatttccacaacagcatctgtgcagagtggggaaagtaaaagaggtttccaacttaaccttcctgtccaagtggagaagaaggaaaaatgaagcgtcaacttcaaattaaattaacttattttacacaaacattcacaatacatcaatgctgataggcgctttgtattgtaggctatcgagttacgcatctgcaatgtgcgtgatttctccgttatccatccttctcattggacaatttttatttgaatattactgaacttcaaagggcttgtcgtgtgatttaatcttttttcttacaacgtcgaatgctgcagctatttattcatagtgtcgtctaagcaaataccccgcttttaaaagctgaatagaaaatccaatcacggtgtgactggtatcacaaacacataatttatatattgcattcaagtttattcaacctatacttaaatacattaattaccaaaaaaaatgatataataaagtcttcttttatctgattaatgacacctttttcagcgggccaaattttttttatttccgaagcccgccggactaatattaattatatcagatagttggtgagcaaacgcatgtggaaatgaacaacaatttcgaaagtgcatatactatctataaatatcaaggggattctatactataacaatacctgcgatgtcatccacagcagtaccacgacctaaaccttgggagaccagtgcttcgttagaggagccacagcgtaatgctcagtctttaagtgcgatgatgacctcgaatcagcaggattccaggccaactgaagaaagcaataacagtaatagtgcaagtgagtctgctcccgaagttttgccgcggcctgcggcacttaactcctctggtacctacggcgaatcgaatacaataccgggaatatacggtaatagcaattatgggataccctatgataataatccgtatagtatgaactctatatacggaaacagcatagggaggtatggctatggaggatcgtactatggcaacaattatggatcgttttatggaggagggtacggtgcaggagcgggatatggaatgaataatggaagtggactaggtgagtcgacgaaggccacctttcagttaatagaaagtttgataggcgctgttactggatttgcacaaatgctggaatctacttatatggccacacacaactcgtttttcaccatgatatccgtcgcagaacagtttggtaatttgaaggaaatgctaggttcattttttggtatctttgctataatgaagtttcttaaaaaaatactctatcgtgctactaaggggagactaggaataccaccaaagaatttcgcagaatctgaaggaagcaaaaataaactaattgaagattttcaaaagtttaatgatagtggtaccataaattctaatgagaaagccacaagaaggaaaatttcatggaaaccgctactattttttttgatggcagtatttggttttccatatctactaaacaaatttattactaaactacagacctctggaaccatacgagcatcgcaaggaaatggtagcgagcctattgatccttcgaagttagaatttgcaagagcgttatatgattttgttccagaaaacccagagatggaagttgctttaaaaaagggcgacttgatggcaattttgagtaagaaagaccctcttgggagggattctgactggtggaaagtgaggacaaagaacggcaatattggctacattccgtataactatattgagatcataaaaagacggaagaaaattgagcatgttgatgatgaaacgcgtacacactagtgcatcaatatttgcacacatatattcgcatatatatatagtaaaatctaaagtaatgtaaatattccagggagaatcagcagaaacgagacgaagtacttcttaacaaaaagccagataacggtgcaaaaacacattatattctccatcttgaaaacacaatctcctacgtacacatatgcgtatttatttttatatgaatgaaacgcctatggatatatatatgggaatatagacattcacaatttcaggacaattgtgatatggcaatatccaaggcctgcggtgctgggcttcgctttttttcaccaacaaaatgagatggacaagtttatcatagcaaagaaacaataagcagattacataaagtcgtcatcaccgaattcaaaatcgtcggggccatctaggtcgaaatcttgatctttcttaaatgcgccacccaaattggtcttacctttgactttcttcttaccagcacccccagtagcagtaccacctctaacacgggccagacgagcttgcctctcctctctttccttatctttgatcaaaacgttcaaagtagcaactgtttgtcttatagattcgatggacattggttttgctacatctctaatcaaatcaatcgctaacgatgaggagtagttcagcggagattttttgttcattggtgtaatagcagcagtaagagcctttcttaaatcctggtactctctctttgtttcggcgttaaacaaaggatgtgtttcgataggtgtgtccttggtaaaggcgggtctttttagagcttgttcctcttgttccttttgtaaagcacgagcccttggatgttcttcggcaacacctaaacccgcaaacaaatctgcagcattgtttaagtcagactccatttcagcctttttgattaattctttacgtgtcttttcatccaatgtgtcaatatccaatagggctctgtcagcggaggattctttcccttttttaaccttttttggttgttctttttttggctttggggcaggcttcttttcttcctcttctgcatcccatgattgcatgacaggttcgtcatcaccaatttcagcatcccatgagtccatcaaaacggcgtcatcattacccatagaaccattgatagcttcgtcgtcccaagacatttttattacttttttttttttgaggtggtggttaggatagaatagttacaaggaactcaaaagatagtaagataatttaaagcgagagttcaagaatggtgggagcagtcagttctcaattctttaatgtagtacttctgacttagctagcatgaaaaaaaaattcggaaaatgcccaaaaacaggtgtgttcgtctaatatgatacagggacgaccataatatcaagattagtgacatttgatgtatagtttagcagaatgactgttataaataaataattatatatgtgtgtatattaaattttgttgaaccagcgcttatttacaatttttaggacgtgaccaaatgcgagctgcactagttttctcaatttcgctcgcccatggtgatatctttaaagatctttaaatgggaacatcaaaactgaggatttctcgcctcttcgagtttttggataacaaatgccatgcccattctgcttttcttaacgttttcgtcaaatttagtgcgcgaccaatcctctaccttagatttgatacccatattgaagccacttgaaaacttcacccggctgtctgctatcgtactacttgtagcactgtcaaattgataggtagtatattcttcaaccttcatgattccagtgtgatccagattcctagtgtaagttttcattgtggagttagcggggttcactacggaaacttcgattatccatgtttctgttatacctcttaaaaagggtttgacccatgtgggcagctttccggactttttcaacagcctcgttgtgcgcaaatttccttcttgatcaacgttccttgatattgtgtctatggatagtacatggggggagtatggattggggtatctattaaaaaaggcgcgtgaaacagaggcaaaatcggtaggaaatatatgtgtgcttttgtgtaaaaggaccattgcaactcttaaggatatcttaccgccgtctcagaagccagacaatacttattgaatatgattactcatccatctgtcatatatattttttttttctagcttattatccagggagagcgagaaatactgcggagtttttcacccgaaagaaaaaaaatacgcaagcacgatgataacaatagttatattattggttacctacagtgtataaaaagaaagagttttattaaaatgcagaactatgtggtggtatacagaactgattatacattctataacaaaagggcaccaacggcgaatgcacccgcaccataagctatgtgagtgccggcaaaggcgccattggtagaattggacattacggacgctaccttaccgttgactgtagacttgtatgtagtggtcagtgtctctactgtagaacctgacgtagtggtataagttgatttgatagtgcttactaccttggtgcttgattccggttttgatgaggatcccgaagatgatttacttgatgaagccgtgttgtcagttgtggctgaggacggtagccaccaaacagtagatgtgtaagtctcacctaacgaattcgtggtagttactatagtaactggcccgtccgttgatgttgatgtcgttgaggaggatgcggagttggtgattccgcttgacgtctctccggtgggctgcacagaggcagttgaagttgtgcttacggcagagttgctttcggccacccaccataggtactgtgtcgtggttttgccttgtgcatccgtcgtcactacggtggtacttggagccacagcataggtgttgctgacgacgttgctagtttgtactaagctttttccggtagaaactacagttgatgcgctttcttgggcttcctttgtcgtggtaggtgtgatctcttgagagtttgagctttccttttgtgagctatcttcagagttctggccatctaaggaaccagagtctttttgagcagcggctagagtaattaaggtggtaaataatatggaacaggccttcattttatatatatgttgggtttgtttatattttcactagatcggtgagtatctagtccagaagagttgatctttcttacatacttatatatgctcactaccgccttctgagaaagtaggcgtttttcagctacctcagtcgctaaaaataaatgcgagttctcaagccaacttggactccaaggcggtaattatagtgattctctttgtctatttttggatttattttggaggctgacactctaaagccagccattggattaattattttttcacttcgtcaattgactatgcggaaaaactaaatgtggtcaaattctgtcggctatgtacacgaaaactatatacgcctcgtcctttcagccactacaacataacaacaccgacattgctacgccttttaatgtcgttactattgtcgggattcaagccaccggtaatcggctttgctctataattaaataaatagaagttcaagaacccgtcaccgggcccgaacttcaaatcatccaagaacaatgtattatcttgcgaagtcaacgcgttaaaaacatccatattagcgtttttggccaaaatacaagcgtcataaatcaattcacacaatcttgttttcaaagccttagtagcttttggatcaaacctgtctttgaattggaaatctgcatcggtggcataataatacaagtacccgatgcctaggtccttatattttgtgttatttaggattgtgaatggcaatgagtaaaatgagaagaagtctgtaatttttccatcgggctgttcgactacatatgagaaaattacttgtttatccaatggtaacgattcttcaccaatgaaattatgttcgaattcttcttttgtgaaaatttgaattagttcgaacctggattgatatcttttgaacaactcaaaaacttggtcaatatcttccttctttaattttctcaatcccgctgtctttgttttggccggtaacgcattctcagcaatcatatcctcctctgtgtgcccatctggtaaccctgtgaaatctacttcataaagtttcttccaattcaagggacgatgagtataacgacacgtactcacaggtgctggcaaaacaatacctgccgtgtacaatgcatgccagatgtcacatttgttcactcgtctcgtaatttctttaattagaacaggtgttaatctcttcgatcttagctgtttgtgaacgcacaagaaattgatttctacactaggcacttgtttacctctaacaccaagtgttactggtatggctgagataaaggcaactaatttctgtgtttctttaacgcgaacaccaatatgccaatccttcttccaacctggactctttaaagcccaattgaagaattctttggtatagttaaatctgaagcctgcatcgcggtcttccacgtagttttcatttagtagaacgaaaacatcttcaagctgttttttgttgtccacatcaatactacaccattcgaagctagacaataaaggtagtggcttgtcagatatatcttccggtgtctttggcttatcaatggggccttcttccaccaccttttcatcgaaatctttgaccggttgcgttctccagaatttgtggtctttcatagcttttttctgttcttgagtgaattttgaagtatcgtcattattcaactgtaataacttcaataaattctctaattttttcgctttatcctcttctgacattctataaatacgtttactaccgaagctctatgacaaccagagctattgtacagatcattctctaaaaagcgtgcaacacatatcatcttcaattatagtgaattacttttatcatgagcaacggctgaaattattttatcctattgttttatgacagtatcctttcaaaagagtcgaaaggatcctctgttgcaagaactactattacgtaattatacatagtccgcctgcaatttctagtgagactttgctttgctttccactttgcgattaatattgagaattttaaacgttaactgaattcttacccacccataataagaactctaactggcgaatttatcatgaaacaaatctgcaagaataaaaaattagagaatcgtgcaattcaatttaattgccttgtccgttgtaaaacttttccataggccctaccttgagttgatcatatgtattattctatatatattatatccagtcgggtaataaattttctcgccctcgaaaaaaagaagtgaaaaatttgtctcgatgagctgagatgagtttgaaagaagcaaagagttttaatttgtaaacgatagcaagtgtaccctcagttgagtctattacgccttccttatttggaaacttagaagacgaataaaaaaaacaaaataactaatgatttctgctactaattgggttccaagagggttttcctcggaatttcctgaaaagtatgttctggatgatgaggaagtggaaagaattaaccaattagcacagttgaatttggatgatgctaaagctactttggaagaagcagaaggcgaatcaggtgttgaagatgacgccgcaacaggtagttctaataagttgaaggatcagttggatatagatgatgatttgaaagaatataacctggaagaatatgacgatgaggaaattgcagataatgagggtggtaaagacgtttccatgttcccgggtttaagtaatgatagcgatgttaaattccatgagggtgaaaaaggtgaagatccatatatttcattgcctaatcaagaggatagtcaagaggagaagcaggagttacaagtttacccatccgataatttagttcttgctgcgagaacagaagatgacgtttcgtatttggatatctacgtttacgatgacggtgctgggttccacagtagcgatattcccgttgaagaaggtgatgaagctgacccagatgttgctcgtggattggttcgtgaccctgcactttacgttcaccatgatttaatgttgcctgcttttccactatgtgttgagtggcttgactacaaggttggatccaattccgaagaagcagccaattatgctgccattggtacgtttgatccacaaattgaaatttggaacttggactgtgttgacaaggcctttcccgatatgattctgggtgaacctcttgataattcaatggtgtctttgaaaagcaaaaagaagaagaagaagtctaagactggacacattactactcatcataccgatgctgttttatccatggcacacaacaaatatttccgttccgttttagcatccacctctgcagatcataccgtaaaactatgggatttgaactcaggtaacgcagcccgctccttagcttccattcattcaaacaaaaatgtttcatcatctgaatggcacatgttgaatggttccattcttttgaccggtggttatgattctcgagtagctttaacagatgttagaatttctgacgaaagtcaaatgagtaaatactggtctgccatggcaggtgaggaaatagaaactgttacatttgccagtgaaaatataatattatgtggtactgattctggtaatgtgtattctttcgatattagaaacaatgaaaaccgtaaaccagtttggacattgaaggcacacgatgctggtatctccacattatgttcaaacaaattcatccctggtatgatgagtacaggggccatgggtgaaaagactgtcaaattatggaaattccccttggatgatgctacgaacactaagggcccaagcatggttctgtctcgtgatttcgatgtcggaaatgtattgacatcgtcattcgctccagacatcgaggtagcgggtaccatggtcattggtggtgtcaataaagttttgaaactatgggacgtttttaccaatagatctgtacgtaagagctttaaaagtgaactagagaatgttcaagcaagagcaaaagaagaagcccaaaaaataggaaaaagttcaagaatcgccagaaaatacaccagtaacgataacccagatactgttataaccattgatgatcaaggtgaagatgaagaagaaagagaaggtggagatgagcatgatgacatggcataatctggatatgaaaaatattaaagcagagtacattgcaagtacaaataaaaaatctatagaagataatactgtatactagtgtaagaggagcctcagaaaaaaacaatataatacattaatatgtgctgttacggtataatttagcatatgatgacaatgtggtgaattacagttgtgtaacttttttatatcacccggcatatatacgctcgtagaatgcgatgtgaaaattttctttttttttttttttcaaagtgaaatttttttgagtgatgagatgggaaatgaaaaattttgtgcaattgcgtagtgtctacagttttttaagtagttattaaaagtgttttggaaggtatatttctaggagaagaagcgtgcagaacagtatttagtgaaagatggctcctattgaatacctactgtttgaagaacctactggttacgcagttttcaaggttaagttgcaacaagatgacattggttcaagattaaaagaagttcaagagcaaatcaatgattttggtgcttttacaaagttaatcgaacttgtatctttcgcgccattcaaaggtgctgctgaagcccttgaaaatgctaacgacatatcagaaggtttagtctctgagagtttgaaagctatcttggatttaaacttaccaaaggcttcctcgaaaaagaagaacattactttggctatttccgataaaaacttaggtccttctattaaggaagaatttccatatgttgattgtatttcaaatgaacttgctcaggatttgattcgtggtgtcagattacatggcgaaaaattattcaaaggtctacaatctggtgacttagaaagagcccaattaggtttaggtcacgcttactccagagctaaagtgaagttctctgttcaaaagaacgacaatcacatcattcaagctattgctttattagatcaattagataaagatatcaacacttttgctatgagagttaaagagtggtatggctggcatttccccgaactggctaaattggtaccagacaactacacttttgccaagttggttctttttatcaaggacaaagcttcattaaacgatgactccttacatgatttggctgctcttttgaatgaggattcgggaattgcacaaagagtcattgacaatgcccgtatctccatgggacaagatatatcagaaaccgatatggaaaatgtttgtgttttcgctcagagagtcgcttccttagctgattacagaagacaattatacgattacttatgcgaaaaaatgcacactgttgcaccaaacttatcagaattgattggtgaagtgattggtgctagattaatttctcacgcaggttccctaactaatttatctaagcaagcagcttcaacggttcaaattcttggtgctgaaaaggctttgttcagagctttaaaaactaaaggtaacactccaaaatacggtttgatttaccacagtggttttatttctaaggcctctgccaagaacaagggtcgtatttctagatacttggctaacaaatgttctatggcctctagaattgacaattactctgaggaaccatctaatgtttttggttccgtactaaagaaacaagttgagcaaagattagaattctacaacactggtaagccaactttgaagaatgaattagccattcaagaagccatggaactttataacaaagataaaccagctgcagaagtggaagaaaccaaggaaaaggaatcctcaaagaagagaaaattagaagatgatgatgaagaaaagaaggaaaagaaagagaaaaaatcgaagaaggaaaagaaagaaaagaaggaaaagaaggacaaaaaggaaaagaaagataaaaaggaaaagaaggataaaaagaagaaaagtaaggattaaaaggaacaatgaatcgaaataaagtatatcccatctttttgtgtacttttcttccctttaaagtttttcatatatatatatattatcttttattcccttctaatattcttctttaggatttggaagctgtatattgtatatttagaaatattattaaataaaaaagtcatatgttattttgagcttaagtaccctcttatgcctctttcactcgccattactgacattctgtgatcgccattcatatatataggcctgattgtgcaccaattgccgcgctatcacacctccataagcgatagcattcttcagaatatcttgaaggctcaaaaccaagccattgaccgcacaaatcaactaaagaacccatgtcagacaacgaaagtttctcaaatccattaggcccctcactaggcgctacaagacatttaaatttcagtcccttactgggaccgacaatcaattgtgttagcacacttcctatgaatcccgttataaattctggtggttgtagtgtacattcattttccgtcattaccttcatgctggcgattttatcagaggtgccaattactattatatcaggggagaactgggctaactgtgatatgatagatctacttatcatgttaccaaaaatcggcgatatactaatgaaattctcctccatagaaaataataacgtctttccaaatgaataaatcgggaaagaaaaaccatatactgtttcatcggcggtgtcatttttttgatcaggatcaacctcgtttggaaagttttcgtcgtaattccacgagtgtttacctgaagattggggaagacttggacttttcaccgtcaatgtagttttaatttcaccaatagaggttaattgaagcagatttttggggaataatgggttcattatcttagtagtaatgacggctgtcgaatattgaggaacatccaagtcctgaggaaactcaacttttggaaccgggcagacttctaaagattgcaggttttttgaaatctctgggagatctagcagatgttttggttctggtaagtcattccattgtttaaacttcaaaaagaatcaagtaacataagttagtcaaaccactctactctagcaaaatatgatggggaaaaaagattattgtaacatacaagcatcgctataaatgaaaattttactgtagtgcgatgatatcttggtcgctgtttcttattatttcgcctgttgccacctattgccacgcaacttcttaaattgatttcaatgaagtctgaaattttgatgcgaaagaaaaaaaaaagtaaaggcaataaaacttcatcaagtcaaacgtcatctataaataatcccacttcagaattgaaaaagactacatttgagtggaggaacaaaagcaaaaatgtctgaattaggtgccaaatatcaacagttgcaaaatgagttagaagagtttattgtggccagacaaaaattagagacacaattacaagaaaacaagattgtaaatgaagagtttgaccaattagaagaagatacacctgtgtacaaattgacaggcaatgtccttttaccagttgaacaaagtgaggcacgtaccaacgtggacaaaagattagagttcatcgaaacagaaattacaagatgcgaaaagaacataagggacaagcaggaagaactagaaaagatgagaagcgagctaattaaactgaacaatacagcagcttccactggcccaggaaggtaaaacaaactcacaggtcctcggaaagacaagaaagcgcacagtaccaataaatctgcccaaaataaaattttcttttatatacaattatgtaacttacaaacaaaatacctacgcatttcactgtcctaaacttcaaattgacatgtaagattgcttaacccctaactaattgagatttgattaaatttaccgtagacattaacgtataccaggcaaactcttcagtattgttatagtactcacccaaacgcatgaccctatgtaatttatcctttgcaaaagtaaacgtttctttgtaattgtgggatttatcctgagccataaataactttgaaccaatgtaggtgctcgaaacagccaatctcttagcataccatgcagaatcatggtggtccttttcgttggaaaagtaaatcatatcatcggacaatctgtgtagttcaggaattgcagtttcaaagagaaaggcgcttggaatagccaattgtgacattagttccgacaaatgcccaccgattggcttgtccatctccaatctttttaacagcaaatgttctaatgagggtagtttgtattgtggagttacgtcagggttgattccttcagttaaacgataccttttatctaccaattgaaactttatcagttccatgacagcggtggaagaatggaaaaacgagggcgagttgggagcacctattgaagagatcatggaggaaggatagccgagctcatttaaagattcaacaatggatctttcagagaaaccgtgctcgggaacaaacttttgtagagctagtgacaatactttatactggggtgattcttttccataagttaaaggtttaatatgaattggtttaacatgttcgatagggttcgaatgatataaacgaaagaatttacagcccgttctggcagtattgcgacaaagcatgatttataatgtggtaaagactctgttatctctttccaaattggggtgaagtaccttatgtaggcccaaaaaaaaaaaaaccccgtattattgtttcttactattgttattgctatttttcttccgcctaatatagtccgaaaaggaaaggatatgtcatggcaactgtagtcagtatactactgtataggtgaatggattagttaatggactattaggtcaaccattacgaagggggtggggttagtatttttgtatttacagatattgagatatcatacataagaaaaaaattataataacggtagaaaacgcatatatttataagatgaaagttgggcatggcctcccgataatcattgtctcttgattgtatggtaccttttacctctgaacccggcaatatacatgttaaattgataaacttcttgaggattcatgtcatttaattcccacttcgtacttccaaatacgtttctgacgggctccattaagacatccatttccttaccgtatttggatttgacaagatttatgtcgtccgttaggtctttcttattgaaacccgttgtgaagatagcacattttgtttccagtaatgccttcatagtttcacccatccatgaaccgtgagattctggagatgcgtagcctggatggaaagtaaaaaagacatccatgtatggatcgtatgggaaaaaatcttgagcctcatggaatacttcgaaaaagtttgtacgataaatgaatttcagagtctcgtctactctttgtactaccggcgtagtagacttgacgtactcctgtttatcccttttatacaggcattcgggtccaatgaaatgtatttcgaaactctgctctgggaaaagaaactggagctgtttccaaacgtggcccggcaattgagcttcagcacgtgcacctaggatgaaaattctcatagcacggttcttagttgtggttggtaaagatctattctccaacggatataaagtatacctgagagcagccagagattttagaccttctaaggtgataggcccctttgggttcaatgaatacggggaaaatttgtgcagcaaagacccaatcgtaattggatagcttagcatctttgtgactgcggctaattggaactctgtatccatggaatagaatgatcttgtgtagaaaaacaaatcccagtttgttaggttaacggccttgtcgtagccttgctgttggggaaaatcaaactccgggaagggtctaccgcttcttaagtcatgctcataaatattaacttttttcaggatttcatattttttagaatcgtgatatgctttatccatctcccaagcctctcgtgagtgatgagtcggaattcctgacagaggacaagtgtagttaatatctttgccggtaacagggcagtgtgctagcgttctaatcttggcggccctttcacgcaagtccactgagggagactgatcccatggatggaatctgttctccggagtaggatcttctggagagggaggaggatccaatccaagggcgttcctaacgaaccccatgaggtgacgacgtgtttggtgagagacaactagcctgttgtgtggcgacttccttagcagatggaaatatagctgagtagcacccgaaggagcatatagcacggtcatagttctggaagtacaagtttgccaaactactttaagtccaccttcgcaatatctacagtgttctgcgcttataaagtgtaaaaaaactacaaccaaaggcccgcccttagtagttgaccaaatatctactattgtctcttgtcagactcctttggattattttcttcgagccgctttttcgtagcgcatgataaaaagagccctttccccatactgcacacttaagtgaatgccaaatataatatcaagagcgaaaggcggttgagttccagccaagacgagcacacacgacaccagaacgagataaacatgctaggaagggcattgcgacctgggtggctgggcattactaggacggtggttaagaaaccaagttgcgggtcctactttaacagaacctttcaaacagcaattaacactacaatgcctcccatgcaagagggcatgctgagtacaatgatgatgatgacggctacggcaacaaggatcactggcacagtcagtgagccattaaacggttcaaatatagtgatgcaactcgattcagtgatgagaaagaggaaaaaaaagatgaagaaacacaaactgcggaaaagaagaaagagggagaaggcagaaagaagaaagctatctcagggtagataatagggctgtaaaaacctctcacatgtttttctctgctgtttttccttccctattcttcatattttgatattatttcatgtatatattatgtttgtatttagacttttttttttatacgttatactatgctaagaaaactctttaccaagaagtaaagaacccagatcgcgataatagaaagcaccagcagcatgaccgtgtggagtgctcttctagtagcagaatccttgttgaacatccattcttcgtacaagtacgtaatacacttgaagctgaacttgcccattaactcgcgacgattcaactctccaatttctgcaacgatgttgaagttccaatcaaaaatgccttctgcgacgctaatgatctgcaacttttgtgcttcggtcaattccgtcctggtggccagctcatagttcttcttgtattcccatttcaagcgtgtttcttcagtgggacccagatcgctgaaggtgaagaagtttgtgccctttttgaccagttccttctgtgatagcttctcgaagttggggaagagccccagtcttctgtacaaattcgatcgtattagcttgccgccggcgaaaagcgccaagtacagaacgtgacagtaagaaagaatggtgcatggctccttgtgtatgttttcgtggatgttattgataaactgctgtagtagcggtggcttctggaacgtagccaggaattcgtttaatgattctgtgcttttaaacgtgtttgagtatagcagcttcaggtccttatagatctgcgtagatcttctaaaatcttcgagccaaaactgcttcagaatggtcgaagtttgcagctcctcctccgttacggggtcattcagtaggcgatctatctcttgctcgatggcatcgaacacataatagtacgccagaataccctgtctgtatataaagccatgtctcatgcgatggccatctttatgcccatgaaggtattgattttattgtgggcatctctggtttgaaagttgattctgtttgctagcgccccacgtcagtgggtgagggtatgattgtattgctactgtcctccatttttgcggttattttatgtgtgtgtgtgtatatatgctgtgttatattgtgcactgttaaatagctcctccttagactaagcaagagagtatgaggaggttgctcttatatacaaacacaagagggcgagaggggcacctggccattgctccatcacacccaactcaggtgtaaatcgtcctacttatgaaggtcattagcccatgtttgaaaccgtgtgttacatggctcaaattccacggtccgataacgccgaccccgagcaggtgcaaatggccaggcggtatcgccaatgatccgtttatctaaagatagatagatggccgaacgtggactgcctctatgggtacaataacatatgcacatggcaacgggtcttggtgctcaatcgacgggcacatacaccctgactttccccatcatacgacgatgctctagtaaacttgcacccgcacctgttagataaacaagtgcgcccaagatcacaataccgaaggggcgatatcaccactcagtattctacagtcgagcatagcgtagtctggcagtatcccgcacgatccattgtattgtttgtccaaaccgcattttatgtgtaacgattaatcgtatatacatggcctacaagaaattaccctgcggcgaagggtgaaaaaaaaagtagtggaaactaaagaaagaagagtttagttacggaccctttcaaggattgacacactcccaatattttgctacattattgacctttgttgaaggaggcgttcgtttatttaattattttgttctgttttgcctacaactgcgaatacgctcacattctagtttgaccttcacaaattcttatcatcttcttttgtttattttgacacacccctattaagtgtatttgttttgtaagtaatgtctaagcagtttgttcgttctgcaaagaacatgatgaagggctactcatccacacaagtgcttgtgagagatgccacggcgaacgactcgaggactccatcgatagacactctcgacgatttggcacagagatcttacgattcggtggacttcttcgagattatggatatgttagacaagaggctgaacgataagggcaaatactggagacacgttgccaaatcgctgaccgttttggactatcttgttcgtttcgggagtgagaactgtgtgctatggtgcagagagaatttttacgtaattaagacattaagggaattcagacacgaaaatgagtccggatttgacgagggacaaattatcagagtaaaggctaaagaactcgtctctttgttgaatgatgaagaaaggctacgcgaagagaggtctatgaatacaagaaacagaagggcgaacagagctgctaggccaaggccaagaagacaaagaacaaggagcaacccacacgattcttctccctcttaccaggacgatttggaaaaggccctagaggagagcagaattactgctcaagaagatgaacaacgtagaagagaactggcccagtacgacgatgaagatcctgacttccaagctgccttacaactaagtaaagaagaagaggagttgaagcaattgcaggaactacagagattacagaagcaacaacagtctctgtctcaatttcaagctcctttacaacaacaacaaccacaacaacaaccagcgtactacgacattttcggtaatccaatctcccaagatgaatacttacagtatcagtaccaacaggaccaggaacaagcaatggctcagcaaagatggctggaccagcagcaagaacaacagcagcttgctgaacaacaatattttcagcagcaacaacaagctgcggccgccgcttctgccttgcaacagcaacaaacagccgctaatatgcaacaacaacaacaacagcccgctgattttcaacaacctttgcctacaggttctaataatccgttttccatggataatcttgaaagacaaaagcaggagcaacagcatgctcaattgcaaagacaacaagaagaagctagacaacaacaagaacaattgaagctacaacaattgcaaagacaacaacaagaggaagctcaattacaccagaagaggcaagaagaagcccaattacaacagcagcaagcccaattgctacaacagcaagcccagttccagcaacaacaacccttgaagcaaacaaggactgggaaccagtctatatcggataaatacagcgacttgaataccttgttagcaactggtacagggatagatacttttggtaacactggagaggcacgtattcctgcacaacatacaaagacaggcacatttataaattctcagggtacaggctacaaacaggttactaatgaacccaagaacaaccctttcttaagcaaccaatacactggtttaccaagcacaaatatcgtgcccacgcaaacagggtacgggtttggtaaccaacctcaaagtcctcctactaattctcctcagcaaaatcctactggtataagctactctcagccacaacagcaacaacagccacagcaacaaccgcaatacatgcaaaatttccaacaacagcaacctcaatacgcccaaaacttccaacaacaaccacaatacactcaaaattatcaacaacaaccacaatacattcaacctcatcaacaacaacagcagcagcagcagcagcaacagcagcaacagggatatactcctgaccaaggtgtaagcttaattgatctttgatactgtcctatatatacttttttgtcatgggtacacatacatgtacgacatatatatatatatatatatatatattagcgagtttacattgatgtagagcagtaactggaagaaataaaaatttaaacttaatactagggggtccgtcttctcgtgggtacttcttttacagttttcaacttctgctgacttgtatgccttcttggcgcttcttcggaaaagttgacagcgggctttactttaacggcaaatcgcagtaagtaagcaagtaacgaactcgcacttcagcaaaataaaaaagaacaatcgattagaaattcaaatttcaccgtgactctttaacccctgccgaatattataagcaaactatgataacactcttattatacctgtgcgtaatatgtaacgcaatagtgttaataagggctgattcgatagcggacccttggcctgaagcgcgacatctactaaataccatagctaagtccagagacccaatgaaagaagctgctatggaacccaatgcagatgaatttgttggattctatgtaccgatggattattccccacgtaatgaggaaaaaaactaccagagcatttggcaaaacgaaatcacagattctcaacgtcatatttatgaattacttgtacaatcaagtgaacaattcaacaactcagaagcaacatatacacttagccagattcacctttggagtcaatataatttcccgcataatatgactttggcacacaaatacttagaaaaattcaatgatctaacccacttcaccaatcattcggccatcttcgacttagctgtgatgtatgccactgggggatgtgcttctggtaatgatcaaaccgtgatccctcaggattctgctaaagcactgctatattaccaaagggctgcccaactagggaatttaaaggctaagcaagtgctagcttataaatactattctggcttcaatgtcccacgaaattttcataaatctttagtattgtacagggacattgctgaacagctgagaaagtcgtactccagggacgaatgggatattgtcttcccctattgggaaagttacaacgtgagaatatcggattttgagagtggcctattaggtaaaggtttgaattccgttccatcttctacagtaaggaaaagaactacgagaccagatattggttcaccctttattgcgcaagttaacggtgtacagatgaccttgcaaatcgaaccgatgggtaggttcgctttcaacggtaacgatggcaacataaatggcgacgaagatgacgaggatgccagtgaaagacgaatcattcggatatattatgcagctttgaatgattataaaggaacatattcacaaagcagaaattgtgagcgcgccaaaaacttgttggaattaacgtacaaggaatttcagcctcatgtcgacaatttggatcctttgcaagtattttactacgtccgttgcttacaattattggggcacatgtatttcaccggcgaaggctcctcgaagcctaatattcatatggccgaagagatcctgaccacgtcgctagaaataagcagaagggcacagggacctataggtagagcgtgcatagatctgggcttaataaatcaatacatcacaaacaatatttctcaagcaatttcgtattatatgaaagctatgaaaacacaagctaacaatggaatcgtagaattccaattatccaaattggccacttcattccctgaagaaaaaatcggcgacccatttaacttaatggaaactgcctacttgaatggattcattccagccatatatgagtttgcagtaatgatcgaatctggaatgaacagtaagagtagtgtggaaaacactgcttacctgttcaaaacattcgttgacaaaaacgaagctattatggcacctaaactgaggacagcatttgccgcattaatcaacgatcgttcagaagtggctttatgggcttattcccaactagccgagcaaggctacgagactgctcaagtctctgccgcctacttaatgtaccagttgccatatgagtttgaggatcctccaagaaccacagatcagagaaaaactttggcaatttcctactatacaagagcgtttaaacagggaaatatagatgctggtgttgtcgcgggagatatctattttcagatgcagaattacagtaaagctatggctctttatcagggtgcagctttgaagtactctatacaggctatctggaacttagggtacatgcatgagcatgggctaggtgtaaacagagatttccatcttgctaaacgttactacgaccaagtttcagaacacgatcatagattttacttggcttccaaattgagtgttttaaaattacacctaaagtcatggttgacttggatcaccagagaaaaagtaaactactggaaaccttcctcgccacttaaccctaacgaagatactcagcactcgaagacttcatggtacaagcaattgacgaagattctacaaagaatgagacataaggaggatagtgacaaagctgcggaagattctcacaaacacagaactgtagtgcagaatggagctaaccataggggtgacgaccaagaggaggcttccgagattttgggcttccaaatggaggatcttgttacgatgggatgtatcttggggatattcctattaagtatattaatgagtacactggcggcccgtagaggctggaatgtccgtttcaatggagcacaattaaatgcaaatggtaaccggcagcaagagcaacaacaacaacaacaagcacaaggtcccccgggctgggacttcaatgttcagatattcgccatatgatgtggtttgtatagatatatacatagactatccatagaaatcacccacgcattacccgaaagttttcaataaagcgaacagcgagaagaaaaaaagcgaaaccgacagagaattaccaccctagagctttaaccccattgagatcaacacaatttcgaacagtgaaagtgcattggcgaaggtgatacaattggcttccagctctgaataataataacttacaagcgcaaagataacagataattttatatcagcatacaaatggtcgtcatagctaatgcgcacaacgaattaatccatgacgctgttctagactattatgggaagcgccttgcaacctgctcttctgacaagacaatcaagatctttgaagtcgaaggagaaacacacaagttaatagacacgttgactggccacgaaggcccagtttggcgtgttgattgggcacatcctaaattcggaaccattttggcatcgtgttcttatgatggtaaagtgttgatttggaaggaagaaaacggtagatggtctcaaattgccgttcatgctgtccactctgcttctgtcaactctgttcaatgggctcctcatgaatatggccccctactgctggttgcttcctctgatggtaaggtctccgtagtagagttcaaagaaaacggtactacttccccaataatcatcgatgctcatgccattggcgttaactctgcttcttgggctccagctaccatcgaagaagatggtgaacacaacggtactaaagaatctcgcaagtttgttactgggggtgctgacaatttggtaaagatttggaagtacaattcagatgcccaaacttatgttctggaaagcaccttagaaggtcacagcgattgggttagagacgtagcatggtcacctactgttcttctacgttcttatttggccagtgtttctcaagatcgcacctgtattatttggactcaagacaatgaacaaggcccatggaaaaaaactttattaaaagaagaaaaattcccagatgttttatggagagccagttggtctttgtcaggtaatgtactagctctttccggtggcgataataaagttactttatggaaggaaaatcttgagggtaaatgggaacccgctggtgaagttcatcagtgaagagtatcaagaatttaaaatgaaacatctcaaaagaaaaaagaatgcaaatgagtctatcgacgaatttgaagggaaataaacgcataatgtacagtaacgtataacaattaaagatttgtggaagttttcaaaaacttttcaacttttttctttgttttttttttgcaacttcttatattaatattgtcatagatatttcttatacaaaaacaagcgaacaaaaataatcgacgtatatacaatagatatataagactgtttttcttcaatagaacaggcgaaattattctaccggccgaaggtacatcttcccgctatgtaataaatagaggtatttaagttataacaattataattcccccattacggcagcaattaagttttgcacgtcattagaggcgattttaccattctccagtacttcagcgtgagtcgctttgcctttttctaagggtacaggtgattcgtccaacgcactggcagggctatccaccacgcaagtattggtaatcaaacttaaggccaaaaccctccatccgcaatgtcttgcaacaatgacttcgggaacagtactcattccgacagcatctcctcccaacatccttatcattttggattctgctcttgtttcgaaagtgggtccagatacaaaagtataagtaccttcatgcagtggcctttgaatcttgagctctttccatttcttaaataaaagcttcctcaactccagatcatatgcatcactcaaggctaaaaaacgaggtccatcttcatccaagttaggacctctcaatgggtgctggccagcaaggccagggatatttaaatgatcataaatgcacatcaaatcgcaggcttgatatttcgcgtttataccaccagcggcattagtgacaattaaattacgaacatgacccatgtggttaagcactctaataggaaaagtagtctcaaacaatgtgttgccttcatatccatgaagacgaccattcattaatactactggtgaaccattcatagatccgaacattagtgtaccggaatgacctggaaccgtacttttcttgaatcctgggatgtcttggtatgggactgttaccgggggtggattgtctctagacagcttggtagatattccaccaagccctgaaccacatataatcaaagttctcggaggctcgaaatttgttgtatttttgaaatgtggttctaaaatagcagaaatatacgcagcggccttggtaattgcttcacgttgttgacttacgttcaagatatcactcatcttttaagtttattcggagtttctcatgtgttctagaagattagcaagattatcctaaagttatgcctgccctatctgccctctgcttcgagattttccttttctttgcgctttgtaaacactgaaacaaaaacaaaaacaatggaaacatcagaaagatatttatttattgtggccgcataaagttttaattctttgataattaacgtcgtatttgggaaactgcttactataccggatactaggctgccctgatcaaacaaggaaattgacagatgatgcttgaagggtatacggtacaacctccacagtctactttgataggtgacattgaaattcaggacgaaaatgcaaaccaagaagttaagaacgtactttaccaaggagttcaaaagggtataaaaaggctagaaaaaagacaaaggagggttgcattaggtgatgtaacctctcaaaaggcaaacaaaatacacaatgctatacataataaattccatcagacgaagaacaattttgaaatagagaacatacgctcatcggccttggtaaaagaacaacaacgagacgtaaggcatgaagatagcgactattttttaattgatagttctgaaggctcttctactgatgacgaacaagttaatgaagatgctattgatgatttgttaagtcgaagagtaaatgatcagcagattcaagccgatgaagtgtatgaagatttcgatggagaaatgcaagatgtcattgaagaggatgttgatagtcaaattgaaccactatcaccaataaacaacgatgaaattcagactgagctggacagggcgtttgaaaaatattttcggtcggttcccaatccgctggatgatgatacccatgatgttgtgatggttgtggagtacgcttccgacatattctattacttgagagaacttgaagtgaaatataggcctaatccctactatatgcaaaatcaagtagagcttacatggccgttcagacgaactatgatagattggctagttcaactgcattttagatttcaacttttaccagaaacgctatacctgacgattaatatagtggatagatttctgtcaaagaagaccgttactttgaacaggtttcaattggttggtgtatcggctttatttattgctgccaagtttgaagagattaactgccccactttggatgatctagtttacatgctggaaaatacatacactagagatgacattattagagcggaacagtatatgatagatactctggaatttgaaataggttggccaggacccatgccatttttaagaaggataagtaaagcagatgactatgacttcgaaccaagaacattagcaaagtacttattggaaactacaatagtagaacccaaactagtggctgcggcaccaagctggttagctgctggcgcgtattttctgagcagaacaattcttggttcaaatgattggtctttaaaacatgtattctactctggctatacatccagccaaataattcctttagcatcactgatattggagaattgcaagaacgcatctcgacgccatcattcaatttggaaaaaatactttgaccaaaagcattaccgctgttctcaaattgtagaagaatggattgtttcgacagaagcctaacttactcatcttaacaccatttgcttcagttttggtttcggaaggatcatatttcatttattcaggtagaagatatatatcatattacacacacacacacacacacacatacacatatacacacatatatatatatatagatatatatatgaatgcatccttgattccgtttcagttaacaccccgatggtccacccaagtttatatcatcctctttttgaccgaatctttatttgacaatcttcaagcagcctcagggcaaaattcaattctggagggtttgatatatgtgccctatgcctccaggtaagcggcattcgcagtagaagagcagcaatcacatactccaactaagttaaaagacgatacttcgtatcttgaaaagaaattaccttattcgtctagtttttttgcttatcccttctttgcttcgcactttctactaagctgtcccagcgttctcttaatcgcccaatttcattagccaattttttattttctttcgtaatttcgtcaattttcataccatattctttaaattttttctgctcatataataccaactcctttttgaattgttccagtcttaagttaatcttcatttccgagtttttggaattttttcctccttctgttttcaattgaatatcattattcaaattaaattgtaagcggtttaaaattgacataagaagtggatcgtttatgggacttaaagtgtcctgatatgctgggttatcccaattcctagcattgcttattccatttatcggagatttgttgtttaaaataacagagccaataagcatattgttgttgaccattccaatattattttcttctgatgactgcttttcaatcaaaagttccaattcttggattttggctgtaatgtcctgttttaataggtcaatggcttgcgtaacgtcagaacttaatttattttgagacaaattctcgttctgcggacctaaaacttcaatggcttcttgatacttcgcttttgcatttgtaaaatctccttttcgacattcctgttcggcgtcctcaataatagtataaacctaattcatgttagtcaccatgaacaaaaaaaaagtgggggcataattcaaaaacttacttccgctaaagtactcattccatcaccaagattagtataactgtcgttgaattatcgaactaatccgtgcagcgatacagatgttttttatttcaaacagagcgttccattacgctgagttgaatcatctggtttttctaccctttaggaaattctaaagttgaagaggcgctatcgatgtatgcaatgatgaaaaagtggtacagagctttatacatattacaatacagtgcagaatttataaagggagataatacatttgaagcggttgttggtatagatatattgagagtactataataaaactattgggcggtggtaaaattcctgaacaaggaaggcatcattatactaatttatgatcaccgtcggcatccaggtcctcttccaactcgccaaccatattttcatcatcaacaagtacatcgtccaagtacgaatcttgttctgcagctacataatcctccatcaggctttgtactacttctcttgactcggcgaattcatcttgaacgttctgcattgattggaacaagtcgcctacattataattatttaaaaatgcgcccttggcaaatactttgtcaaaagtattgcacgcattctcaaagacgttcaccacggtagacatattgcttaacatcatgccgctaacttcgttttcatttggttgtaaaggcaagtatggcgatcttcttccaatgttaacgtgcatcgcagaagaggaccatgaggggaatttgatgcgttgttgtaatttggtcatagcacgcgatatctgacgaggttctacattaccaatgattgtattataaacgttaaaatatgttggattgttcatcgcggtagagacaagagaattggaagggtctaataaatctaacatgacgtcataactggaatggcctttatgcgctatatcatcgtgaatataatctgatgtaaatggagtgaaactagggcttaggaaatgaagttcaggagaaggaatcaaggtagagtaaatactggacatggatgaatacatgtaactcggaaaccgtatactgttcgttactgaagatattatggtcgatatcaattgattcgtgtgttgtaaatcgatgttcggatttctaaacactttaccggaaatattcagcaacgaagcgttatcaaacaccaccgttgcatcgctatcttctatcagtcttctcaaagccagaatagtgttataagattgaacaacaacctcagaagatcttgcagggaacacagaatatgtcgtgagtatttttttaggatatcgatcacacagcgcttctaagaggttggatccgagccctgaaccggtccctccggctactgagtgcagcaactggaaaccttcgaaattgtcggtagaatcaatctccttgtcgatcttgttaagaatatcatcctggttacgagttcctatatcatacccattggcccaagaattaccagcgctagcgccatcagaagctacccaggtatttcttgggtcgaaaaacccacgaaatgtgttctccacgtcggcgatgacactaggctcggaatccatcataatagcccttggcgtaaacttattcctactgttttcgcggaagaaaggctttgtgtcatcatctctttccgtactggaatcaggaagctgagatagcccatcggtgcctatagcgtgttctttcgccaattgagaccagagaaacttaccaacgtggttcccgcattgacctgcttgcaaagtaataatttctccacccatagatagttatatgttgaattcttatacatgtgactaaccgatattacgcatttgttcatttcgcagctactgttacgattattatttattacatttaatgaaatttcccaaaagataatattaacgcgttctgttacccggtgatattttctgaatgtcagggtaacaaagagagaacgttataatgggagaatagtaaatatttgctttaggaaattagtaataattgcaatgcggaaaataggtgcattttgtgtttcttgaaaggtttgaactaaagaatgtatacatatatattagagcgtgccttcatgcagggaattagaggatccgttacggaagagagaacttcgtaagacattattgctgtgactattttgaccgtttccaagaactcaaccagtcatttatctttggagtaacaaagcagtcccatttgagagacccctcatcatgatgattcagtctgtcttgcctgttatacgaaacgactactcttgacaaatctttttgggaaaaggttggtgcctttttctttgcctttatacaaaactgcacttgttctgtgaatttattttggtacggcgttacggtgatttgttcaacatgcgccgtaaattggcccttttcgataatatcgggtgaattttcccaatctatgaggccacctgcccagtttattgtaccgggtccgttggtttccgagccgcctggccaaacagcgatttctagtctcatcggcgtttgtgggtacctatattctttactaatggggtcccaggtatccttcttcaggactgtgcgagctattttaccatcaacataccatattatcctatccgggtcccaatcaatctcataagtgtggtaagtggcccaagtgtcagcgcctacgggaaatctttgcattcttgtgtaatccaaatgcccttgagaatagtagtttgattgggccgtcattaaatcaccacccagccactcaaaatcaatctcgtccccaattgcggatgttaagtcaaatgcagtcaccacacccctcgacctcgccgttttcattcgcacgcttgccttgccgtatagaaacgacctggtcgatgtgatcaaacttccggtagttttttttggcatagccagaacaatattcccgctactcgcttcaattgatgtgtagccgctatgtgtgaaatcgaaatcttccaacattttctctgcctctttactgtctggagtgaccaagaatttggcgtagtgtatgattctcttggaatttagctccccttctactacacccaccttggtatttgccttattcggtccatttccctctcttattggtggcttaggttgatagttcacaataaatttaggaacctttggtgtgctaacaaattcaagtttttgactggcgactaatgcaggtataggagcacagctttcctcgtcgaaagatgacctcacgttgcagccaccgacacatatcggtccagcgccacattcattatacggcgagcagcacggccattctgcgggacaagggttatttggagaacaagaaatggagtttttgggtttgtataattctcccagtgcaaatccgatgtagccaacaaccggcaccagctgtaatattgatattctcatatttttatttcgtgcaaaagcccttgatgatactctaaactaaacgactgttcttgtatttcgttattaatcgataattattagctggtattgtcttttttttttttttcctacatgatcgtcgcgaggctttacataatttttgtgacgcctttaaaagtatagtagaacgagcacataagaagtaaatgaaaagtacggcagatgcaattgacagtaaagagcggtacaatagttgaagaatacccgataaaaatgtatttaggttgcttgacgggtttgcagcaattgccaagaacactaactgtggcaatcttggtgagaatctactcccaacccaaacattttcgccgatatttttgctcaccttttttttttgctcatcgaaaattgttatagcggctcgactttgatttactaatacacccaatttctaatatcctcaaggctagatcgttctctcaaggaacttaaagtgcctgatcttgcgatgattaatctacagcgatggatacttaaatcatgtaaaaatctcagttttgaagtcgtttgctctcttccatgcttcagttcccttttggaaggtaatataatcatctaatttctcgcatattcacgccgacggaagaacgagccggatcaatatggttagaacccgtgtattattctgcttatttatatctttttttgctacggttcaatcgagtgctacacttattagcacttcatgtatttcccaagctgcgctataccaatttggatgttctagtaaatctaaaagttgctactgtaaaaacatcaattggctgggttcagtgacagcatgtgcctatgagaattccaaatctaacaaaacactagacagcgccttaatgaagttagcatcccaatgttcaagcatcaaagtttatactttagaggacatgaagaatatttatttaaatgcgtcaaattatttgagagcacctgagaaaagtgataaaaaaaccgtggttagtcaaccgctcatggcgaacgagacagcgtatcattattattatgaggaaaattatggtatccatcttaacctaatgcgctctcaatggtgcgcttggggtctcgtcttcttctgggtggctgtgcttactgcagccactatcttgaacattctgaaaagggtgtttggtaagaacatcatggcaaactccgtcaaaaaatcacttatttatccttctgtttacaaagattataatgaacgaactttttatttatggaagcgtctaccatttaattttacaactcgaggcaagggtctcgtcgtattaatttttgttattttgactatattatctctcagttttggtcataatattaaacttccacacccatatgataggcccagatggagaagaagtatggcctttgtgagtcgtagagcagacttgatggccattgcacttttcccagtagtctatctattcggaataagaaataatcccttcatccctataacagggctttccttttctacatttaatttctatcataaatggtctgcctacgtttgtttcatgttggccgttgtacactcaattgtcatgaccgcctcgggagtgaaaagaggtgtgtttcaaagtctggttaggaaattttactttaggtggggtatagtggcaacgatattaatgtctattattattttccaaagtgaaaaagtatttagaaatagagggtatgagatattccttcttattcataaagcgatgaatattatgttcattattgccatgtactaccattgtcacaccctgggctggatgggttggatttggtcaatggctggtattttatgctttgatagattctgcaggattgttagaataatcatgaatggtggcttgaaaactgctactttgagtaccactgatgattctaatgttattaaaatttcagtaaaaaaaccaaagtttttcaagtaccaagtaggagctttcgcatacatgtatttcttatcaccaaaaagtgcatggttctatagtttccaatcacatccatttacagtattatcggaacgacaccgtgatccaaacaatccagatcaattgacgatgtacgtaaaggcaaataaaggtatcactcgagttttgttatcgaaagttctaagtgctccaaatcatactgttgattgtaaaatattccttgaaggcccatatggtgtaacggttccacatatcgctaagctaaaaagaaatctggtaggtgtagccgctggtttgggtgttgcggctatttatccgcactttgtcgaatgtttacggttaccatctactgatcaacttcagcataaattttactggattgttaatgacctatcccatttgaaatggtttgaaaatgaattgcaatggttaaaggagaaaagttgtgaagtctcagtcatatatactggttccagtgttgaggacacaaattcagatgagagtacaaaaggttttgatgataaagaagaaagcgaaatcactgttgaatgtctcaataaaagacctgatttgaaagaactagtgcgctcggaaataaaactctcagaactagagaataataatattaccttttattcctgcgggccagcaacgtttaacgacgattttagaaatgcagtggtccaaggtatagactcttccttgaagattgacgttgaactagaagaagaaagttttacatggtaaggccccttgttaataattcttgcacgcatacttttgttattttgttgctttatcggataaaagttaatataaatcgatgtaaataattttatataatcatacaacagggtaataaaaagacgaatatattcaaatgcgggttctaaatctaagtttcattctcactatcactgctttcttcctttgcctgttgagagagtagttctttccatttttgagtgagctctcggattgcttcaggatttaaactagcttctacgagatcctgtggaacatgattttcggagtgctcttttgaagcgaatctccccgtgttatgcctcgtcactaaccttaattcataatcttcaacatcattcttcggaggtgctatcgcagcaatctcgttccatgaaaatagcaaagaatctgtcttcctggcaaacggatttatatcaacaatgaagattttattgaaaggtcttggaatataaacgtcaagaacgaaacttttatcaggaaacttgggcaggacgacatcatgaactatttcatcaataaggtccttgaaggtatctgacaactcatctaaatagtcataataatttaaatcacgctgggtggccccaacgatatgcgcattcttaacgaagaccctaaattcgagtgccggattcatatcacaccattgtctaagtaccaagtcaaatttcaatccttttatatcatccccgtccacgcagcctttaaatgctctttgaaggtcatgcattatgtaattggatgcgttcaacaataggtaaagctcatttacctcgttacacttcatagtgttattcggcaaaatccaggtagcgtctcttggtgcagaccagtttaacttgggagccactgcacctaattcgttcaaagcatcctttaatttctggtgtaattctggaaaatctatcaatggctcaacttcttggacaaattcggtggcggtatcctcatcgtcctcccaatcactatagtcattatcttcatttcttattatttcctcggtgtacacagacctggagttttcctcttggggtagcttgataccgtcttgttccaaatattgaataaattttttcggtaaggattttaacactatggattttggcacatatttgggatacagtgaggaccaaaacgagtaagaacagtgttcaacctgcgctcttgtcactggtatatctataaaagttgtatattcttgtgaggacatcaataagtaatttatgtcagcgctttttggacgcacgttttagtttcactggtggagttacggtatcattagcttcttaatcttcccactgcataaatggacatcggaaaatatccgcttattatgcctgaaaaaataatttttttaacagagttttctacgtactttttacttaactactgaggcagcgcaactgtttagtatttaaacatataagcatatatataatgcaagtaatcaggagaacatcttcgaaagagactttttagctttttcgttttgttgctttctttttaatttagtattatgaatagctttcaaaatggcagcgtcatttggctggaaagtagtggccatttctaggtcattgagagccatatctgtgtcattaacatggtaataggccaggccacgacggtacaaagctttggccttggctttttcgtcagccgcttcggcatataacacctccgatgaggctactaatacttgcttgtaatcttttaatttaagagcacagatggcaatattcaatggaatagacactttcaattgattgattttttcaatttgttccttctccaaatcttctgggaaatactctttcaagaatttatcacatttgacatatttttctaaagccacggaatagttctgtttcttgaactgttcagtaccaatgttctttaccgtttcgatagctttcaagacggtgtcgaaattcttcaagtcaactttttcgtcttgttttaaaacatcttcataattatcgccgtactcatctgttggtgtagcttcggcattctctggcacttgataatcgtcaggtaacacgccacagtcatcaatctttacatcacgcaatggcttgttgttttcttggtcacattgttggttttcaatcaaacgaacaattcttttaccttgaatcacttcaccaaacacaacgtgcttcccgtccaaatgaggtgtaggaacacaggttatgaaagcttgagatccattggtatttggaccggcgttggccatggatagaaggaatggtttatcatgtttaacagtgaaattttcatcctcgaatttttcatcgtatatgctctcaccgccagtaccattaaaattggtaaaatcaccaaattgacacatgaagtctttgatcactctgtggaaaatggaacccttgtacgacaatggtacatcaggtttagtctttgccataccagcatttccttcacacaacttcaaaaaattttcagccgttttaggcactatgtcattgtacaactcaaaaactatacggccttggggtttacctccaatagaaatatcaaaaaaagttttaggtctagtcatttttactccttgatcgcctgaatattgtcttaccagttttctatgtgatgtgagcgcatcagcacctctgatattcgacttatttaaataattttctgtctgaactttctccagctagggcggaaaaatattctagaagctcatagaaatgccgttcaaaagcgtaacagttatgttctataaagggaaacaatgtgtttcgatcactgcagctgtctattatatacaagttatacatcacgacatttagattttcatttcttcttttccgaatccttactggtcgtcccatccacgtccactgtgcttacgcgctctctattaccattcttttcccaacacttcctaaataacgccatctcgttgaagcactgcctccagtcacctgtttcggcatggcacagctgtaatgcgaggttctctacgtagcatccggtcttggatattctcgtgtcccacacatccgggtcttcgtcttcttggacctctttgtattcttccagcgcctgcttataatactctgaagtttcgccagtttcactcatgaccagtctgccagttttagcctgccagagcttttctttccctttaatcttcccttgtttggcgcaactcttagaagtgcctttcactacctttaatggctgaggcccctttttttgtttcggacatttgttgtgagaaaaaaaagaagaaaataaaagcataaatgaagcgaatggatgagaagaggggagggaaagcaagaacgagaaggacaaacatcagggacccatacttcaataaattgcttgatttggtgttaatcaattcttctaacatcaaacctcttttagtttccttcgatcgtttcacgttgcttatattgattgctttttacttctattttttcactagaataaacaaacaaagacattctgttgatcaagaaagttgaaaatggtatttggttttacaaagagggacaggagggtacctgatttatctaggtatgattactactatcagaaccatgaagattataacaaaagtcctcagctctctgctgctgctgcctctgctgcttctgccgcatcaccggatcgaaccaattactcaaggtcgcactcgctggttagtcatgcaccttcaataccgagacaaagaagttcggtaaagagcccaggaagaaggctttccacatcctctgccgctccgccaacgtccagggcagcagctaagcagtattcacagaagacttactcgttgaggtcgcaaaggagcggagagtaccatttacacccgcccggttatactactaatgggagccgtatgaattctatgacgtctggtgcgaatgtcagaagaaactacggtaagaacaaatcgacggccggcaacaataacgattcaagggccaactccattaccgtaaagactacacaagtaacagacccttcaggaaggactcaatcaattaccaaaaagacaataagaaaaataaatgggtatgaatacgtagaaaccacgactacgactaagaatttggttccattaggtgactcgcagcgtcatttcgatgaatttagtgaaaattacatgttgcaagatgacgacattttagaggaacaagctagtgataacattcacgatataatcgaggaaaacgaaacagataacgaaaagccatattccccagtaagcgaaagtcatttacaagatgattcagagctaaacgtggaaaaaccagatttcccacttggatcatatttccaccataagtattctacagacgttatgcctctagaagaagaaagtagtttatcaaacttcagtgacgcattagattatattcctcccacccatcagaccagtagtaaatatattcataataaaaggaagcaagcatcgacgacaagaaggaagaaaagaccgcctgccgtgaaaaacgcagaagcagaggccaagaaaccattaaccgaagcagaaatgtatctgaaggcactagaggttgctaaaagaaacgtttatcacacggatgctgcttcggataacgcatcggcccccctcgggagtaacaaatccaggaaaagtaggatgggtcaaaaaatgaccttgagaagcagtagtgattctccgacggcgactgctaatcttgtcaaatctaatgtcgaggttcaaccaaaaagatttacaagttccttcttcagcagaaatactaaaagcgccccccatgaagtgcacaatcactctgtgtctacacattttaaatcgaataaggctgttgacccagttccagagcctaaaagtgcaaacacagggctaacagataaagaaatgtatgaccaagctttgaaaatcgcacaagcgaggtattacaactcacatggtattcaacctgaagcagtcgataatagcactacggcggctaaacctcgtcaggtcggcgttagccatctgggatccactgggagcatcccgcccaatgagcagcactatttaggggattctgaaattccagtccaaagcgaagtgcatgaatacgagcccattccattgcagaagacaaaaacaactggttcttccaaaaataagttcaaaaccatgttcgataaagtgctgcaattctctcaagaaaactacggctaccagcacaagaaggaacaaggcgaacaaactccagttactcgtaatgctgaagaaagcttcccagcagcgtctatttcggaaggtgtgacaaccgcaaagccatcttcaaacgaaggtgtgatgacgaatccagtagttacagattcaccttcaccccttcaacaacaaatagactcgactactgcgtcctcgaatgggcaaagtcagggcaatgtacctacctccgcagtagcttcaacaacgagaacaagatcaccggaactgcaggataatctaaagtcttcttcttcgcttttacaggaccaaacccctcagcgtcaggaagacgccacggatccaacaacatcatcgacgaatgaattatctgccgctgagccaacaatggtcacttcgacacatgccactaagacaatacaggctcaaacacaagatcctcccacgaagcacaagaagtccagtttcttcactaaactgttcaagaaaaaaagcagccgttagcagttgtttactcgaattttgcaatcaaccctaatttttgaagcctggttttagatttattctcttctttttcttcttgtgaacttcaattactaatgtaacttaatttttaatataacttttacagtttaataatattgatttttttcggtctggaccaatcgcgccgcatttctcactaatattactaacataccctcttctcattggctcggtacccctttcgtgacccgcattttttgttttctttgttagcccgaatgtctcacaatgaagatgtaaaattaagattatatatgaaaaattgatacaaaacaaaatagttcaaataatcaagttaaagcgacatcactctcaatttttgctttttttaggtttatagaatagaaatataacagaacgaagcctttagactctttttttttattggtatattgaacaaagaaactttttttttgtcctcccatatctcgtgcacacaaatattatgtccattgtagcactaaagaacgcagtggtgacccttatacagaaagcgaaaggtagtggtggaacctcagagttgggggggtctgaatcaactcccttgttgaggggtagtaatagcaatagttcaaggcatgataacttatcctcatctagctcggatattatctatggtagaaattcagcgcaggatctagaaaactcaccgatgtcagtagggaaagataataggaatggcgataacggttcggataacgaaaaggcgaacctagggttcttccaatcagtagatcctcgcgtaattagcgatttgattatcgggctaagcgacggtttaaccgtcccctttgctctaacagctggtctatcttcacttggtgatgcgaaattggtcattaccggtggctttgctgagttgatctcaggtgcgatttctatgggccttggtggctatttgggagcgaagagtgaatctgattattatcatgctgaagtaaagaaggagaaaaggaaattttacgataactccaacctaattaacagagaaattgaagacattctgttagagattaaccctaatttctcggacgaaacaatcgtttcgttcatcaaagatttacaaagaacacctgagctaatggttgacttcattatcaggtacggtaggggtctagacgaacctgccgagaatagagaactaatcagtgcagtcactatcggtggcggttatctacttggtgggctagtaccactagtgccatatttttttgtctcagatgtgggcacaggtctcatttattctataatagtcatggttgtaacattattctggtttggttacgtaaagacaaaactatccatgggtagtggcagttcgacttcaaagaaagttacggaaggtgttgaaatggttgttgtgggtggtgtagcagcaggtgcggcttggttctttgttaagttactgggttaagtgtaaagtaacaacactatacatatttattgtaaagaaatttgggattgagaagctttgctatatacttggaactgggctggattttctcgacatacatttcttttacgttttaatttgtttctatattctcctctttaaatttatttatattaatgaatttcaaactagtttctttttctattgccaagaggcccatcaggtgatccatgataacctttattcgcattgaatcgtttttcattggatctaattcgtcatttggtcgccgcctttctttgctccttctgcttttttctttttctctttgactatcaggtcataagatcttctcctccattatgcccaagtgtttttcttttttttgcctttatataaattacaaaatacatacatatacttctcgtgcagtatactggaatcagctttataccatatgaagcacaacttggatcaggaccgctcttcattaaaaatcgaagaattatctaaataattaatgtgcacgtcaatatattctccgcggaaacatgacaaacttttagaaaaagatttaaagcaatatttttcagttctccatttctttatttttcaagaccaattctagttcaccaatatcaaacattcctatgccttcctgcagagcatctgccaaaatggatagtgatttattcgtgaaatccggggcagctctaagacgattgatatcatcaccgtagttttcaaaaagtaaatttaagtattcttcccttaactttgtcttgtctttccctttgggcacaaagttttctgccaattcattgtattcttctctcgcaagcttgatattttcggcaattttcgatgcattcataaaaccctccttgttttgagatttcgtaggctctgggatcttgctcaaagaaattttggttaaatcgtctatcacttcttttgaatttaacttcaaatccttgctttcttcgtctgtaagctcgacatccgaaacttctattgcaatgtcctcttgtttgtcttcgtcattaccttttgagaaaacatgatcacttttaccattttctccaacgtgttcttcgatggccccattttggatttcctccttttcactttctgatgatggatccgatgatgaagaatctgatgatgaaacatcagctgttcttctcttcttcctccttctgttttttttgacagacttgatatttatggctgatatatcacctgccgacatcctgtataatatattatggctagttctttccgtgctatttcaagtgggcagtttaaattcttgtatatattactacaatatatgaaagttttcgctcttcgttttttgcaaatttttagtgatgagctcttcgcgcaaagaagttttcaatgcccgtaaaggcacctaattatatatcgaattattttaagctttccgcttcatcaatgcattttgtctttatatatctagtttacaaaataatatgttgctattgccttgcttttaaaggctcaatatcttggacttactgcctagaatagcttatccatttccactagcgcgtagtctaatatgtaactttgttcaactaagttatcaacccttgtgaaatgcctttgcgtgtatggaattattgcatcaactatctttaccattccgggtatctcactcaattttgctatgttatgatgcatcaaaatacatcttattgttctttgcgctatggtatgtgtttttgcatttgtattccaatctctgcatcgtttcattaacaaaattaactgttcatcatttaggatagagatggcttggtccaattcttcattgaaaatgacttcaattttgccctcttcggtatcttgtctagaccttgattcgcccaaagctcttttcaaaacattaaacaacctcattgggtgatctaaagtcattgctaacaaaaatgcatttgtccaatcacctttgctcatataattttgaagcgattgttcttgttcgacttgtaatttagctttttcttgttcttcttctatttcttgttccgtacaatctttccaaaactgaaaaacaccatctgcatcagcacttacgatcatatcaccatcattcatagtacttaaagcccataatctattattatgaccatccaaagtcttcagacattcaccgctagaacaatcccatattttgatcaagccatcagcaccacaactgatcagttgtttttgcttattaataaacgaacatctttgaaccgcattggtatgaccttccaatgttttcataacgctgaatgtatccaatgaccatatcttgactgttttatcacctgaagaagttgccaataatttatcatattggcaaaatgatacatcccatagtccacgcttgtggttggccaacgtggcttccaattcaccattttctaggttccagatcttacaggtcttgtcgtatgatgctgttgcaaaaatagaatcgttaggagaaactgacaaagcattgatatccttttcatgggcatgacgagtatattcggataccttgatgatttgaacatccatactagcagttggctttggaattatccatttcttaattgttaaatcattcgatgctgtcaataaaaattcaggatatccctttgaaactatatttggcaatccaacagcagttacggcagctgaatgaccaatatacttggcataaatatcaaacttgcagctgttctcattgtatctccaaacaatagccgtattatctttagaggcggttgcgatccacaggccatcctcagtagcatccaatgaatttagcaaatcttcatgaccttcataaatttcgacatccaaaggcagcgaagcttctgggcctgataaatcggggacgggtattatcctaagcgatggagaattggtagctaaagctaatttattcagctctgggccaacatacctcatgtcagcaataataccatgattaccagcaatgctcgaagtgacctgtattgtgtcttcatcattctttaagtcttcttcaacgttaattagttgtaatgtctggtcagacaatactaaaaacatctgtgaattgctcaatattggaagtacaccaataatgaataactcttctataggtttattggttcttttaagcacgctaccagattcagagtcaattaactgaaagatagcatcaccgccggctgtataaattatgcgtttaccgtcaccatcctttaggaatccgcatgactctacctgttgatttactggaagtgttttcaacaatttacatttctttttcatattgaaatcccagagattgatgatatcgtctctaccaccggaaagtaaatttaggcttggctcatcattatctggtacctcaatgatatccaaccctctcacagcagatgtgtgctcttgtaatgtgtgcaagcacttccttttaacaagatcccaaacctttaccataccattggtgtcaccggatgctaataaccatattttactattcaattgtccataaaacttcaaactggaaattgtaccaccatgacctttgaacgaatgagtaatgtaaccattttcaatatccacaacaattatactaccatctgtccctccgactgcgagaagcgttgaagtggaatctgcgtcgagaatgtacgatggagaagagattttcattgatctgacaactttcccggtcttaaggtgaaagatttttaaaagctgagcttgtgaaacatacgtgagatattgaccatcaggagttaatttcagtgcagtaatttcttgctcgtcttcattagaaatcttgtgcaaaatttttctggagcctggggttaaatcgattatgttgatttcgtcaagcaccggagtagctagtattttaccattttctgaaacagtggcaacagcactgcttcctgcataaatagggtttaacgatatacctttatatgaggttttcagatccatattgtacgtagtatggcttactaccgttgagagtactatgttgttggttcacacctttaatgccataccgctattatatctgagagcgatgagctgaatttttcagaaaattttcagtcgctttacacggatatattaagaagctccatcttaatcgccagaagagtggatgaggttatcatctcaactagagtcgaagagtaaggcaatccatcaaatggggttgcttgaggcttatttacttttatacgtctgattggacggattataccagtaaaaaaaatattgattgtgtttttctataaaaatatgcatatataagtaaaaaaataacatgtaattcttttcaaccaacgataaagcaaaattcagagtagaataaggcaaagtcacatactgatgatgatattgtaaacgaaaggtgatttgattgtagtaaccataaaaaaatgcaaaatagctcattgtaagacgtcattgaattcgaatgaatggttaacatcattgcccataattccttcgatatctgccaatgcactctcactaaataaaccatttttagtgaaacgaagattttcagccgctgcttccaccatactttgccttcttctccacatggaattactattttcatggcttaatgtattgtcgaattgcacaggagcggttaacgatgctaggatatcggcgtcagtatcttcgatcacatgaccttcttgtgcatcataaccgttaatatcacctacagacagtaagtcattttcatctttgcccaaaatctcatgaatttcatctaaaccaacactttttgttgaatttttccttgtattgctgtccacggcaagatcagaattatgaggtattaatgacgcatcttcaggtgcgtgagagggaagttcattcataggggtattttcattggttgtaaaatcggtaccggtatttatgtcgctatggctgttattgttaccgatgatctcatggccattgattcccaattgtaaattcatagtttcttgctcctttattgccttttgtctttgctttcttattttaagaagcttcttttttttctttaactgcctttttttttcagtttttttccgttgtagctctttcatcttatcaatcttctttcttgttctttcattaccaatatagccaatgggaacttttctgttagaatttgctggtatcatgtactcatcttcttcataggcattaatacccttatttctaaatgcagataatggaaccttaggaacttcataccaatctgcagcatggccatttgtgcttttgctattaattgcatcattgtaattgttctccatatcgtctgtgtgggatggtgaatcatcctccaattcactcatgtttagcagctcattgagtgtcaattcgtcaccgttattgccattagagcttccctctcttttaacatctggggtttgagccctttgatgttgctcgcgaagctgttgatgttcttggattaaggcgtataatgatttagtagacagaccatcaataatactaaaaggtttgttgtccgtctcccaagtacccaattttggtggacgtaatccaacaacatttgaacttacgatttcctttgcttttgagccaatgttttttgaccttgaacttgggggcggtaggttatcatcttcatctgtggattcgtcatcaacgtacacaacagtctctaagagatcatgtttgcaatctttggatccatcagaattttctttgtctgagttagaacttatcaaagaggaagatccatcgctgtcgtaatgaaagtaaaaagagtctggatctaaatcatcgatgtctatgaacacatttgtcacgctggaatcatcgtcgtcgtcttcgtaatcgtcgtccagttctgtgccaatgtctaagctatctgaatctagtgccctcaattcttcatccgtgtcagcatcgtgggacgtttcagattcactgcattcatcatctgaaggcatatgggcaacatccaacaaaatgttatcatattcatcgtcagaagaatcatatttcccggaattcaggaccgtactatgagtggatggttccagatcatcattggattttatcaaattcgagcctttattcttatgttcaatatgacttttgcccgatttatgcctgcctttcttgctcttatggccactattttcatcatctgattgaaaaaaaacattgaaaatatactcatcattgtccacattggaggttgttctcgtactaggtttttgcgtctttttatagagctttcgtctttgtttcctttcttcctgttcccgttttttggcctctttcttttttagtttagatagtttttcatcatttagcattaacggtaaagatgtactcaaggatagctttggctctgaaccatcgccataataataaagatttgcaaatttaggatcttcataaaacggcatatcaaaatcagacattatttcatcttcttcgtcatcttcttcatcatatccgttttcttgattgtattcattttgcaaaaatttattttcagcatcttctacaggatcagacccttcttcgtgtatactaccatcgaatgagagttcgtcgtcattttgtagctcagaaacaatgttttgttcttcttcttccaatatgggaagatcgtcttcccccgtttcaagatctgtaccaatttctccatgagaatcttcattgttaatcacgtcaaagtacgcatcctggtcaatatcatattcagattcatctgactctgaaatattgggaaatcgtaactcatcgttgttacctaacatcaccttagaatccagtttatcttcttcattaccattgttctctttgttttttaaatccaagacttcttcacctatatcctcgttatagccttcattaccattaccaaaactaatgccgtcgtcctcttttttgaatttaaacgatagcgcctgttgtgtagtagtagtgcctgaaccgtttacttcttttttgtttgattcttgttgtttttgttgctcttctttctctttttctttttcttctttctgctcttcttcattttctttcttaggggatagtttaactgatttatttttgttactgttctcacgagaggaatagagtgtattgctatttgtattcatggcagataaagctttcatggctcttttctttctttgggccgtcagtttgacaaaatctatattctcgtcatcagaacttgtttcgctatcactatcactatcacttccgtcatcatcatcgtcgtcgtcgtcttcgtcatcatcttcttcttcttcttcactctcttcttcttcattttcactctcttcgccatctgttacagcttggtaatcggatgactctgtgccctcgtcgtcattgtctatttgcctttgtataagtttacttttttttccttgggaattatttgaaatgttctttgcttttcttttaattttatgtgggtttgtacttttgtttttatcagaatcagatacgtcactcaaggatgactcagaagagtatataaggctaaatcttcttggcctcgttgtactcagtgtgggtggtgattgcctggactttgtatcggattcgcccttttttatgagccttttaatatttgctggcagtttaccagaatgtgtactatgattgatcgtactttttcgaggactttttttgcctgccatttcgttctgtttccagtttgccggttgttttttccttatttgtttatttgcttccttgttgaatttccttcaatttcaacaagcttgaaaatgaatttcgtagaatgaatattactatgtttgaaatggttattgcttatgatgctcaccgaagttaaaaaaaatattataggtttgtcctatgttagaattgtggaaagggaggaatgtaataaataagcagtaattaaatatagccttttgaagagttcctccttttaatttcttgtagcaagtgtttcgaatgtattcaaatattaccaatgattatacaaatacttacagcaagtcaattaaagagccgtaaaagctaaacgtcaaaacgtgtaaagcacctattatctagtctcttttccctagttgtactttaaatcaatttagtgatgagatgaaaaaaaaaaaaaaaaaaaaaagaattccaacgaaaaagaaacgacgggcagggcaacctttagagatttcaatccgtataaagagatgtagtaggcagtacgggtaacatcgtcacaattcataatggaactatctagcttttgcttgattgcaaagttctacacccgttgatacttcaaacatctttgcaatacgtaggtaggggtcgcgtactagcagcctcctagttaagtgtatctttcaatcgcattacggaacaactaggcatcccgaaccccacacggaaaaatcggaacaataactgaaaatttcctttttcttttttttgctcttcaaagtctctgcccctctattgcgtactcgattgatttttttatcaaaggccatctcagacaagtagatctacattggagtttctcataatattatcactatcggaaggtagcataacctttaatagagtttccgctgtttgcttggctcgtttttttgtttgtactatgcctattggcgcaaagaagacagagtgtgcaaacaagagatgaatcagagcgatagcagcttgatggatttaccactggagatacatttatcattactagagtacgtgcctaatgaacttcgtgctgtcaataaatacttctacgttttgcataaccacagctataaggagaagagtttggcgtggatagctgaggacaactatatatgggccgttgtcaaacattcattatgtttatatgtcaagagtttggacccacttcgacagcatgccagagaaatcattcaagaaacgaaggaaccaggttttaatgtgccactgtgcatgactaaatacatcgcagattcttggtatattgtatacaatgcgctgcaatatcctggaaagataattaatatgggatgggacaaatataccaaaagtcaagattcaaatggttctgattctaccagtaactttaatagtcggcccaaggaaagaactcttatgcagtcgttgacagctttacctgttaacttttggtccaggaggaaggacgagcctacaccggtaaacgtttggttttatgtaaaaaatgcgcacgttgccagatacataccgaaaattattacggaaataggcatatgcaactatgggccgaagcagatcgtggcaagtgcaggatatatcaacgaattgataacatctgaaggaatatactgtgttaacctaggccaccttcccaggctatacgatgagcaaatttttgaaggcactggaacgacacatcttcccctggaactgaaagctatcgacaggacagattcagatgtttgtatcaatggtgatttagttctactcggttatgactttattccatatcagatatcgaagccgtggttactctttagaatcgaacccgtaaatagcattgaagcaatcttcaactatagtgaatgttctttttcataccagtttgcatggagtttggcctgcttacaatctgaagagaaaatttcatttcctagagacacgataattgggcacggtttaccttacaagccatccaaattgataagaattttcgtctacaagcatccggaacaaaagcaagatcttggtcaagaaatagcattgcccaactggaataccccttatcttcgaagatgaaaaaaaaatttatcaattagtctataatatatgtgtatatacgtctatgcacctacctacttataaatggatataatattcttgcaatgatgaaaatatgtatagtcaaatttcatttttttcaattgataaatgtactttcaatgatggaaactccttcatcgtcatcgaatttagacttctggcagaattggtaaatgaatggcttcatgtttgccagattttcagcaatagacctaatgaaagcgggcagctcactcattatatcgtacctattgactaatcttaaattagattcttcaaaaccacgcggaaatgaaatggatgtaggatatttccaaccattttgcttatcctcttttgtagatggaaatttaacagcatgatcatttacacttgacccgacctccaaaattttgtccttatcactaaccgcccatatagtcactgtagtgctgccatattcttttgttgtggtgaattcaatacacatcatcgaacgcttctcaccattgaaacaaagaaaattccatttactagccgccttattgggtattagcccctggacagcatccagatacaacataggcgtgtccttcaagtccagcttcacaggtttatcgtttttcttgtatgagatggtaccattgcaaaaacctctaggaacaaaaacatgtcttatcatttttctggacgtactagaagagtctctttttgctaactcttccaagctgatgctcttgtcaaggtaataattggaaccgtccgggtttattatgaatccttcttgtaaatttacggtaatgtcaaccttcaaatcttttagtaaacagcttgtacttcccttcggaatatctatcttaattaataattgagcaaatccactggaggaagaattttccaaaggtacgaagtgaaacgtaacattgtccgattcaacttttaacgtatcaaaatctttgatattatcaattttaaagctttcccatatatcaatgtcttcttcagagttttcctcactgctggctttaaatattttgaaatttaactgaaaacctttgtatataccgcccataacactggaatataatagttgaattaatccacatttgccgttggtgagatccgtaaaatacagagtttgtgtctctattcttgtttccgttggatttcttactgcttttaataaactatgtgacttgaactttttgtgatttgacgtcctgcaaaaccattctagtttcgatgtatcctgaaatttagtataattagcatgatccttctcggataaaacttccttaacgggggcaaatttcgtcttctcctttttgatcgcaaccgccattttttctttgctctatgatttttatgttaattaaactgttcgttgccctaaaattttgaaaatttctcgaatatttagagagaatccgtcactattttagtatctatcttgtctatttatatataaaatctcattcccctgttatggtttttgccaagccctatcccaaaaaaccaaatgatacatgataaacctatttatcctctttaacagacctatcgtttaaagcttttttattgcaaaccctattcattatggctttttgacctaggtctcattgtgacttctatttttcactgttcagtaaaaaaagaaaagtgattaaaaagtatcactatttctgttagaaagcaagtagctattttgattggtaattatatacacatattgaaggaggccgtagtattttcgtttaaaatatattacagtaagataatgtctgctacatcttcaagtggtgacgtgaaaaaatttcaagctgtaccaaaaccaacgagcaatgcatcaccaccaccagcatcgagtgggtttaacgcaaggaccctatggccggatttgatagaaacaccagaaaaccagtgggtttttgagtgcaaagatattattgaaaagataggcactaatggaccgatagcagtggaaataaaaaaaaatatggaaaaatgcttaatgtacttttacacacttaaaaaaaaattaaatctttttgatcacacctatacggcatcatgcattctattttacaggtattggttcatatatggaatacctacagccataactgaatgtattcatatatcacagggaattctggtcaccgcttgcaaaacaatggagaataataggcctatagaggcctatattaaggcgacttgtgagtttttgatgcaaaatataccgtctttaaaaagtcgaacaaatattgataaacttaaatgggaatttagagataagttagtgacgaatgaaaaaaaaatactatgtttatttggctttgacttaaatatcagtaatccaaaagaattgattgaagaagtgttcagtggctattatagattcaacagggatcacaatctgccagaaaactttaaaaaagcttttccaaaaattcttcaagaatcaagaaattttatggtccaagctgtcacccagccagtttctttattgtgcgacggttatacgttcattgtactatctctcatatactgtggtttagagtataaaaagcttgtagacaaagatttcagatatccgaaaaacttcttcaaggatagattccctatcgaagtaacgccggaaaattttgccaatatctttaccgattacaagttactggaagagaattttttcaacttaaaaagtaataaaggtgctaaattacaaattgattcaagcatgattgattcggtgattgacgaaagtggcgatgtggaaaatgaagtttcagaaatctctgatccgtttaactacgagttgattaaatccggtgaggtgaaggaagagtttttgaatcatattgaaacaagggttaaagatttactagataaggctaaacaagaaagtatgaagagaaaggctaaagatcctataagaaccccagatgccaaaaaacctaaaatataaaaatagagtacaagttatgtttaattggagggatcagtaaaggtttgatatatacgtgacaaaatgtccggcaagttccctatgttatcctgatagcaatatttccaatactcaatccaatgatcatctgtttctggatctttaggtgagtcaaagcgcagtttctgcttcaattttgttttcatcttgtctattattattctgggatgtctgaattggtaagttcggggatgataatcgtccagagattctgaacagtcattatcttcggatattttttcagcaacaagtaatttcccctccatagcagtcaacagtaccttaggtagttggtagtcagttacttcatcaggattgtcacaagcatcaataatattttcgatgatacataagcattctatggtcaatttatccatttcagatgatgcttcgaatgtgtattcattatcttgcatatagtatagttttaatacataaaaaaactggataactttaaattgaacacctgatgaaagtaataagccttccagaattttattcaagcagcatataatctgagggtcatttttaagtttgaaagttattgacagaatatttttttgaattgtttcattcatgtggttactatctactaatagtccgattctgggaccgaacacatcacattcacactcccaaatttttcctctcagaatggctaacatttcttcgatttctgcacaatactgaaaaaactgactaaaaacaaaattttcattgacctttgaaaatttaagcgttatcttatccatcgcatcgaaagcgacgcagtataacgcctcaataacatctacctcgtcgagtgaccagtgccattgaagtgacttggtctcctcatttaaatcgaagccatgggaataattagggttttgtcttttgataaaattttttagattattgcctaccaatgcttcattttctttcaaatcaattagaaaacagtggcaacacaacatggatataaatagttcgcaaagttcataaaaagctccaatttgctcgtctgcgatacttgcaaatagtcttgtcctttttgagtacgcaatgaattgtaagcaccagcgaaaagattgaaatgcgaggttataatttttatctacatgaccaaatactccttgaaataattttatatatagtaccagttttaatttattcattgtctctggatcggctttatctttcttcattatcttgatgatatgttttggacccatcgcaagattaaagtttaaaattttggccagcgcttctttcagaaggttattggtttgaatccttaatggtgaaccttttttcatgatcgaaagattataaaaaactacatggtacggaatataaagagccaaaaagtcccttatcaaatcaccattatatgcttgtaaatttaggatagtcttcacagcttttttaaattcttttcttaaactttttttaaaagtttgatagtcgacgtctttattcattatacgtgagccgacaatttgtgactatgatcaataaatagggcatatatgtacaattttgtttgtatttcctcctgttggagatgagtagtaacataatcatgggtaaatcgtcttctctgtgacagcgcaaacctttacgcccaataaaaatttgacagaaaaattctctatagtgccggggcacttcattcaaatttagtaaatagaacttttgtggcaatggacaggttcagctactgcatttcatatgcgaattcgctgctataccagttttgtggccccaaaatcacccggcagacagggtctggtaacacgtcataattctttccctacttacgaacgtaaaggaagctttgccaacttttagagaaatggctacattaattatgaactggagtgaaacaactgtgctaaaatgatacgatctagtaatttataggaaaaagtaaagatggcaaaaaacaaaaaataatgagagctaagggattcgaacccttgcatccgaagatatcagagattttagaggttaaacccacctaaatctgacgccttaaaccactcggccaaactcccattgtatgttgaaaacgatggattatacaagccattgggttagccatttatttctaaagtctttttcttggctgattacttattaatgagaaattggtaaagtttgacataattgttgggattccattgttgattaaggctataatattatgtataagaataaactagaagttctcctcgaggatatagaaactctcaaatggaatcgatatttctacacaataatattacgattatttctccttccgttttatatttttcattatcttattacattatcaatccttccatttcagcttcctttaacttcggttgcatcttctcataccttatgtcatcatctaactacccgtatatgataatatacgcgtagtaagactactagttaatgacgatagttgatttttattccaacaattaagttagcaaatgtgggaaagcataaattatttgggaaatgcatatatctccgcgatttccctagcttaggagctctttgggatcgatatcatttttgttggaatatgttggaatagaaatcaactatcatctactaactagtatttacattactagtatattatcatatacggtgttagaagatgacgcaaatgatgagaaatagtcatctaaattagtggaagctgaaacgcaaggattgataatgtaataggatcaatgaatataaacatataaaatgatgataataatatttatagaattgtgtagaattgcagattcccttttatggattcctaaatccttgaggagaacttctagtatattctgtatacctaatattatagcctttatcaacaatggaatcccaacaattatctcaacattcacatatttctcatggtagcgcctgtgcttcggttacttctaaggaagtccacacaaatcaagatccgttagacgtttcagcttccaaaacagaagaatgtgagaaggcttccactaaggctaactctcaacagacaacaacacctgcttcatcagctgttccagagaacccccatcatgcctctcctcaacctgcttcagtaccacctccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtcagatcactgatgatgaactcaccttcttgtataacacttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgccaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatctgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcaccttaggccaggaacttactgaatctacggtaaatcacactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacgatctgacggcactgtacttgcacctatcgtacaatatggagacttttactgggtatctaaaaggtacttgcttccatcaaatatctccgtacccaccatcaataatgtccatacaagtgaaagtacacgcaaatatccttatcctttcattcatcgaatgcttgcgcatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaaaagtgcaccatcctatttcatctcatttactgatgagacaacaaaattccgttgggtttatccattgcacgaccgtcgcgaggactctatcctcgatgtatttaccacgatactagctttcattaaaaaccaatttcaggccagtgtcttggttatacaaatggaccgtggttctgagtatactaacagaactctccataaattccttgaaaaaaatggtataactccatgctatacaaccacagcggattcccgagcacatggagtcgctgaacgactaaaccgtaccttattagatgactgccgtactcaactgcaatgtagtggtttaccgaaccatttatggttctctgcaatcgaattttctactattgtgagaaattcactagcttcacctaaaagcaaaaaatctgcaagccaacatgctggcttggcaggacttgatatcagtactttgttacctttcggtcaacctgttatcgtcaatgatcacaaccctaactccaaaatacatcctcgtggcatcccaggttacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcattcgttcattgcgtcaaatgagatccaagaatccaatgatcttaacatagaatctgaccatgacttccaatctgacattgaactacatcctgagcaaccgagaaatgtcctttcaaaagctgtgagtccaaccgattccacacctccgtcaactcatactgaagattcaaaacctatatctgaaatcaatcttcgtgcacccagagaagttgaccccaacatatctgaatctaatattcttccatcaaagaagagatctagcaccccccaaatttccaatatcgagagtaccggttcgggtggtatgcataaattaaatgttcctttacttgctcccatgtcccaatctaacacacatgagtcgtcgcacgccagtaaatctaaagatttcagacactcagactcgtacagtaacaatgagactaatcatacaaacgtaccaatatccagtacgggtggtaccaacaacaaaactgttccgcagataagcgaccaggagactgagaaaaggattatacaccgttcaccttcaatcgatgcttctccaccggaaaataattcatcgcacaatattgttcctatcaaaacgccaactactgtttctgaacagaataccgaggaatctattatcgctgatctcccacttcccgatccgcctccagaacctcctaccgaattatcagactcctttaaagaacttccaccgatcaattctcgtcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgcaaaagcagtaaaatcaatcaaaccaatacgaacaaccttaagatacgatgaggcaatcacctataataaagatattaaagaaaaggaaaaatatatcgaagcataccacaaagaagtcaaccaactattgaaaatgaatacttgggacactgacaaatattatgacagaaaagaaatagaccctaaaagagtaataaactcaatgtttatcttcaacaagaaacgtgacggaactcataaagctagatttgttgcaagaggtgacattcagcatcctgatacgtacgatacaggtatgcaatccaacactgtacatcattatgcgttgatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcacattatggattgaaacaaagtggagcgaactggtacgaaactatcaaatcatacctgataaaacagtgtggtatggaagaagttcgtggatggtcatgcgtatttaagaatagtcaagtaacaatttgcttattcgttgatgatatgatattgttcagcaaagacttaaatgcaaataagaaaatcataacaacactcaagaaacaatacgatacaaagataataaatctgggtgaaagtgataacgaaattcagtacgacatacttggcttagaaatcaaatatcaaagaggtaaatacatgaaattaggtatggaaaactcattaactgagaaaatacccaaattaaacgtacctttgaatccaaaaggaagaaaacttagcgctccaggtcaaccaggtctttatatagaccaggatgaactagaaatagatgaagatgaatacaaagagaaggtacatgaaatgcaaaagttgattggtctagcttcatatgttggatataaatttagatttgacttactatactacatcaacacacttgctcaacatatactattcccctctaggcaagttttagacatgacatatgagttaatacaattcatgtgggacactagagataaacaactgatatggcacaaaaacaaacctaccgagccagataataaactagtcgcaataagcgatgcttcatatggtaaccaaccatattacaagtcacaaattggtaacattttcctactcaacggaaaagtgattggaggaaagtcgacaaaggcttcgttaacatgcacttcaactacagaagcagaaatacacgcagtcagtgaagctattccgctattgaataacctcagtcaccttgtgcaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatctatacgtatactacatcgagaccaagaagaacattgctgatgtgatgacaaaacctcttccgataaaaacatttaaactattaactaacaaatggattcattagatctattacattatgggtggtatgttggaatagaaatcaactatcatctactaactagtatttacattactagtatattatcatatacggtgttagaagatgacgcaaatgatgagaaatagtcatctaaattagtggaagctgaaacgcaaggattgataatgtaataggatcaatgaatataaacatataaaatgatgataataatatttatagaattgtgtagaattgcagattcccttttatggattcctaaatccttgaggagaacttctagtatattctgtatacctaatattatagcctttatcaacaatggaatcccaacaattatctcaacattcacccatttctcagaatagatgtgaactctttggttttcggtcagactagacgtcagtaaatagtttgaaagcgagaataaaaaataattgtaatggataatgaaatgccgttaattggtagtattaatgaagaatgaatatccatcttttcatgcaatataagagaaaaatataaaactgctgagatacggacaaaaatcacctatgtacaagtatttattttatcatatacggcgtaagaagatgacgtcaaaaattgaggaacagtcatcgaatttaatggaagctgaaatgcaatgatcgataatgtaataggataatgagtaacaacaattaaattgaagaagaaaaaatagtgatgctctgtagagatgtcatttcccttcaatgttgctatattctcctggcacattaacgtatgcccactattagtgcctttaacaatagaatcccaacaattattcaattattcacccataaaatccacctatttttcaagaaagcattagatttgctcattattatttattattaacataaaagtgcctttggtagttactatgtatttagtgtggtgacccgtattcctcatatatataagtagctaccacattatgttcaatcaatatatctttaactcagctcagcattgtctgaattgctcgcttaagtttttatcctgtgattagtgcatttacacataaacgtataccgggtgtacctcaatatactatgtaaacatttaaattgttaccataacaactcatgttattattaatgatcacttgacaacatataaaaacgaaagaagaaataataatactactatgtataagtatccatttccttttgtggattcctcaaaatggccagtatattcggaagtaacataatgtagttattcatcgatgaggttcacattctgtagcactgacccatcgaaagaaaagagtttatattttgataaattacataaaagctgaaaagtttgtagtggtcatagaaggtaacccacctcctaagaaatccagcatcatatgcataccaccacctccactatactcatcaacatcctgtggtaaaacctgtgatacgctatccaagaaccacactttgtcctttatttctgtggtataacctctcaataatgtatagtaagacctcattattctcatggcccctaggtcgcctgtcattaataatgctaaaaaagtcctatccaaaagagcaggaaatgagaagactctcaacataaaatctaattgatttttttcgcgatgcagtttgtccaaatatgctaaagttatcaagtacggtgaatcaatttctacgggatataaatctgctatactttcgtcaaagcatacgagttccgatatcgtattattgttatttccatcaccattattgctattgtcattatcattattatgattactttggttgattacagcttcacccaaatcactcaagtcaacagaaattaagttataaaacttggatgtctccgacaggggccatacagcagttagtatagttacggcgcctttaacatggaaaatccatgccgttggtgagctgcttgaagcatttgccaatgaatctaggattaatattagagcactagccaccaaagcatctgtgttatcatctgaaatttcgagcacagcctctcttaacagtctcaacgcttctaaacgatgactagacacgtagttatccaagccggcttcagttctggacaaatgagtggcgctaaaagccaaaattgtatgcatcaagaagggaaaatgaaaagccaaatccggaatataagtgctccatacttcaggaccagaaatgcctgcttcggttatggtatgccatacgtcagtacaatagtgatgaaaaagttttagatctatcaaattcaaatttgattttctagacagcccgactaattcagggactagtcgtgaggctgatgaagcgtttgaatggggagaagattgttgttgagtgtgagaatttgatgaacgtggagacaatgcctccgagttggataacaggtcacccattggggacgtcttcaaagtaggagaatttcccaaagcggtcctgttgtccggtatagataacaatgactttgtagaggttacattggatactcccgttgaaggggacgcaatgttttgatctatggaaggtttggacaacgtgtgtgggggactgattgtgagaccggtattgtcgattatcaagtttttgttatgagatagtatatcagaagcagtaactttattttcgtttccgttaagggggttattgcccgaattaacagcatccgtcttagtattatccaatgggttcttcgtaaattgcttgtttttgtcctcctgttcctgttgcatatttgcgagtgcctcctctgctgtgctaactttgattgctctgttattagatgtagcaaactttccgaggccaaataactcttgaaactcagaggccattccatttgcagcaccgtatggaaataatgtattgaagctcttcatattgaagttcaagcccatcttgttcaattgcgctagctggtcgaagggaatattgctgaagggggactgtgttccttgttgttgtggaatttgctgattttgttgttgaagttgtggctgctgcaatccattcgtcaccgaatttagcctaccaggcgagagtaagccgttaaggctacttgataaattcatggccgttgattgaaaactaggtgttatcggtatactcaatggcgaattccctggtagggccatgtttgggtggttgttgtttatcattgaactgggagctgtttgtgttatattattatgcgcttcagctccatttgcactgctgttggtactgttactggtgttattcactaaactcgctaataggtgcggtaacaaaagattctccatattattggatacggatggaggaacgctattaggggaattgctttgttcatcagtaccaacatgtggcaacagttgctgctgtaactgaacttgctgttgttgacgaaattgctgttcttgttgatgatgaagttgctgttgttgttgttgtaacatgatggcattgtcactcagatttttcttgcctaccctatcgtggaccgctgatgcaaattttgacgacgaagaatcttttcttcttcttggctgaatagggctgtaaacacagtccaatttcatgtttgtacatttcttgcaaaatggtttgccttcatcacattttactcttcttcttttacaattgtcgcaaccggtcttggacttgttatgaaacttccgtttccctgtcgaagtcttgctcactttcttgcccccaacctcaatcagttcagcatccttctctctttcttgtccagcattcccatcatcggatgtcatgttatgttagatggagatctatggataaacgaaatataaaccttaaatgaaaaaaaccgtcgacttaactcctctatattatgtaaaggcgaaatgttatttgtgcctttgaaaagtggaggtcttggttgcttctccttcgacgataatcgatttcggtgactagttagtagatgatgtaatcgtagacgcagggaacccttgcttttccccaatcgtaacaaaaaaaaacaaggggaaataaactattagatagtacgagttcgttaagttaaaaaaaaggctataaaagtcgaagaacgaatgattacgaccaacatctattgttcaaacttgccttcgttgagtttatcgaacgcgctcgtttaaatttttccgacaagaacgaggaacgagtcaccaattacgttttcggctctgtcggttgcaggatctgtaaaagcgatatagatacacacgtcagcatgaagctcttatgatttggcgagtagtgttagtacgttaaatgctacgactcggcatatactgtgctcgtttttatcagtttcatccgaggattgtagcctttttttttcatttgttgatgtttctctagtattttccgtcttgtagtggtttcgggtatgttgaacataaacattaaaaaagacgattaaataaacttgagtttgtacaaaggaaagctgtagtcatagagtatttagaaaaaaaagcagccacagtttacatgaagatgtgaccaatgaggaggcatcggtttgcctttgaatctcaatcgcttgaaaattgagttcttttcgaatgatgacacctccgagaaatggcatttctatgctagcgccactctaccctttcaaacgtccgtactcatatgaagtttcatccttcacgcagcgatctaaaaagttgtaaaaaaaaatacatttaggcctagctatatatgctactatgtatcattcagtgaaatggctgaggttatataaaatactgggaggtcgtttttacgctaaagcagaccttgcggatcttttcctgtagaatatatttgtagcataagtccaattttacgggcgcattttcaaaatcaaggtgatattgacatattttgaagagcacccaatgggctagctgcaagaacaaagagaccagaaagcctagaattaaatgccagaaaaatggaaatttattctagacaaaaattgttcggcacctctacagacgtttaacgaacctggtccggcctttgaggcgatcaaaaaaaggcccatttttgtgttccgcgtaattggtttgcgcctttccatggagcttggtgggcgacattctcaaactggtttcctgatacatcatgcacgcccgtaaagggtttaagtattgattgctagcctgaatgtttcatatgcataccgtgtctatgcaacgaatatatttcagaaaaaagcacgaaagccaaatttttgatgttaagaggtgtttttgcccgtaaacggagaagacgtggtaggactcgcaaatgtcgcgtttagcgttgaagaacatggaagtattgaacgtttggggcttgacggctcgacttttttgcactactccgccttgaacagacggatgatcctggcgcaagaaacaaagagaatcaactctgagcaaagcgaaaaaatgaaatacaacgataataaaaggataggaaggtgtatatataagttaattttagatatagattaagaaaagatgggcatatactaatatgactacaaaattgcacattttttacttttcttgataacaggaggctccaaggcggccacgatagcttcatcgaatacattcttcaaaccgcgttgtgttagtgccgaacactcgacatattttactgctttcagttctcttgctaacctggaaccttgttctgatgtaatcggacgtaatctttgtctttgcaacttctcgatgattaccttgtcatcccttagatcaatctgcgtaccgacgaccaggcatggtacacctggacaatggtgatgtacttcagggaaccatttttctttaacgttttcaaaagagggtggggaaataacactgaaacaaaccaaaaatacatcagtagaaggatatgacaagggtctcaatcgatcgtaatcttcttgaccggccgtatcaaacaaacctaacgtatatggttcatcaccaatcatcacagtcaccgcatagttatcgaacactgttggaacatagtcggctggaaattgattcgttgtataggagattagaaggcacgttttcccaacagcaccatcaccgacaacaacacactttagcgtttgcattttgtggaagagctaatacgtttatttcttgttttataagttttgcttctctaattcgtttgttaacctatctcctcaggaaaatagaatagtataataaataacgaatataattttttgcgacaaaggaaacctattgcaaaaagtgaagaatgacagagaaggataatcagtatatctcggtacacctggaacctatttatcaaaacgctgctcttgccttttccaagaatcgcgtctatcatcgatcaatcaaccttgtttgcttttttttatcactttttcccgtatcttgtttcatttggaagggcccaatggaagcagtattacccgtattgaatgacccttgaatcgacggtggaagacatctttaatgcgatgtttagaagacaatgtgccgtatttacctgtatatgtggattatctaacagtctacaatacaaaattaggtgtaacgtagctacaacagttgatagaaataatgcaactttttttaaaaaaaaaagagaaagtgctcgaggtggggattgaacccacgacggtcgcgttgcttttaaaggcctgtttgaaaggtctttggcacagaaacttcggaaaccgaatgttgctataagcacgaagctctaaccactgagctacacgagcattttcgaaagagacgtaaattaaattgttatttataccgtagatgattgtttttcacgaaattacccttttgagttccggcttgtttcgttcaacagtactaccactgataagttagcttcattattggaagaaggttgataaatgaaagaagattcacgactatgcacggcaactggtaagtaatacacgggcccagatatttattttaattcttggaaagaaagtataaatttataggttcgctatcagtaagtatacgaatttcaaactacgtcatatataatatccaaaagaagatgaaggcgatgcggtcactctaggactacaacttatccatcgcctcatttagtgcattcaccgcaatgtatacatctgaaaatgtattatataagggagcaggagccaatctaattacgtttggtcttcttgcatcgccaatgacaccatggtcatgcaaatattggaaaactttgggcataatatcctcttttccagtgtcagaatcgaagtaaagtgacaattgggcgccatgttcttcatctgtgcttgttggagttaatattgtaaaaaaacatggtaatttctcgatccttaaagggtgtttgtaatacttggaggcttccaacagttccgtcatatagttcgtcagcaacaacgatcttttacgaacttcattaataccattaaacttcgcaaataattccaatgaacttctcaatgccactgtgtcaataacgcttggattagattgcctgaatcccaatgctcctggaatcggctcgaatacttccagcatttgaaatcgcttagcaggatcattgccccaccaaccagctaatcttggcaaactttccttagcagggtctggtttagtatgcttcgagtggacaaataagccaccaattccaccaggcccggcattcaagtacttgtaagaacaccaacaggcaaagtcaacaccccaatcatgaagttgcaatgggacgttccctacagcgtgtgctaaatcccatccaaccaatatgtcggggaattggtgggcaaatgaggtgattcggccaatatcgaaatattgccccgtgtaatactgaacacctgacaaacagaccagcgccaattcatcttgatttacctctatggtatccaggatatcttgagttctgatataagtctctccctcgcgtggctcgatctgaataaaaacattctcaggttccgaaattccatgaattttgcactggttgtagaaagcataatagtctgatggaaaggagcccttttcaaaaaggatcttgaatcttttctcagtaggtttataaaacgtaattaacaatgaattcaaatttgcagtgagactattcattactgcaacttcattttcttgagcacccacgatgggggctagtagtggaagaataggtaagtcaatgctgacccaaggcacctttcctctggcttcttcaggatgtttgaaatgcgattccacagcacaatcgctccacgcatctagctcagcattaattgaattcctagttgacttcggcatcaaacctaaagaattcccgcataagtacgtcacaggcttatcgtcggacgatagtcccatggatttaaatgtagggatgttgaattcatccctcagagattccggatattctccgtctaattccaaagctttctccataattaccagtttgtttcttttttccacagaatatttaggcttaatatgtacgtattgacagcatatatatttgctgtcttgaatttattatgctaataaataattatgtttttcaagcgcagtcacctatttccaaagcgatgggtttgtccgtgccgtagacggcatcccgtcgttttaataaccgttataaaaaccgcccccatattttcgtgggttgacgacgacaggcgtggacgacgttaattgacgtcgtcataatatatttcatattatgattttttccctcaccattacttgttctctcaagtaggagtatctggcacttggacggtgatgtcctcatcagcatcaattgcttcgtctggatatgagagaaaatcagaggatagtgggccagtgatagtttttctccctcgtgaagcagcatgttttaccaactcagaagaaacgccatctttttctgggagcggagacaatttttttgttctccggacatttgcaaattgtttttccagttctgtcacagctattttcccggctcttttgcgctgttgttcatctcttttggcctcaacttttctcgaagagactactctttcctgttgtgtttttacatttattttggaggaaatttccgataatgctatttggcgttttattttaatatttgggcttattaaatcaaacttatatttgctggcattccatatgacgccggtgtcatttttctctaaaaatttcatgccagaaaatattattgatctaattcgcagaacacattcttcttttggagaaagcactttagtcaatgtagggcatccaattatattattaatcatgtcgggagaatcatacacataatcgtcattaaaatctgttagtgcaaagttaatgcaagaaaattccctgaaaataatatcttctctaaaaagatagcttcttttcggcctgtggctatatatatttcctgaacaattcagtggactatttatcaagtcgttcagcaacaaggcgaatgaagtgcaaaacttcctgtgtctgtgagtgtactgcaaaatagatctatatgacttaatccagcacataagcaaacgaataatggctagatatcgaaagtcttccatgtttttttgccaggagggtttgatgacgacgtctatgatattagcaataaaatcaaagctcaagtctaaaaaaaaaacctggcgctcactcaaatctgcatatttgagtttgttcttttgttccttactttttcgagttgtaaacataagatcgaaacttcccattgtggcagccaagttttcaagtataacattaatattacctgaatgatactttaatgcagccatttgtaaatgctctttcaataaccaacaattagaagcacgtgatgcgttccatgactgtggaaccaaagtgtgttctactatcgatagaaattgcaaaacaatttgaccttcaaagaatgatttctcacctttgagatcttttgacacaagaattgccaattttttcatcagacgtcttctttccggaaaatcaggagtcaaaatgaaatctttcaaattgtttaacgcacatttagacggaatccttaccaatgctcctcttactaattcaaagaaatacagtgagaatttcccagtgatcaagtaaattttcgctcgttgaaaataagtatctccaacggctgggagatagagtgaggcaatattcaagtacctaatagacttctcaaaaccttccacactcttgggtttgttagacggcttgtttagtagtgttttataaaaatgtgtggaacctagattaatcacgcatctttgtagtgagattacaatggaaaacgtcagtggattactcgtgtttaagataattttctcatgagttgaaagtccatctgtgtattgcattaaattcaacttcgcgaagagagcatttgaaataacggaattcatatcgtactttgcgcataggtgttcgatgatgtcatagtaatacctgtgtgtaattttgaaaaattgaatcatttttttttgaaaaattctaaaaactctgaactttcttctgttacttagtcgcatgatatcatggaaccagtgctcaaaccattggagtgtaggttcgtgaatttgaagccataaaagtttcagaaccaatggtatcacggaatcatttatgcgttcgtaattgttattatggtacatattttcttgtttcaaaagtagctcttcgagaaacctagtagatttgcgatgtattccatccaggaagcatctgaacgtgatatatgcattttcatcgcatgtcaaccttgatgttagatgtttatccagatgcgcacgagcgttcttgaaaaataatctcatacattcttcgttaacttcttcattatccattatctatggtggcatgtgtcatttaatggaatatactttttcccctgataagtttgctaaaaacggtcggatcatacaggcatgttaacatttccattatcctttttgacattggataatggcgtgaacgcgaaaatcacattgataaaaaaaagcagtttggcgaattagtaactgtcaataaagagggcatcgcttttgaaagcaccttcgtctgtgcgctcgcttcagctacgtaaaggtgtattatagacaataatgaaagtgctatgtgtcgcagagaaaaattctatagcgaaggcagtttcacagatcctaggaggaggcagatcaacttcaagggattccggctacatgtatgtaaagaactatgatttcatgtttagtgggttcccgtttgccagaaatggggctaactgcgaagttaccatgactagtgttgcagggcacctaacaggcattgatttcagccatgattcgcatgggtggggaaaatgcgccatccaagagttatttgatgcgccactgaacgagattatgaataacaaccaaaaaaagatagcaagcaacatcaagcgagaagcgaggaatgcagactatctgatgatatggacagattgcgaccgggaaggagagtacatcggttgggagatatggcaggaggccaagagaggcaacaggctcatacaaaatgatcaagtataccgggcagtcttttcgcatctcgaaagacaacacatattaaatgcagcacgaaacccaagtcgattggatatgaagagtgtgcacgctgtaggcacgcggattgaaatcgatcttcgagcaggtgttacattcaccagactcttaacagaaacgctacgaaataaactgagaaaccaagccaccatgaccaaggatggtgcaaaacaccgcggtggtaacaagaacgactcacaagtcgtatcgtatggtacatgccagtttccaacgctcggctttgtagtagacaggtttgaaagaatacgaaattttgttcccgaagagttctggtatatccaattggtagtcgaaaacaaagacaacggcggaacaacaacgttccagtgggacaggggccacttgttcgaccggctgagcgtgttaacgttttacgagacatgcatcgaaaccgccggcaatgttgctcaagtagtagacttgaaatcaaagccaacaacgaaatacagacctttacctctgaccacagtggagctacaaaaaaactgcgcccggtacctgcgtctgaacgccaaacaatcactagacgcagcagaaaagctataccaaaaggggttcatatcgtatccaagaacagagactgatactttcccacacgcaatggacctaaaatccttggtcgaaaagcaagctcaattggaccaactcgctgcaggcggcagaaccgcctgggcatcgtacgcggcatcgctgctccaacccgaaaacacaagtaacaataacaagttcaagtttccacgaagcggctcccatgacgacaaagcgcatccaccaatccaccccatcgtaagtctggggcctgaagcaaatgtttcgccagtggaaagaagagtatacgagtacgtggccaggcactttttggcatgctgctcagaggacgccaagggccaatcgatgacccttgtgttggactgggccgttgaacgtttctcagcttcaggtctcgtagtcctagagagaaatttcctcgatgtttacccttgggcccgatgggaaaccaccaagcagttaccgcggcttgaaatgaatgccctcgtagacatcgcgaaggccgaaatgaaggcgggcactacggcgccgcccaagccgatgactgagagtgaactcattctcctcatggatacaaacggcattggcacagacgccaccattgcggagcacatagacaagatccaagtacgtaattacgttaggagcgagaaagtaggcaaggaaacctacttacaacccacgaccctgggtgtctcactagtgcacggcttcgaggccatcggcctcgaagactcctttgcaaagcccttccagcgcagagaaatggagcaagacctcaagaaaatctgcgaaggtcatgcctccaagactgatgttgtaaaggacatagtcgagaagtataggaagtactggcacaagacgaatgcctgcaagaatactctcttgcaagtttatgaccgtgtcaaggcatccatgtaaggcgtttttgccgccctttgtcttcaaaaaagctctccgcttaattgcatgattcagctgactgcatatgtgcattttcagtaccagccgcaactgcatcaaaccatgcagaagtcgccgccacagaagctccagcgcgccgcgtaaacgcatgttggaaggcgccccaattagcatattcacgcgcgactaccaaacgcatagggaaggtttcagagagccgatgagcagcggatgcacagagtacggccataaggctgcaaagcgcttggcaggaatgggcgttttctagaggttgccttattgatttatatggaagaggagaggattcatcgatcgggcttctaaggcaaatagtatgcatacctttttcgggtagttgaagagaaaagaggaagagaatagaaaaaaaaaaaaagcgaaatttttacatcctctattgtaatgtaatttctttttttttattaggtatatatgtgagatacaattctcgaagtcatcgggaagctttaccatttcatttcctattccagaactcatattagcatctattgttctgagattcatcgcaacatcatttaaaggactgtagagccaattgcattatatcaatatgagtttcggtagtaaagtctccagggctttgagatttttggaaattcctgtcaaagacagggcatctgtgagtttcttgaagaacccggatttgcaacctattaagtcggctaaccaaacatgggggttctggtctaattttgcatattggggtgttatgtccttttcagtgggtacatggatgagtgcctcttctgcactaggtgttggattaagttacccagaaaccattggtacatttatcgtcggtgatgtgttgaccattattttcacattggcaaactcgtgtcctggttacgactggaaggtcggtttcactttggcccaaagattcgtctttggtatttacggttctgccttcggtatcatcatcagaattttgatgagtattgtcaactacgggtccaacgcttgggtgggaggtctttgtatcaatatgatcttggattcatggtctcaccattatttgcacctgccaaacaccttatcttcgaaagttgccatgaccactaaagaattaattggttttatcatcttccacgtccttactgcattctgttacttaatgaaaccctaccacatgaactacattttaatttggtcgtgtgttgctacatttttctctatgttgggtatggtgatctatttagctaaacaggctcacggtgttggagaattgtttacctccactaaatccactgccactggctccaccaaagcttgggcttgggtttatatgatctcgtactggttcggttccgtttctccaggttccaccaaccaaagtgattactcgagatttggttcctccaattgggctatctgggccggtaccatctgtgcattgttaattccaaccactttaatcccagtttttggtgttattggtgcctccacctgtgacaaactatacggtgaacaatattggatgcctatggatatcttcaaccattggttgacaactaactattctgcaggtgctcgtgccggtgcgttcttctgtggtctttcatttgtcctatctcaaatgtcctacaccatctccaactgtgggtttgccagtggtatggatttggccggtttattacccaagtatgtcgacatcaagaggggtgccctttttgccgcatgtgtctcctgggcttgtttgccatggaacttctacaactcttcttctactttcttgactgtcatgagttctttcggtgttgtcatgactcctatcatttctgtcatgatttgcgataacttcttgatcagaaaaagacaatactccatcactaatgcctttattctcaagggtgaatactatttcactaagggtgttaactggagagctattgttgcctgggtttgtggtatgacccccggtctacctggtattgcttgggaagtcaataatgactatttccacaacactggtattgtcaatttcttttacggtgactccttcttctcgtttttgatctcctttttcgtctattggggactatgcctcctcttcccattcaaaattactgtcaaacatgatgacaaagattattatggtgcctttactgacgaagaagcaagaaagaagggcatggttccatacagtgaaatttctgaagaagaaatccgcgcttacacattaggcgaaggttacactaccggccacgagtacagacctgaaggctccgacgatgaaatacctgagttggtcaaaactagctctgaaaacaccaatgagtttgaaatagttcatcataagaataatgaaaagcaatcctccaccgccagtgaaaaagctgcttagtgggaaataaaattgcaaaaaataattaagaataaaatttccctttcatttaatggctctctgcactaatttttttacctacgaaattttccttcgttcacacttaatattaaataacagctctttcctaataataacatatacactagatatataataccaaataaattaaaaaaaaagaaaaacaaaaaataacgtagctttgttacagtcgtaaaaaaaagaacaataaaccaatcttattgccagcgtctaactagtcctattatattccaatatattaaggggtaaggactactattattcgccctgaattgaaatcttttagaaagcacctgttctctctctggtgttctttttttctcatctattatctaatttcttcaaccttcgttatttgttgttattccgtaatcgtggtgctcaacttttgaaatttcacttgtttaccataacggaacataattaaaaatttgttcttgaaagtcacaagcactacgtgaacacaaaattaaggcaagagtgacaaagtaaccctcacaaggagcctgtcgttggttatattggaagctatagatataatcgaatccaatgactggtcctggacctgaaataaataaggaggagcaccccagttctccgggcaagaaacagataacatataatagtatacccaagaatgcaaatctaattgatggatctacgaattcatcgaagaggccaattgaaaagtatgacaagagaatagccgacccaacaaaaagctattttccacatagcatatcaagaacaccaaggagaaaatatacttacattctagtcctcacatcactaaatggaacttttgagagcaaacatgtggtgataccatttaaaccagatggtttgaaattgggaaggcctgttgctaatagtaatagcagctccagttcatcgctcaggggcggtaaaagagtggattcacacactttttcccaagtaaggtccgataatggtaatttcgattcaagagtactctccaggaatcatgcattgttaagttgcgacccgctcacgggtaaggtatatatacgagacttaaaatccagtaatggtacgttcattaacggtcaaagaattggctcaaatgacgtagaaatcaaagttggcgatgtgatagacttgggaacagatatagatacgaaaattgagcatcgaaaaataagtgccacagttgaagaactatttgtacaacctttattagaatcaccgatttttgaaaatgaagatagtgatgattgccatacaattacagaaaaagaggaggctgctgccataacaagtcacatatatggtgattccaacaacctagaattggaagaagttatcctgggctctgatacagaaatactgagtggaatttttattaataattgtattggtacgagcccgactttatctaatatcatcaaaaccctggcaatggaaattccattttccaaatgcgataattttaaattacagtcgatggagaatttcttaattaattatacgacacatctagaatacacgaacaaacttttagtggaaaaaaatgatcagcaactggtaaagctgcaaaatggattaagaaggaaactgtcggggaaatacgaaaagattatcgaacaaaacagaaatcaagtaaaacagttggaaagggaccatatgtttttcaaaaagtcatttgaagtgaagaaaagaagaaataatgaaaagcaaaaaagcatggaaagggaaatagaagacttgaaaactaggttagaagtggaacgatataagaattcacaaatgatgaagaagaacaaacagaaagaacaagaactctcaactgcatctaaaaaaaagactaccgaacatgacactagaggcgtcccgggcatgaatcctaagggtactgacaaatttagcatcaagaacacgctatgtaatcatttcacactattaacatttggaactatttccatcgggattatagctattgtcttcaagatcctttcccccaactagcatcgtaaatacaagacacacacgatccgcttttcacgtcagagattattatatacgtacgtatatatgtaatagatattcacatgtaaaaaaaggtaagcatcctttcatttaagaaagtatggggggagtcatccgtctcacggattctttttcaaaatattgacgtcgtcaatttgcattctttccaaagtttttattcctagcagctttgtcatttctttgacaaaactaattgctacactttgcacatttacaacagcatcgggtcgttgttccataattgaagtagtcagtgtatttttcaaaccgcacatttcaaaactattcatatacgatagatctgtattaacattaattgctaccccgtgcgatgttatggaacgtctgacgtgtattccaacactagcaactttcttcttgccattttcaacccaaactccagtgtcctttgtagtcatagcatctaagttcaaaggcttgtcagtgtcgtcgcacatcttggtattcttcaacgttctgatagtggcctgctcaatgcatgaaaccaagcatttagcagggaaactttgaaatgttttcaaatctaaaataatgtaaataacaatttggcctggaccatgaaatgttacttgtccacccctttccacttgaacaaactttggtcgtgggttgtccttttgcgtttctggaatgaaactttcataagccgctatctgatctggcgtcatagttttcttaatcctcttcccacctgtataagttggctcaaactcaaacgttaatattatcggattaggtttcattgccataaccttgtctaatattcttttttcgttatcatttattgttgcagtgcccttatattcttcatccaattgtattaattttctctcaatcttcgattgaatgtctttgatgtccaaatttgccctaactaatgtctcctgtatttccaatcctttttgaaaaggtattctttgagtgaattgtagatgtctgagcgtttgcgctgagggttttataggatgtgtcatttccttgagagcagaggcataagtgctaaagcattgtcgcctacagacattgaagtttgtgcatacggactggcgaatacacctcgacatggggctgaagctttcgacaaatcttaaattgtgactttgtgcatgaaatttttatatgaacgttttaaataagtggacatagtccttcattcggtatatgcagatccggcatcaaacactttttcaagaaagtttgagtcaaaaggattaaaggataaagtaaaacaacaataacatctccgtgaagcattgagggaagggtttaactccaacaatgtcactgaacaacataacattctgtgtctcacaggatctggatgttcccctgaaagtgaaaatcaagtcattggaaggacataagccactgttgaagccatctcaaaaaatcctgaaccctgaattaatgctgatagggtcaaatgtattcccttctagtgatctaattgtatccttacaggtatttgataaagagagaaacagaaatttaactcttccgatatacacgccgtatattcctttcagaaactctagaacctgggattattggttgactttgcccatacgtatcaaacagcttacctttagcagtcatttacgcattattttgtgggaatacaatggatccaagcaaattccctttttcaatctagaaacgagcatctttaacttaaaagactgtactttaaaaagagggtttgaatccttaaaatttcgttatgatgtgattgaccactgtgaagtggtcactgataacaaagatcaagaaaatttgaataaatattttcagggtgaattcacgagactcccttggcttgacgaaatcactataagcaaattaaggaaacaacgggaaaataggacttggcctcagggcacctttgtcttaaacttagaatttccaatgttagagcttcctgttgtgttcatcgaaagggaaattatgaatactcaaatgaatattccaactttgaagaacaatcctggactaagcacagacttacgagaaccgaataggaatgatcctcaaatcaaaatttctttgggggacaaatatcactccacattgaagttttacgatcctgaccaaccaaacaatgatccaatagaggaaaagtataggagattggaaagagcatctaaaaatgcaaacttggacaagcaagtgaagccggacattaaaaagagggactacttgaataaaatcatcaactacccccctggcactaaattaacagcacatgaaaagggttcaatatggaaatataggtattatttgatgaacaataaaaaagctcttacaaagttattacagagtacaaatttgagagaagaatcggaaagagtagaggttttagaactaatggactcatgggcagaaattgatatagacgacgcattagaactattaggctcaacttttaaaaacctttcagtgagatcgtacgccgtaaataggctgaagaaggcatcagacaaggagctggaattgtacttattacagttggtagaagctgtctgttttgagaacctgtccactttttccgacaaatctaacagtgaattcactattgtggatgccgtatcttcgcaaaagctttcgggtgattctatgttactatctacatcgcatgccaaccaaaaattattaaagtccatctcgagtgaatcggaaacttccgggacagaatcgctaccaatcgtcatttctcccttggctgagtttttgattaggagagcactggtcaacccaaggttaggaagttttttctattggtatttaaagtccgagtctgaggacaagccatatttagaccagattttaagttccttttggagtagactggataaaaaatctcggaatatactgaacgatcaagtcaggctaataaatgtgctcagggaatgttgtgaaacaattaagaggctgaaagatactacagccaaaaagatggaattactagtgcatttattggagacgaaagtcaggcctcttgtcaaagtacgaccaattgctttaccactagaccctgatgtgttgatatgcgacgtttgtcctgaaacttcgaaggtatttaaaagctctttatcgccactaaaaataacattcaaaacgaccttaaaccaaccatatcacttaatgtttaaggttggcgatgatttgagacaagatcaactggtagtacagatcataagtttaatgaatgagttattaaaaaatgaaaacgtggacttgaaattgacaccatacaaaattttggcaacaggaccacaagaaggtgccattgaatttatccctaatgacacattagctagcatactaagcaaatatcacggtattcttggctaccttaaactccactatcctgatgagaacgcgacattaggcgtacaaggctgggttttagataattttgtcaaatcttgtgctggctattgtgttattacatacatcttaggtgtcggcgataggcatttagacaacttactagtcacgccagatgggcacttttttcacgcagactttggttatatcttgggtcaggaccccaaaccttttccgccattaatgaaattgccccctcaaattatagaggcgtttgggggtgcagaatcatcaaattatgataaatttcgcagctactgttttgtggcatattcgattttaagaaggaatgcaggcttaatcttaaacctgtttgaattaatgaagacttcgaacatacctgatatcagaatagatcccaatggtgctatattacgtgtaagagagagatttaatttgaatatgtccgaagaagatgccacagtgcattttcagaatctaatcaatgatagtgtaaatgctttgctgcctatcgtgattgatcatttacataatctggcacaatactggcggacctgattggttgataattggtgcttcaaaatttaaatttcgtcactctaattatacttaacatataaatggtaccttcaatatatcttcttagtaaaaagtagcatgattttgtgttaatttgcactttttttatttaaaaataaaaatcacagttaatttttcatgatcttgcaaagacacgcctccccctaatgtggcatatataacaattgtgaatcagaaaaactcaacactttaacataatggcgggcacgaaggctaaacaaacaagattagcattgaatgccttttttgggtacaatagaacagtactgaatgacatcatatatcgaaaggctcaagtcggcagcatcgtatcttgatacagttccagatgagcatcatgatttcagaaaacccaccgccaaggttgtaacgacgcaactgactattgctacttcactaggtatttttgctttgctttcgttctcaattctactaaaaaagtggcctagattatacgcaagcagacgatataaagatgacgggaaccttcgcttaccgtcctggaatcagtcaagtttattcggctggttaacagtgttgtataagatacgggacgaacagattctggaatatgcaggtttagatgcgtatgtgtttttgagttttttcaaaatgtgcatcaaattactttctattttttgtttcttctctgtgtgcgttatatctccagtaagatatcattttactggaaaaattgatgacggcaacgatgatgatgacagtgaaagttctttaatacatctggtaaaaagaattgtggagggaagtggcgatggtgacaatcattcagctcccgaacgtacaaatgtgtacctctggatgtatgttctcttcacatatttcttcaccttcatagcaattaaaatggcagttgcggaaacaaagcacgtcgtaagtactaggcaagcttatcttgggaagcaaaatacgattactgatagaacgataaggctctcaggcatcccgatagagcttcgtgattcggaagccttaaagaccagaattgaacaattaaaaatcggcaccgtttcatcaatcactatttgtcgagagtggggtcctttgaacaagctatttcattgtcggaagaaaatactcaaaaacctggaattaaaatattcagaatgtccaagggagctccgtactcgacaaccatattcggagaactatcatttattgggaaacgagcaatcaggcgcagttacacatggagaaaatgttccatcaagcaataataatgacgaggatactatactatattctcaaatttctcttggagagagaccaaaaatgaaaattggatatcgtggtatctttgggaaggaagtagatgccatagagtacctggagcagcaattaaaatttattgatgctgaaattattgaagcgaggaaacaacactactccgcaacacctacggcattcgttacgatggattctgttgctaatgcgcaaatggcagctcaggcggtattagatcctagagtacattacttcataaccagattggctcctgcacctcacgatatcaagtgggatcatgtttgtctttctagaaaggaccggttaacaaaagtttattctactaccgtatttataggcctttcaagtttgtttttagtcattcctgtatcatacttagccacattgctaaatttgaaaacactttcgaaattctggccaagcgtagggcagctactaaaagatcaccagtgggccgctaacattgtaacggggctattaccaacctatctcttcacattgcttaactttggaatcccctatttttacgagtatttgacttcttatcaaggattggtatcatacagcgaagaggaaatctcacttgtttcaaaaaatttcttttatatttttgtcaaccttttcttagttttcacattggcaggtacagcatctaattactgggcgtacctcagcgataccaccaaaattgcttatcaacttgctacatctgtgaaggagttctccttattctatgtcgatttgattatattgcaaggtattggtatgttcccgtttaagttgttattagttggtagtttgatcggctttcctctagtgaaaatcaaggctaagacacctaggcaacggaatgaactttacaatccaccgatatttaactttggactacaattaccacagccaattctgattttgattataacgttgatctacagtgtaatgagcacgaaaattttgacttcagggctggcgtactttattattgggttttacgtctataaatatcaattgatttttgccacagatcatttgccccattctacaggaaaagtatggccattaatttttagaagaatcatcgttggattgctattgtttcaattaacaatgacaggaacactggcaggattcgaaggaggatgggttttgtcatcttgccttttcccgcttccagtagtgacattatgtttcctatatgatttcgagaagaactatttgccgttgtcaaaatatatcgcattgagttcaattcgcgagtacgaaagagacaattctacggtgaattctgccaatgaggaagagtcgtatgcatacccttacgctgtgagtgaattagagggtccgatgttggattgaaatcccaaggtgctatttctatatttatatattttgttgtgaaaatgccaaaataagatttttgatacaagtaatactggatatttttttatttgcttataacaataaataagttcctgacttctgtagtagtagtataaactcctgatgtattaaattcttaataactgaaaagttaaactttgccacgaaaactataagtattggcttaaccatgaaatatcgtaataaagacacacttataaaaatctttatgatattccaataggaaagattagttacaatcttcaacgattcaataatatagagattagctacccacttaatgatactcatcgaaattagagtatcataaggccatatcaacatcaatatcggaaaaattttggcaccgtacgataataagatcgtatatgatatgacatcctttgaagaaacggaatagtgcttccaatgcaactttttcagtatgaaatactgggtaaaggtgtggaataaagaaacgtcaagaatacaataacttgcaaagtaaagatattgtattggtgggctccaggtaaacactttacttgtaatggtattgcgcatgattgccgagtcccatttgaagctctctggtaatttttttgaaagcatgatgagcttaccatcattattgttacggttcaaatagtagatgtatttactctcctcagtaacccaagttaaataaatctcgaatgataatagtagaagccaaaggcgatttaaccggtcatatttacaaaaccagttctttacgttaaataacaaagcttgcgtatagtcacgcaaacactggcaatcatttagcgcttttcttttcggatattttgagagatgcaattccaaagcattgaataccaagtgtctatatgcacctgcttttaatagaagcaaatcaatgaataacaggacattatctatctcaacatatttgtctactgtctcttggcaatatggacaatctgtcagctgaatgtggtcattcgagtacactgtataaagggaatctacgggccgcatgcacgttatgcaaatcatcgtttatcacagctaatatctactttttgatgcgcttcatccgttcactgacgcaccaaaccttccttctatgcaatgacaagaatttctcagcttgatttatgccattgatgtttctgaatcatcaattgttcacatagggctattcaatttggcccgctgtccctaaactgaaaaaatactaagaaaaattttgcaaaaaatctaaaatgatgaggtgaaagatcaaaaaagaaagatcaataattaagaggttggcaagtcatcctgatcgtgaaaaaaacttaacaagtacaaatagagtaatcagcattggaaaatgtctcgcgttggtgtcatggtattaggacctgcaggtgcggggaaaagcacattttgtaattccattatatcacatatgcaaactgtaggacgaagagctcatattgtaaatttagaccctgccgcagaagctaccaagtatgaatttactattgacattagagatttaatttccttagatgatgtcatggaagaaatggatttgggccccaatggtgcgctaatatattgcttcgaatatcttttgaaaaatctagactggcttgacgaagagatcggggatttcaacgatgaatatttaatctttgactgtcccggtcaaattgaactctacacgcatatccctgtcttaccgaacatagtgcgccatttaactcaacaactgaatttcaacctttgcgccacatatcttttggaagcgccatttgtgatagatagctcaaaattttttagcggtgcactatctgctatgtctgcgatgattctattggaactaccccatatcaatgtgttgagcaaactagacttgataaaaggcgacatcaataagaaaaaactgaaaagatttttgaatcccgatgcaatgttattaatggaaacggaaggaatgaatcaagcatccaaccctaaatttctaagactgaaccagtgcatagccaacctcgtcgatgatttcggtatggttcaatttttacctttggaatctaataatcctgacagtatagaaaccatattatcgtatgtcgatgatataacacaatgggcagaaggacaagaacagaaagagcctaacgaccaaatagatgtcgaagaatagttatagagaaaattatgtacgcttgattcatataaaaagaggtaaaaaaaaaaaatagcttctcataataaccaattcggactcgggaaagtacaagttcaagttttttattggtttctatatgtataagataaaaatacctagatctatttaattctctgtcttgggccacctggtgatttcttattcctggctgttaggatttcaacaccatgttcggtaaccaacagtgtatgttcaaattgagcactcagtttaccgtcttgggtggtagaagtccagtcatcaggccaggtcatatccttccaagtaccttcattaatcataggttcgatggtgaaaaccatacctggtttcataacaccaggtgttctattcttggcgtagtggggaatatttggggaacaatggaaaaattcaccaacaccatgtccacaataagttcttactacactgcacttattttcggtagcgtgtttttcaatatgatcacctaactcttggaaggtggtacctggcttacacattttaatggctagtttcaaacattctcttgaggtctcagtagtattaagagcttccttagaaatgttttcgccgacataatatgtctcattcaagtctgcatgataaccttggtagtataaggaaacatctaaattgacaatatcaccttccttcaagacagttttatcgggcacaccgtgacaaataacttcattgacagaggtacaaagcgatttaggaaagttgtaataattaagaggggaagggtaggcacctctcttaattgtttcattgtggacgatttcatctaattcatctgtagtgatgcctggtctgacatgggcagcggcaatatcaagaacttctctacccaacatacatgcctttctaatcttcttaatttgatctttcttgtatatagggatgttgttaagtctatcatttctttgttcactgactggtagcccattagcggcccagtccggtttaggaatatcttcagggacataccttcttggggtaagtggatatgaagccttcactttaccagaatatttgaattttgggaaaggatcataagcaccttccaagccgtccttagcattgtgcaaagctttgtgagctttgtagttgttttcataacagcttgtgtcgcagaaaatggaaacgatgccttgttttagacaaacagggcatttcatttgggacgaagtttctctaccacattgcaaaccggagcaatatatcttggtaggatgagaagcctgatcggaggtagtaactgttgtagttgcagtgctcattatacaatttttttgcttatttttttcttgctaggaatatacacaatagcgttcttgggatgaataataataatatcagtttttcttctttatatgaaaaatgaaaaaaaaaaaaaataagtaaaaaattttcgctttcttttcggggagcagccaaataaagattgctgctagtttaaatgagatggaccaaaagccatgggcagcagttctcccattgtcatgactttagaacgagaacctgtggaattaagcatgactattggaaagtccttgaccacaaattcattgataaactgcctgcaaacgccgcaaggggaaacacactggtcctcagaatcgccacaaatgaccatgcatttccatcctgagcgatggcctgccattagaacttgtatcatagcagatcgttctgcacatatacaattactgtagcttgcattctcgacattagcaccagtgaagataacatcgttatttgttaatatggaacaaccgacacggaagtgagaataggggctataggagagttcacacgccttcagtgccgccctttttaaggcttccagttgtctgtcttctatgccacctactttcattaccttatttctctgcttgagattctctgtttggttttcctagtttcttgtacataaacagtttgtgtttattttgtcaaactactcggaaattggcgagcagcgccttatcaagattacagtttgcaaatataaaaatgtaaaggaaagaaagcgtaaggtaacaagaagagaaacggggaagataatggccttggtctctagaaggtcgacaagatcggaaagcacctcaataacaaaggaagagcatacaggagaaggttcattgacgaagttgttcttccgatggcttgttaccttggagggtgatcaggatataaacgatggaaaaggttatatatcgttaccgaatgtctcgaattatatattcttccttggtggcaggttcaggacagtaaagggcgccaaaccgttgtggttaggtgttctccttgctattgtatgtcccatggttctcttctccatatttgaggctcacaaattgtggcatacccaaaatggttataaagtgctggtcattttcttctattatttttgggtcataacgctagcatcctttatcagaacagccactagtgatcctggcgttcttccgagaaatattcatttaagtcaactaagaaataattatcagatcccgcaagaatattacaacttgataacactaccaacacattcttcaatttcaaaagacattactatcaagtattgtccatcatgtaggatatggagaccacctcggtcttctcactgttccacatgtaacgtctgcgtaatggttcatgaccaccattgcatatgggtcaataattgcataggaaaaaggaactaccggttctttttaatattcctgttaggtgcaatactttcgtccgtcatattattaactaattgtgccatccatattgcacgggaatcaggggggcctcgcgattgtcccgttgcaatattgttactttgctatgcagggctaaccttatggtatccggcaatactgtttacttatcacatatttatggcaggtaatcagcaaacaacaagggaatttttgaaaggtattggatcgaaaaaaaaccctgtattccatcgtgtggtcaaggaggaaaacatatataataaggggtcctttttgaaaaatatgggtcacttgatgttagaaccaaggggcccaagctttgtaagtgccagaaagccacatgaagctggagattggagatttatggatttatcgccagcacacagctttgaaaaaatacagaaaatataaggaagtatagatataaagaactcagcgacacagtagtacgtaaaatataaaaaggttactgaaaggagtgaattccgccatagtataggttgagtatacgcaaataaacgttggaaattggctagaatgttaaaaaaaacattcattaaaaggttcttttcgtataacttttacaacaaataagtggttgtttggccgagcggtctaaggcgcctgattcaagaaaatatcttgactgcagttaactgtaggaatactcaggtatcgtaagatgcaagagttcgaatctcttagcaaccattatttttgccttccgaaaattttgaagctacatattagcactcttcttcagatgtcagacaacgtgcagcatctttttttcctaccattgaatatatatatagtaattacggcaaccgtttatataaaaattcaaaagattaaatattttaatatattagtgtctggtttaaaagtcatacttctctaatcactaccgtgaaaaaagcagttccataagtgttcattactgacttcttggtctaccacgcttatctcaaacttcgcatcatcgctttcctcattatccgtttcatcttgtgcttcgtcgtatttatcgcctttttttgacttctcctttcttttgcgctcttcgagtatacatttatatctgaggatgttttcttcaacggtatttctgatcatgaaattccacacaaaagtttcttcatcttgtcctatacgattattccttcccatagcttgtaattcatcactattattaaggataggatctagtaggaaaatatgttttgcatttatcaaattcaggccggcacctaaagttttcacattcaaaagtaggcaagtgacggaaggctggcgtttgaagttatttatagtttcgccaacattggctgtattagatagacatgccaagtgttcaatgtgatacaactttaataccttaccaatgacctttaaatattctgtcttttgagagtatagaataacttgtggcggatcagcgttttcctgctcactttttagcctcaggtaagatattaacttgatgacgaaatcaatcttagcaccaaaactttcctttatgtgaatttgatggacttcattaatttgatggaattgctcgtatttatttccgaataatttttctacttcactcatattggatataatcgagttttcatttgaattatcttgagacgaatcggcgccctctcttcgtggctcttgaatttctttttccctcttctccgttgagttcttgaacttaaagttatagacttccgatatactacagaaacctttgcatatagggcatttactatgggctcgtagccacgtaaggatacaactcttgcaaaaataatgtccacacttaatgatagcacctatttcaacttctcccaaacagatagagcagctcaatatttgattatcgtttaatgtgtctttcaatctggacaaattttttaaatatatcagccgtgattcaatgttattgatttttgcatctagtgtaccgcccaatgacttattgatagttcttattagatggctgagttgtggagcactcaaagagtgcaaggacaccaatgaatcggaaatcctctgtaattgactataatattccgtcttggcattataaatcgatcccaggattttcaaagattctcttacctgtttattgtacttaaacaggcttttactttcaacttcgtactgaagtaagtagtcctcaaaattttgaatggtagattcactttcattgcttgaggatatccgtcttactatcctgctgttcttcagttcatcaaaaacagttcgtagaggtgttcctgaaatcaagcgcaagctgttcaataactgcttttgatattttgaaattattgaaccttccggtaccaaatgcttcggaattttaacttctgattctgaagttaaaatattgtccctattctgtaaaattatctccaagcaaccaagaagactgaatatcttatcttgactgtcaatcgatgttgaatattcttcattaccgataattttattagtgctatcatcgtcctctgtcctgtggacaggttcatagataataatgagtaactcatccaataactcgttgaagtttttagtttgttcattcaacccttctatcaacttactcaaagacttgaaacaacgagatactgctaaattagatgagtagtcatttttgtggtcaaattcaatattgattaatcgcaaaggtatattgctcgtcataggagcaaacttagttctggccattttaatagtcatatcaacttttctagcctcagaggagaggattgacttcctcaaaatttctgcattcgcataattttcttgttctaaaagtctattctcttcaatttcctctaactcattttttggaaaaacatcagaatacaccacttcttcagtcttctcttttcgatgcttgtcgtccgcctcttctagcttacgagtgcccaagttatagtaaacagaaccgaggaagaagtagcaatcatgcagtaaattcatcatagcacgtaatcctttcttcttcaggtggttggataacattccgtcattgttgtgattatcatggtttttagcaccatttatttctctatcgctttcgtcgcctgaagatgtttccttctcaccaaacctctcgtccatatgttcgtcctcatcttcactgaggtttaacgacttatcaaacggatcctcaacgttgaatttttggcgtatgtgtatcatcaaatcatctctgattttgataaatgattcaagggctttggccggagtattggaaatttcaagttcatactgtgcctgcttgatcgataaatggaatctctctctgtaatagccaattaaactgtcaaatgcatccattcgcatggatattaagatatcgtctatatttgaaattcttgacaagtgcccgtgaaggcgcttctgtcgggtacttaaaatttctggaaataatgcatggcaacatatatatcgcagcctagacaaccattcgtttaaaaaggcattgcttacacggggtgatccactgccatccgaattatagccactcaactctaaaaaattgttccaaagatttaaatagttgtcccactcgataggcgcaaactccaggggaatgatgaagttgtgttgccgcggaatatgaatctgagacgcaacattggctttcgaatgccttatgcaaagatcatacctgtaaaaaatgttcatacaatccttgatagaaaaccgaacgccctttaattggcatacaaaatcattactagtgtaatctttagcctcatttcttagtttaatttcttcttgaagtgtccgaataaagtctacctcatcacaaaatggatgcagctttaaataagacatgatcatcctaaagttgtaaatgttctgtattggagtcccggaaacaccccaagtgtgtattctatgaagtaaactcgtgcattttgcagaatatgttgatgaactacgtagcatttgaacttcatccagaatgattctataaaactgcatcaaagctaacggtgaagaatagtcatactttgggcttttcaaccttctcgatctgatactacggttaaactcagcatgatggacctccgtggcaataatgttatatgatgtaactataatatcgtattggcacaattgttgaacagcttcgtccacagttttgcaatctttcattatctcattatatcctctataggtataccattttaaggaatttgcgtgtaattcgatttcttcgagccattgttttaagatagcattgggacagataatcaaagtcgtctttgtcttcgtgattgttctattttcatcgtcaataaatgttgcctctgagtccttcaatttccttctatttaagagtattagtgataaaatttcaatagttttgcccaaccccatctcttctgctaacaccccctttgcacaaactgggtagtcgccgcttaacctttccttcctatattggttgtacaaatgtgcagcatcttctgtagttagaatatatcctgttaatttgttccataacaatgatggccctacctcgtcagggctgcgtgcaatgagctcgtaaccgtatgcatagtactcgttcataaaatctataagccctacttcgtcgatgactgtaggtgtatcactaagagaattaccatgcccttctttaattagcatccactcaacgctctctctttgaaatggtaagaggttaacttttaggtctggtatagattggggtaagaacggtttgatctttgatagcctatctttactatattccaagatttgagaaataaattgtttttgaatgaagtttgaatggatatggctgtgcttgtgatatcgctcaaattcgttctcgtccctattagagaacgtcaagtccagtatttggttagcctccacggaaaaccggttgaatttattatttaaaaacttcaacttcaaattaaaagataaaacccatgttaaagaggaatcattgtatcggaatacgactggagagcattcaaaatctttgtaggacaaagataattcgtgtatacgactttttagtaatttttcaggatcgttaacatttgaatttttttttcttctctttcttgatggtttgcgttctaaagatttacgattttctaactgatttcgtagggccctttcttggtttttatgagcacatatatccaagatcagcggaagttgtttgtcaacagcgatttttgaattgttctccattttaaatccaatttgaaataaggatacggaatctgacgacacaacaagtgttgcctcgttatcattttcacaaggtaagatctctatatcaacaataaatttaaataactgcctaccgttgttggaaagacttattcgctctggtatttcgatatttaccgaggcaacgttgattaattcttttccgttcttgctaactttttgagttacagtctcttgttcctgatttagcgctggcaatgctgctatcactgaatcaaaagaaccattttctaggaaaaagtcgcatttttcggcagtcacgttgtactcccttgctaatagcgcacctactgcagacatttaccgtcgaataagttggcctttcctggagttcattcctttagacagcgcctagaaagtggcaaatcaatacattcatcagccacatttcatcagctgtagatctggaaaagacgggtagcagttcgagtgttccgaaaaaggaaaaaacgagccttatccttggtcagagatgcgagcaggtaattccttgagctctcataggagtgaagctatcccagactccttggatgtccctgtatttgcggtcaagtttgttctttgactggttcgtcatttcgagctcacttaaaaacaggagttattcagctacatcttcaagctaataaaacatccgttgcgcaggcactctttttagtagttgccatttcctttattcttgaaagtacgaaggctgaaaaagagccactacgatccaaaaaatcaccgttagttttagtcgtccacgagtacgttggcataaagtctagtaatctttttactttatagcaatcaagagaaaaaaggaggataaagggacatttatttgttattgttttttgttctttttaaacttttttactggctaggtttaaggttataattataaatccagtgattaagaggaaacctcgtcaagaatcctagataatagtaatcagcgacagttatttcaacgaagtcaaactctatctctggggctttatctctcctattgacatctaactttttacaaacgcttactagaaaagacggatcggccaaagaaaaaaaaagagtgacatcgaaaaaattaaagaaaataaaatcccagatagttcatacgttatttgaagtacaaacatttaacgattggaaaagacgaaagtattgttaagagtactgcttatttagagaggatcaaacaaaatctcttcgatgcttaaaataaaggcccttttctcgaaaaagaaaccggatcaggcagatttgtctcaggaatctaaaaaaccattcaagggtaagaccaggtcaagcggtacaaataacaaagatgtttcccagattacttcttcccctaagaaaagctttcaggacaaaaatatagttcagtacccgagtgttgtcgcagatgaccatcatatgaagtctttaaccgatgaattagtaaccacgatagactcggactcttcaccgagtgataatattaccacggaaaatgtggaaacagttacttccgtgccagctatcgatgtccatgaaagtagtgaaggtcaattaagttccgaccccttaatatctgacgaatctctttcggaacaaagcgagattatcagtgatatccaggatgacagtactgatgatgacaatatggaagatgaaattccggaaaaatccttcctcgaacaaaaggaattgataggttacaagctgatcaataaaatcggtgaaggtgctttttcaaaagtctttagagccatacctgctaaaaatagttctaatgaatttttaactaaaaactataaagctgttgccattaaagttatcaaaaaggcagatttatcctcgattaatggtgatcatcgtaagaaggacaaagggaaggacagcactaaaacttcttccagagatcaagtcttgaaggaagttgcactacataagacggtttccgctggttgttcacaaattgtcgcgttcatagacttccaagaaacagatagctattattatattattcaagagttactaaccggtggggaaatcttcggcgaaattgttaggttgacctatttcagtgaagatttatcaaggcatgtaatcaaacaattagcactggctgttaaacatatgcattcactaggtgtagtgcatcgtgatataaaacctgagaatcttctttttgaaccgattgaattcacacgctctataaaaccaaaattgaggaaatcggatgatccgcaaacaaaggcagacgagggaattttcacaccaggagttggtggtggtggaattggtatagtaaaactagctgattttggtttgtctaaacaaatattttccaagaacaccaagactccttgtggtacagtcggttacactgcccctgaagttgtcaaagatgagcattattctatgaaagtggatatgtgggggattggttgcgttttgtacacaatgttatgtgggttcccgccattctatgatgagaaaattgacactttaactgaaaaaatatcaaggggtgagtatacctttctgaaaccttggtgggatgaaatcagcgccggtgccaagaatgccgtggctaagctattagaactagagccgtctaaaagatacgacattgaccagtttttggacgacccatggttaaatacattcgattgtttaccaaaggagggcgaatcttcacaaaagaaagcaggtacttccgaaagacgccatccgcataagaaacaattccaactatttcaaagagactcctcgctactgttttcaccagctgctgttgctatgcgtgacgcctttgatattggtaatgctgtgaaacgtaccgaagaagaccgtatgggaacacgtggaggattaggctcgcttgctgaggacgaagaattggaagatagttacagtggcgcccaaggcgatgaacagctggaacaaaatatgttccaattaacgctggatacgtccacgattctgcaaagaagaaaaaaagttcaagaaaatgacgtagggcctacaattccaataagcgccactatcagggaatagcaactttcccttctgtttcaatctttttacctattcctttttaaaagatatatatacattaaactccttctacaagtatatattttatacatatctacagggcgtatatatacataacattttaagataagcaagtgaatgttgattcccgtttcttagtcaacacttctttctattttacccggtcgttaccctattaaaaaaacaacttacaatcattgttcgccccttccatacttactgccactcgcaaaagggcccaaccagggcaattacgtatcaaaaaatcatgacaggctgggtaataaatattcgtgaagaaagaagaaattaaaaaaagaaacgaagaagcaaaaaaaagaaaagactccgtttaatcactttcaaccgcggtttatccggccccacccatgcataaccctaaattattagatcacttagcacgtgaaaaagaaacgtttttaatgttttttttttttttttctttttctttttttgcgttggtgaaaattttttcgcttcctcgagtataattatctcatctcatctttcatataagataagaagttttataaaaaccttttgcatcaaaattttgtagaatatctctttttcttacgctctctttctttccttaattgttttctaaagaaccgtgtatttttctagttcgaatccatcgataacattaaaagatgtctgattcccagcaatccattaaggttctagaagaactattccagaagttatctgttgccactgctgacaacagacacgaaatcgcttctgaagtcgcttctttcttgaatggtaacatcattgaacatgatgttccagaacacttcttcggtgaattggccaagggtatcaaggacaagaagaccgctgctaacgccatgcaagctgttgctcacattgctaaccaatctaacttgtctccatctgttgaaccatacatcgtccaattggttccagctatctgtaccaacgcaggtaacaaggacaaagaaattcaatctgttgcttccgaaactttgatttccatcgttaacgctgttaacccagttgccatcaaagctttgttgccacatttgactaacgctattgtcgaaactaacaaatggcaagaaaagattgctattttggcagctatctctgctatggtcgatgctgctaaggatcaagttgccctaagaatgccagaattgattccagtcttgtctgaaaccatgtgggacaccaagaaggaagtcaaggctgctgctactgccgccatgaccaaggctaccgaaactgttgacaacaaggatattgaacgtttcattccaagtttgattcaatgtattgctgacccaactgaagttccagaaaccgttcatttgttaggtgctactactttcgttgctgaagttactccagctactttgtccatcatggtcccattgttgtccagaggtttgaacgaaagagaaaccggtatcaagcgtaagtctgctgttattattgacaacatgtgtaagttggtcgaagacccacaagttattgctcctttcttgggtaaattgttgccaggtttgaagagtaactttgctaccattgctgacccagaagccagagaagttactttgagagctttgaagactttgagaagagttggtaacgttggtgaagacgatgctattccagaagtttctcacgctggtgacgtttctactactttgcaagtcgttaacgaattgttgaaggacgaaaccgttgctccaagatttaagattgtcgtcgagtacattgccgccattggtgctgatttgatcgatgaaagaatcattgaccaacaagcttggttcacccacatcaccccatacatgactatcttcttgcacgaaaagaaggccaaggacatcttggacgaattcagaaagagagctgtcgacaacattccagttggtccaaacttcgacgacgaagaagacgaaggtgaagacttatgtaactgtgaattctctttggcttatggtgctaaaatcttgttgaacaagacccaattaagattgaagagagccagaagatatggtatctgtggtccaaacggttgtggtaagtccactttaatgagagctattgccaacggtcaagttgatggtttcccaacccaagaagaatgtagaaccgtctacgtcgaacacgacattgatggtactcactctgacacttccgtcttggatttcgttttcgaatctggtgttggtactaaagaagctatcaaggacaaattgattgaattcggtttcaccgatgaaatgattgctatgccaatctctgctttgtctggtggttggaagatgaagttggctctagctagagctgtgttgagaaatgctgatatcttgttgttagatgaaccaactaaccatttggataccgtcaacgttgcttggttagttaactacttgaacacctgtggtatcacttctatcactatttctcacgactccgttttcttagataacgtctgtgaatatattattaactacgaaggtttgaagttgagaaagtacaagggtaactttaccgaattcgttaagaagtgtccagctgctaaggcttacgaagaattatccaacactgatttggaattcaagttcccagaaccaggttacttggaaggtgttaagactaagcaaaaggctattgtcaaggttaccaacatggaattccaatatccaggtacctctaagccacaaatcactgacattaacttccaatgttctttgtcttccagaattgctgtcattggtccaaatggtgctggtaagtctactttgattaacgtcttgactggtgaactattaccaacctctggtgaagtctacacccacgaaaattgtcgtatcgcttacattaagcaacacgcttttgctcatatcgaatctcatttggacaagactccatctgaatatatccaatggagattccaaaccggtgaagatagagaaaccatggacagagctaacagacaaatcaacgaaaacgatgctgaagctatgaacaagatcttcaagattgaaggtacccctagaagaattgccggtatccactccagaagaaagttcaagaacacttacgaatatgaatgttctttcttattgggtgaaaacattggtatgaaatctgaaagatgggttccaatgatgtccgtcgacaacgcttggattccaagaggtgaattggttgaatctcactctaagatggttgctgaagttgatatgaaggaagctttggcttctggtcaattccgtccattaaccagaaaagaaattgaagaacattgttccatgttgggtttggacccagaaattgtttctcactccagaattagaggtttgtctggtggtcaaaaggttaagttggtcttagctgccggtacatggcaaagacctcacttgattgtcttagatgaacctaccaactatctggacagagattctttgggtgctttgtctaaggctttgaaggaatttgaaggtggtgttattatcattactcactctgctgaattcacaaagaacttgactgaagaagtctgggccgtcaaggacggtagaatgactccatctggtcacaactgggttagtggtcaaggtgctggtccaagaatcgaaaagaaggaagacgaagaagataaattcgatgctatgggtaacaagattgccggtggtaagaagaagaagaagttgtcttctgcggaattgagaaagaagaagaaggaaagaatgaagaagaagaaggaattgggtgatgcttacgtttcttctgacgaagaattctaatctttttgatcactgctttcacagttttctttaagatttttattgatcaataatttatgtatattttaatttctatgtttttgtaatattgtttattttggtaaaatatagacgcaacttccttattataaagaaaggcattatttaaaagaaaaagcgttccattagtcagacatctttttttttcatacattcttaagctcaggcaaattgagcattgcctcatacccttttcggtaagagggtaacgaaaatatttttttggaagaataaaaataggtgacggatcatagactaggaagctttaaaacatgattgagcgtaatattatattccttctagaaaagataaaagagccaagacctaaaattttttcatccctgttctattaaaattgtggaaatgaggtttttgaggggatttgtattttctttggctttcactctatataaagtaactgccacggcagaaataggatctgaaattaatgtggaaaatgaggcaccacctgatggtttatcctgggaggagtggcatatggaccatgagcatcagctaaaagattacactccagagactttcttcgcgttacatgatatcaagaagaaaggatttttagatgaaaacgatattctatctctctacgggttgaaccgtgaagaaattgtgggggctggtgatggtatgggacaacacgatgaatctgagaaaattgacaatgaaatggctaagcgtgttgttagccttattatgaggttattggatgttgatgataataccaaaatcaccaaggaggaatatctacaatttgctaagagaggaaacaagttccctgaccttggcgttggtgtaggtcaccactccgattttgagctagaatatgaaattcatcactggaataagtttcataaggacaaagatccagacgttaaagtcgttcacaaagaagacatagaacatgaattgcttcatcatgaacatgaaattgaacatgaagaagaaattcaaagaggcgcttctagagctactgtaataactgatgacgaactagagtctagaatagagctgaaaaatattcccgagaaattcaaaaatggaattttttaatggacttggtcaagatgaatagttgagactgagaaaatattcaagacactatgtatgtagtcaattagcatgtagtaagtaatcaaagcacttaaaatatatttttaccatcgcatcgttgtgatgcctctcctttgtgattaactatctactttaaacgttctattttctatgttctaattacgtatgtattggtcttttctctccgatggtaacaagaagcgtttcgggaaacagtggcacctccttgtcccttaaatgtcgaactttaacagtataagtacaaagtgaaaaaaaaaaaaaaatggaaatatctatgatagtgatatgatagaagagctatttgaatgctatgttgtcatatttagccttacaaaagggaaaaggcaaacacagtcttttgttattactataggaaagatagaattgatattaaaacagtatgaagttattgcatttatatgaagcgagcttgaagagaaggcccaaaactacgaatgcgataatgacaggtgcgctatttggaattggtgatgtttctgctcaattgttgtttccaacatccaaagtaaacaagggttatgattataaaaggacagctagggctgtcatctatggttctttaattttctcctttataggtgacaagtggtacaagatcttgaacaacaagatttatatgcgtaacagacctcagtaccactggtctaatatggttttacgggtagctgtcgatcaattggcgtttgcgccgctaggtttgccattttatttcacctgtatgtccatcatggaaggtagatcatttgacgtagctaagttgaaaataaaagagcaatggtggcctacacttttgactaattgggcagtttggccacttttccaagcgattaacttttctgttgttcctttacaacataggttactagctgttaatgtcgttgcaatattttggaacacttacttatcttataaaaactcaaaggttatggagaaagacaaggtacctgttcattatccacccgtggtcgaataactggataagaaatcctgattttgaaaatatttggaattcaactagcatatttatcagaccttgttccttggggtactggaacagcatatacctaatagactttcggcagagagcagaccaacttcataaatatttgagtcaccaaagttggctagcaatctgcttttcctttacagatgtgcttggtcaggaacaatttatttaattacattcgtacttcttttatagaggaaatagtagctaacatttcactattgcggtcatgcctgttgttcttcagctaccgtttatgcaaaggtgtttaattaggtgtgagacttaagtgggccttttagtaccactgtgggttctggacctttatataatatttcattttttcaaaggttttttcatatgccgttaaaagaggtcaaaacatagacccgaggaacatatcttgtaaatcgctgcgttatgtatgcatattgtactcctaccttcgtaactggaaagaatcagtctgaaagtttattgagcctgaaacggagcaagattatagttgaatgtttcttattcggtgttgatagtagatgatgaccaaagctttttttaacaaactaccgtttgaggtattccgtcggtacgttaggacaggtaaaagcatccctcaaagaagccccaggacaagaaaatctcttctggtgggtgggactattgcatcagcagtagttttgtacaactttaatgacacttttcatgattctgtaaagcacacggcactgacgactaaaagaatcgctgtcgtcacacaagctaccactcgttgcttctaccattacaagagggctctaaataaaagctatgagaacaaaaaagaacgagaagttgccttaaataaatgtcataagatgtgtgccttaatcacgttgcatgcgctacgatcgaatggtgggatatatatcaaattaggccagcacattggggccatgacctacctgttgcctaaagaatggacggatacaatgataccgttgcaagaccactgtcccgaatccacctacgaagaaattgatgagttatttaaagaagatctaggcaccagcattgaggatatgtttttagaattcaacaaaaccccgataggtgtagcttccttggcacaggttcatgtggcaaaactaaaaaatagtgacggtaaaggttctagtgtagctgtcaaatgtcagcatccatcgttgaaggagtttataccattagatgttatgctgacaagaacagtgtttgaactgctggatgtcttcttccctgattatccgttaacgtggcttggtgatgagcttcagtcttcaatctacgtggaactgaattttaccaaagaagctgaaaatgcagaaaaaacccgtcattattttagtaagttcaagaagcaaacagcattgaaaatacccaaggtcattgaaagccacaaaagaattttgattatggaatatgttggaggcaaaaggttggatgatttggagtacattgacagtcacggtatctcgcgcagtgaagtttcgagttgtctctctcatattttcaataacatgatttttactcccaatgtaggtattcattgtgatcctcatggaggaaatctggccatacgatctgttaagcccgctaaagataatggataccataactttgaaattgttttatttgaccacggactctatagatatcctagcacgagaacaagaagactttatgccaaattttggttgtcgctcctattcgacaaggaccagacaaaaatgaagaagtatgccaaaggattcgcaaacatcaccgacgaacagtttccccttttagcggctgcaattacgggccgtagcattgatgctgctttgaattacgacatttcaacgagtcgaacacaagaagaaatggacgtcatggcaaatgggatcttggaaggaacgttactgagcgacttgatgagcattttgtctagaatccctcgtgtagtgcttttgatattgaagactaacgacctaaccagacatcttgatgaatgtctacagaatccactcgggccagagaggactttcctgatcatgacgcaatactgcgccaagacggtctacgacgaaaaagtggaaagaattaattcggagtatgcgaggtggtctattaaatggatgtgggagaacttgacaaactggatagtctatgagaggcgtattaatcaattgtatttttatgattttgtgttgtggtggaaaaaatttattccgaagacttggttgtcatcttaaatcgttagcgttctttctacttgtaaatatatacgtaaaattatatataacaattttatatgtgtcattaaacggaagacgttgttgctatcacagtggattgtgttatttgggtatttggaatattacagtgacttcttgcagcgttgttagtttttgccatgttctgcaagtacaaggttgaagatgtggtcgagactttgatagtatccttaaacaacttcatttttttattttgactgggtaacgacctggtgttccttctagtctcaccgctagtggcttcttctttgctgactcttaacttttgcagcgcctctttggtgtcgagtaactcgtgttccagtagaacgttgcgttccagtcgtcggtcactctccaattgtaatgtctctatcttattcctcagttggatattttcattttccaactcatctacctgtatctctaaatctgttatctgtttcttattgcacttattttgttgttggctctcaagaagatcgctttttaactttgatattacttgttccaaatcattttcatattctttcgtggcgccttcaagctcgctcaactgggtctccagtgaggagattatctgtatagctgtttccaaatccaaattcggcaccataggaaagtcgcaattgttgcacgtatatgtcccttggatattccaattaaatttgcgaggattgttctttcggccgttcgtggtttgttgtagcccttattatccctctttttcatccttaattgcaaatttatgtatgaaaactttcatttctaatgttattaattttcccgattctgcaaactaattgataaaataattgatacttgccgtcacagatgatatagagaacgttcagtttttttattgttctattgtaaaaaaaaaaaaaaaaggaagaaaaaagcaagatccgataggagaagacctctttagcggctttactgcgctacaaataaggttacgaatatgcggaatagttcatgatacgttgttgagttatagtatgtagccaatatttcctgtttttccgctgttacccttttcgaaggatcgatgaacgcttctgtcacttagtaagcaaatgtacgaaacccagagcattgtatgtacaccagcagtcgttttttgtagctcttttccatggatggacgatgatggcaagacgcgatcgtggcggagcctcactaagaaaaacaattgtggagaatctatacacacagaaatcgtacttcaagaaatattgattagcgagcctttaagcacagaacaatctctatagccaacatcttgtggaagctacaactgtttttcttgttcccgcttgagtagggccttacaaggcaagaccgtataaaataaagataactcctccgccgtatcctgaatttcgtgtgccctttctctctctctctcttcctctttcttcctttccctttccctcttcttcttatctcaacaaccgcccagcgcattagcaaaccacagtacgagctgtacggctgagccactgcacctgtctggcttgcccctttttgttgagtaaccgggtaataattcggctgtctaaacgatacaatcctcgttccacccacacccattcacccgtcgggcgaaatccaccctcgcggcctcgtttagaataccaggcaacggcaccagcaacggccccggtaactcgatcgcgttcatatatatcggatatactcttgaggcacaatttttttcggttttcggttttttctattattcttcgagatgcaaagcacacatttgagactcacaactcaagataccgcaagcacacagacgctattgttctcccaaagaataggttcctgcagtgctcttttaaggtttgaagatattgcacaaaattgtatctgatttcatctcatcgaacctcattccatcaacttccttttatcaaagcatcttgttttgttttcgcagaaaatttttcttccctttcaatttggccttttagtttttctccagtcgcaggcaagaaggtaaggaaatagaagaaaaagaaaaaaaaaaaaagggaacaataggttagatgtcgaataccccttataattcatctgtgccttccattgcatccatgacccagtcttcggtctcaagaagtcctaacatgcatacagcaactacgcccggtgccaacaccagctctaactctccacccttgcacatgtcttcagattcgtccaagatcaagaggaagcgtaacagaattccgctcagttgcaccatttgtcggaaaaggaaagtcaaatgtgacaaactcagaccacactgccagcagtgcactaaaactggggtagcccatctctgccactacatggaacagacctgggcagaagaggcagagaaagaattgctgaaggacaacgaattaaagaagcttagggagcgcgtaaaatctttagaaaagactctttctaaggtgcactcttctccttcgtctaactccttgaaaagttacaacactcccgagagcagcaacctgtttatgggtagcgatgaacacaccacccttgttaatgcaaatacaggctctgcttcctctgcctcgcatatgcatcagcaacaacagcaacagcagcaacaggaacaacaacaagacttttccagaagtgcgaacgccaacgcgaattcctcgtccctttctatctcaaataaatatgacaacgatgagctggacttaactaaggactttgatcttttgcatatcaaaagtaacggaaccatccacttaggtgccacccactggttgtctatcatgaaaggtgacccgtacctaaaacttttgtggggtcatatcttcgctatgagggaaaagttaaatgaatggtactaccaaaaaaattcgtactctaagctgaagtcaagcaaatgtcccatcaatcacgcgcaagcgccgccttctgccgctgccgccgctaccagaaaatgtcctgttgatcactccgcgttttcgtctggcatggtggccccaaaggaggagactcctcttcctaggaaatgtccagttgaccacaccatgttctcttcgggaatgattcctcccagagaggacacttcgtcccagaagaggtgtcccgttgaccacaccatgtattccgcaggaatgatgccgcccaaggacgagacaccttccccattttccactaaagctatgatagaccataacaagcatacaatgaatccgcctcagtcaaaatgtcctgtggaccatagaaactatatgaaggattatccctctgacatggcaaattcttcttcgaacccggcaagtcgttgccccattgaccattcaagcatgaaaaatacagcggccttaccagcttcaacgcacaataccatcccacaccaccaaccacagtccggatctcatgctcgttcgcatcccgcacaaagcaggaaacatgattcctacatgacagaatctgaagtcctcgcaacactttgtgagatgttgccaccaaagcgcgtcatcgcattattcatcgagaaattcttcaaacatttataccctgccattccaatcttagatgaacagaatttcaaaaatcacgtgaatcaaatgctttcgttgtcttcgatgaatcccacagttaacaactttggtatgagcatgccatcttcatctacactagagaaccaacccataacacaaatcaatcttccaaaactttccgattcttgtaacttaggtattctgataataatcttgagattgacatggctatccataccttctaattcctgcgaagtcgacctgggagaagaaagtggctcatttttagtgcccaacgaatctagcaatatgtctgcatctgcattgacctcgatggctaaagaagaatcacttctgctaaagcatgagacaccggtcgaggcactggagctatgtcaaaaatacttgattaaattcgatgaactttctagtatttccaataacaacgttaatttaaccacggtgcagtttgccattttttacaacttctatatgaaaagtgcctctaatgatttgactaccttgacaaataccaacaacactggcatggccaatcctggtcacgattccgagtctcaccagatcctattgtccaatattactcaaatggcctttagttgtgggttacacagagaccctgataattttcctcaattaaacgctaccattccagcaaccagccaggacgtgtctaacaacgggagcaaaaaggcaaaccctagcaccaatccaactttgaataacaacatgtctgctgccactaccaacagcagtagcagatctggcagtgctgattcaagaagtggttctaaccctgtgaacaagaaggaaaatcaggttagtatcgaaagatttaaacacacttggaggaaaatttggtattacattgttagcatggatgttaaccaatctctttccctggggagccctcgactactaagaaatctgagggatttcagcgatacaaagctaccaagtgcgtcaaggattgattatgttcgcgatatcaaagagttaatcattgtgaagaattttactctttttttccaaattgatttgtgtattattgctgtattaaatcacattttgaatgtttctttagcaagaagcgtgagaaaatttgaactggattcattgattaatttattgaaaaatctgacctatggtactgagaatgtcaatgatgtagtgagctccttgatcaacaaagggttattaccaacttcggaaggtggttctgtagattcaaataatgatgaaatttacggtctaccgaaactacccgatattctaaaccatggtcaacataaccaaaacttgtatgctgatggaagaaatacttctagtagtgatatagataagaaattggaccttcctcacgaatctacaacgagagctctattcttttccaagcatatgacaattagaatgttgctgtacttattgaactacattttgtttactcattatgaaccaatgggcagtgaagatcctggtactaatatcctagctaaggagtacgctcaagaggcattaaattttgccatggatggctacagaaactgcatgattttcttcaacaatatcagaaacaccaattcactattcgattacatgaatgttatcttgtcttacccttgtttggacattggacatcgttctttacaatttatcgtttgtttgatcctgagagctaaatgtggcccattgactggtatgcgtgaatcatcgatcattactaatggtacatcaagtggatttaatagttcggtagaagatgaggacgtcaaagttaaacaagaatcttctgatgaattgaaaaaagacgatttcatgaaagatgtaaatttggattcaggcgattcattagcagagattctaatgtcaagaatgctgctatttcaaaaactaacaaaacaactatcaaagaagtacaactacgctattcgtatgaacaaatccactggattctttgtctctttactagatacaccttcaaagaaatcagactcgaaatcgggtggtagttcattcatgttgggtaattggaaacatccaaaggtttcaaacatgagcggatttcttgctggtgacaaagaccaattacagaaatgccccgtgtaccaagatgcgctggggtttgttagtccaaccggtgctaatgaaggttctgctccgatgcaaggcatgtccttacagggctctactgctaggatgggagggacccagttgccaccaattagatcatacaaacctatcacgtacacaagtagtaatctacgtcgtatgaatgaaacgggtgaggcagaagctaagagaagaagatttaatgatggctatattgataataatagtaacaacgatatacctagaggaatcagcccaaaaccttcaaatgggctatcatcggtgcagccactattatcgtcattttccatgaaccagctaaacgggggtaccattccaacggttccatcgttaaccaacattacttcacaaatgggagctttaccatctttagataggatcaccactaatcaaataaatttgccagacccatctagagatgaagcatttgacaactccatcaagcaaatgacgcctatgacaagtgcattcatgaatgctaatactacaattccaagttcaactttaaacgggaatatgaacatgaatggagctggaactgcgaatacagatacaagtgccaacggcagtgctttatcgacactgacaagcccacaaggctcagacttagcatccaattctgctacacagtataaacctgacttagaagactttttgatgcaaaattctaactttaatgggctaatgataaatccttccagtctggtagaagttgttggtggatacaacgatcctaataaccttggaagaaatgacgcggttgattttctacccgttgataatgttgaaattgatggtgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattgcagattcccttttatggattcctaaatcctcgaggagaacttctagtatattctgtatacctaatattatagcctttatcaacaatggaatcccaacaattatctcaacacccacacatttctcatggtagcgcctgtgcttcggttacttctaaggaagtccacacaaatcaagatccgttagacgtttcagcttccaaaacagaagaatgtgagaaggcttccactaaggctaactctcaacagacaacaacacctgcttcatcagctgttccagagaacccccatcatgcctctcctcaacctgcttcagtaccacctccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtcagatcactgatgatgaactcaccttcttgtataacacttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgccaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatctgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcaccttaggccaggaacttactgaatctacggtaaatcacactaatcattctgatgatgaactccctggacacctccttctcgattcaggagcatcacgaacccttataagatctgctcaccacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacggtctgacggcactgtacttgcacctatcgtaaaatatggagacttttactgggtatctaaaaagtacttgcttccatcaaatatctccgtacccaccatcaataatgtccatacaagtgaaagtacacgcaaatatccttatcctttcattcatcgaatgcttgcgcatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaatagtgcaccatcctatttcatctcatttactgatgagacaacaaaattccgttgggtttatccattacacgaccgtcgcgaggactctatcctcgatgtttttactacgatactagcttttattaaaaaccagtttcaggccagtgtcttagttatacaaatggaccgtggttctgagtatactaacagaactctccataaattccttgaaaaaaaaatggtataactccatgctatacaaccacagcggattcccgagcacatggagtcgctgaacggctaaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccgtccttaaagaagacagtagatacaactaactatgttattcttcagggcaaggaatccagattagatcaattcaattacgacgcactcactttcgatgaagacttaaaccgtttaactgcttcatatcattcgttcattgcgtcaaatgagatccaagaatccaatgatcttaacatagaatctgaccatgacttccaatccgacattgaactacatcctgagcaaccgagaaatgtcctttcaaaagctgtgagtccaaccgattccacacctccgtcaactcatactgaagattcgaaacgtgtttctaaaaccaatattcgcgcacccagagaagttgaccccaacatatctgaatctaatattcttccatcaaagaagagatctagcaccccccaaatttccaatatcgagagtaccggttcgggtggtatgcataaattaaatgttcctttacttgctcccatgtcccaatctaacacacatgagtcgtcgcacgccagtaaatctaaagatttcagacactcagactcgtacagtgaaaatgagactaatcatacaaacgtaccaatatccagtacgggtggtaccaacaacaaaactgttccgcagataagtgaccaagagactgagaaaaggattatacaccgttcaccttcaatcgatgcttctccaccggaaaataattcatcgcacaatattgttcctatcaaaacgccaactactgtttctgaacagaataccgaggaatctatcatcgctgatctcccactccctgatctacctccagaatctcctaccgaattccctgacccatttaaagaactcccaccgataaattctcgtcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacggacaaccttacgatacgatgaggcaatcacctataataaagatattaaagaaaaagaaaaatatatcgaggcataccacaaagaagtcaatcaactgttgaagatgaaaacttgggacactgacgaatattatgacagaaaagaaatagaccctaaaagagtaataaactcaatgtttatcttcaacaagaaacgtgacggtactcataaagctagatttgttgcaagaggtgatattcagcatcctgacacttacgactcaggcatgcaatccaataccgtacatcactatgcattaatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgatacaacaatgtggtatggaagaagttcgtggatggtcatgcgtatttaaaaacagtcaagtgacaatttgtttattcgtagatgatatggtattgtttagcaaaaatctaaattcaaacaaaagaattatagagaagcttaagatgcaatacgacaccaagattataaatctaggcgaaagtgatgaggaaattcaatatgacatacttggcttagaaatcaaatatcaaagaggtaaatacatgaaattaggtatggaaaactcattaactgagaaaatacccaaattaaacgtacctttgaatccaaaaggaagaaaacttagcgctccaggtcaaccaggtctttatatagaccaggatgaactagaaatagatgaagatgaatacaaagagaaggtacatgaaatgcaaaagttgattggtctagcttcatatgttggatataaatttagatttgacttactatactacatcaacacacttgctcaacatatactattcccctctaggcaagttttagacatgacatatgagttaatacaattcatgtgggacactagagataaacaattaatatggcacaaaaacaaacctaccaagccagataataaactagtcgcaataagcgatgcttcatatggtaaccaaccatattacaagtcacaaattggtaacattttcctactcaacggaaaagtgattggaggaaagtcgacaaaggcttcgttaacatgcacttcaactacagaagcagaaatacacgcagtcagtgaagctataccgctattgaataacctcagtcaccttgtgcaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacatttaaactattaacaaacaaatggattcattagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattgcagattcccttttatggattcctaaatcctcgaggagaacttctagtatattctgtatacctaatattatagcctttatcaacaatggaatcccaacaattatctaattacccacaaatttctcagatggactagtagatttttatagagcagattttccaatatgggagtgatgcggtttgtttatgtataaatagaaagggacatatttttattattattattttagttatttagcatgtatgttattttatcggtgaattgtaatgatcgaataataattggaggttgaagaagttgcaaaaaatatttacttggacgagtccggaatcgaaccggagacctctcccatgctaagggagcgcgctaccgactacgccacacgcccaattttcttgttgtctgttgtgtttcagaatggggtacgtcagtatgataataatcatcctaaacgttcttaaattacatatgaaacaaccttatagcaaaacgaacagaatgagcaacatgagatgaaactccgcctccttaactgaactttccaaacgtataaacgcctgaaaaattagtttagatccgagattccgcgcttccaccatcaagtatgatccatattttatataatatataagataagtaacattccgtaagctgataatcccttttggcaactcgttacttcccaaagactgtttatattaggattgtcaagggaccccggtattgctcgagcccgtaatacaacagttgtctttcactgctctctatgttttgagacctccagttcaccacatatattcgatctttttcttactgttgaagcaagaatctgttggaatgaaggcctagtattgtctattgactaatattcatcttactagtatattatcatatacagtgtaagaagatggcataaagattgagaaccagtcatcagactaatgaaagctgaaatgcaaggactgataatgtaatgggataatgaaatatataaaacggaaggagaaataaccgtgatattattatgtagatttaccgactccacttggaggatttctctattctcgagggaaacttggtatattcgtacacctaatattatagctcttgataacaatgaaatttcaacaattattcactcaaccctcaagtgtatatcgccaagatcctaatcacccctctctggtggccttccctcattgtttttacacagaacaagaatccataaaatcaagatattgggaacaattcattgtcttaggaacaagtttttataatttagtttcattagcctattgtaacttcttgttttttttttttattttggctggcaaaacaagaagtataaagaagttaccactgctataacgtatatcttaaatcaagtgggcaattcttcgaataaacttagaggcgctgaagaaagaaccgctcaattagttcgatcatacaaaatacagatattgcgctgtgtattatcattacggaaagtgtgatataaacaatgctgtgttgtattcggtcttttttttccgcctggagattgtcgtttttgtttttttttctcgtgtagctgcagttatcatcgttttgcatgtctgttctgtcggtgaagccgatctcatggcacttcgctttgataccgtaaagaatcttcttcattaatacggcactgcaaggcgatatctatctctggggttaggactgataaataggtacttatcagttatcactagagacgaactgtttacgttttgaagctcgacagcaggggttcttaacgggcgtcggcctagacctcaccttgcgagaaatttttagttcatatccaggggatggtgaatggttggatctgacgaagccacggtaagggcaaggctttgcgcatgcactggccactatgcataccatatataaatagataatcaagcgtatagaaaacgacatgctaagttattttactcagtgttaggtctcttagtatttgcgtctgaaaagatcttagctctgtctttgactctatcacttatttttaagaggttctctattcgtcagtgatagaaatagcattttgacccgcacgacattggttaataagagtacttttccacgtgtttcgattgcctttatttttagcatacttgaaaataatattatcgtgagatttaggtaaaatataccacatatcaagagaaagagaagtaagaatggttgacgctaggggtagtacgccatgtttaattggtgattctataagaaacgttaatgatggaaatagtctggatttccagtatactaatcagtttaatgaggaaagtgaggcttcgaggttactaacgccacaaacgagttccaatcacgccctaagcaagatgcagaaggatgatgatattcgagatagatcttatacatctgtagcggaattgaatcgtgagggtgctttgctgaccgacgaagttgatttggagaatgttgatgcttcgaaagttcgcagcaatagagacgacctagaggcagaggagaaaaggaaaaaactactcttgttgaaaaaaaagcaaagaaataaatccatcaactcggaaagtttttcctctccttctctgcgtgcttccaaatctaattcactgattacatcaactgatcctgtcgaagatcacatcagtaagtactcttcatcaggcacccctgaaaatattacaggtgaggcagacgacgaagacgaagacataatcagaaactcttacgggcaaatgatcaaaaacaattccaacaggccacatttggcgaagggtgaatcgtaccagtccgcagaacaggaaatagatcatacggcgcctgaaaaatcagagaaaagacaagaaagaagcggtagatcctttgatagacaaaaatcttcggctgagtttctaagatccttatcgaggtcaataagtcgtggacccacaaagaacaaaacggtttcgccctctaagggagaagactctagaatgtatagtaccagcaactactctatatcattagttgatttggagaacggacccaaaattatcccggaaactttagaagaagagcaggaggacgccgaaaaggagggtgttttgatggaagacgagggtaatgaagaatacaccaaagatttggaagaagcagctaacaaagctcaaccacagtagaatggaatattgaaactggagtgacttctgatgaagtttccaattatttatatgtatacattatttatttgtctatcattaaaatttctgtcaagtaatggctttttatgtttatttcatggattacgaaatttgctggctttttagagtgaccgatgagttgcatgtacatatgtgcgaaataaaacaatacggtagtaaaacatgaatacttcgagaagtaaattcaagattgcaggcgtagcacaagaatgtccttccgcctgctagtgtgttgagcaaagcacgccatcactaatggaacccttacaaaatctcgcatggagcagcaaaccttaaatccattttctatcattcgttcctgaggacccggatatcgttttagagacaaaaatagatactacaagaggaatagggatatctgcacatggggcctcgagcatggctcattttcgattttccggcacgatgctgacttagtactatcatgccaggcaggacaggccttatggggttcttgcagcttaccaattctgacactggactgcccctggattagcgaccccgcgaccccgcgaccagactccctgaaaatggtaattggtgatgatatatgtgactgagttcagcctgggcatacaatgtttaacccttttggacatggaattaggccagcaaagggagcagctttccccgaaagcgtagtttttctccaggaacgcaattcacccctttctttcttatgcaagctcctcgtacatatataaaaatatatgagtatatatagtgcttctacagcataatcaatttaaggttccttgcctttccttaaatatgttagctatctctaaagcatcactgagaagtggtagtttttttgataactgtgattgaagttttgactacctcagagaaaaattttgaatgtcccgtgacctacaaaaccatttgttattcgagactgcgactgaggttgctaatagggttggtggtatttactccgtgctaaaatcgaaggctcccattacggttgcccagtataaagaccattaccacttgatagggcccttaaataaagccacttatcaaaatgaagttgatatactagattggaagaagcctgaagccttttccgatgaaatgaggccagtgcagcatgccctgcaaacaatggaatctagaggagttcattttgtttatgggaggtggctgattgaaggtgctccaaaagtaatactttttgacttggattctgtgagaggttattcgaatgaatggaagggtgatttatggtcattagtaggaattccctctcctgagaatgatttcgagacgaatgatgctatcctattggggtatacagtcgcttggtttctaggcgaagtggctcatctcgattcacaacacgcaattgttgcgcactttcacgaatggttggccggtgttgcgttaccattatgccgtaaaaggcgtatcgatgtagttaccattttcaccactcatgctactttattgggacggtatttatgcgcctccggcagtttcgatttttacaattgtttagaatctgttgatgttgatcacgaagctggcagatttggcatataccatcgttattgtatagagagagcggcggctcattctgcagacgtgttcactacggtgtcacaaataactgcttttgaagcggaacatcttttgaaaagaaaaccagatgggattttgcctaatggactgaacgtcatcaaatttcaagcatttcatgagttccaaaatttgcatgctttgaaaaaagaaaaaatcaatgactttgtaagaggccattttcatggttgcttcgatttcgatctagacaacaccttgtacttttttattgctggtagatatgagtataaaaataagggtgctgacatgtttattgaggctctagcgcgtttgaactacagattaaaagtatccggatccaaaaaaactgtggtagcgtttattgtcatgcccgccaaaaataattccttcactgttgaagcattgaagggccaggctgaggtgagggcgttagaaaatactgtacatgaagtgactacttcaattggtaaaagaatattcgatcatgctatcaggtacccccacaatggactgacgacggaattaccaaccgatttgggtgaattactaaagagttcggataaagttatgttaaagagacgtattttggctttgagaaggccggagggacagttacccccaatagttacacacaatatggtcgatgacgctaatgacctgattttaaataaaatcagacaagttcaattgttcaatagcccaagtgatcgtgttaaaatgatcttccatccagaatttttgaacgctaataatccgatccttggtttagattatgatgagttcgttcgtggttgccatttgggtgttttcccttcatactacgagccttggggttacacacctgcagaatgtacagtaatgggtgttccctccatcacgacaaatgtctctggtttcggtgcctatatggaagacttgatcgaaaccaaccaagcgaaagattacggtatttatattgtggatcgtcgtttcaaggcacctgatgaatctgtggaacaattagttgactacatggaagaatttgtaaaaaagacaagaaggcaaagaattaatcaaagaaatagaactgaaagactctccgacttactggactggaagagaatgggtctcgaatacgtcaaggcaaggcagttagcattaagaagaggctatcctgatcagttcagagagctcgttggtgaagaactaaatgattccaacatggatgctttagcaggcggaaagaaattgaaagttgcaagaccgcttagtgtacctggctcaccaagagatttgagatcaaacagcacagtctacatgacccctggtgatttgggtactctgcaggaggttaataacgcggacgattatttttcattgggagtgaatcctgcagctgacgatgacgacgatggcccatatgctgatgacagttaaatcctatgaggatataaacagtattaaaaaaatcttaccataaagacatacgacatttcgaggcgtttttgcttttcttttaactttcgttggcacaaactgaaatatatgtggaatgccctctgaaaatatactaggagttttgagcgatccaaacattttcttttctttttttctcttccttctagcgaagtcctcttgcgttagctgtaaacaaaataagtcaatttcattaatgaaaagtgacattatggcggtagctctctctatctttgttcagttatcaacatatagtcatacttaaagatataatagctcatagtcatatatagttctttatacttgaaaaagtgattcctaaaaatctcaacttttttcacattgtatttacaagataataaaattattaccatatttaaacgaaagataaattttgaattaaggcggtcgttacatcatacctggcattcctggcataccacctggcataccaccagcgccagcagctgctggtggttctggggcatcaacaatagcaacttcggtagtagctaatagtgaggcaacaccagaagcatcaactaaaccggatctaaccactttaaatggatcgatgataccagtggctaacatgtcggtgtattctgacttagaggcatcgtaacccttggcaaaatcatcaccatattcatcaatcaatttgccgatgataactgaaccttcttcaccagcgttttcaatgatctgcttggctggtcttgtaatggcctttcttatgatatcgacacccaatttttgatcgaaattgtcgacaacaacttcatccaaaactctagatgccttcactaaggcagtaccaccacctggcaagataccttcctcaactgcagctctggtagcgttcaaagcatcatcgtaacggtccttcttttcaccaacttcaacttcagatgcaccaccgaccctgatgacagcaacacccccggacaatttggccaaacgctcttgcagtttctccttctcatatgaatttgtggtggtaatgtcgatggagcctttgatttgttcaattctctcttgaatagcttcctttggaccactaccgttcaggataacggtgtcttccttagtaacggtaatagagtcacaagaacccaagttttctatggtacattgttctggtttcaaatccaactcctcagtaaaaacagtaccgcccgtcaagactgcaatatcaccaattgtattctttctattatcaccgaaaccaggcgccttcacagcacaaaccttaacttgacccctcaacttgttcaaaatacaagccgcaagagcttcaccgtcaacatcttcagcaatgatcaacaaaggtcttctgctttgattggaaatttccaaagctggcaagatatcttgaatggaagaaattttcttttcactcaacaatagcaatggcttttcaaattccaccttgctcgactttggatcagtgatgaagtatggagaaataaaaccacgatcaaacctcataccttcagtaacctcaagttcatcttccaatgttctaccttctctgatagtgatgacaccttcttttccaaccttttccatagctgaagctagtaacttaccaacatgagagtccccattggcagaaatggttgctacttgagcaatttcctcagatgtggtaatttctttcttgttggcgctcaaaaattcaatcactttttcaactgcaacttgagaaccccttctcaaatccatagggttacaaccagcggcgacatttttgacggattctgtgaagatggctctacctaagacagtagcagaagtagtaccgtcaccagcagcctcattggttttggaggcaacttcttgtagtaacttggcacccatattttcaaacttgtccttcaacacaatagatttggcaactgtaacaccatccttagtaatctttggaggaccgaaaggctgttcgattaaaacgtttctaccctttggacccaaagtagcagcaaccgcttcagctaaagtttcgacacccttaagaagggaggctcttccttctacaccgaatttcaattctttatgagaggagtaagcacgacgcaataaaggccttaaagtagcgcgactacgaacaacggatgatctcaacattttgaaaacttttttgcttatgatgttttctcgtgggaattttcttatattattcaaggaagtgcatgaagacgcaaccacgaccttacataatgaatgtaaaacttagtctccttcaatatatatacatgaatgtccgtctggattctgctccgggcaaaacgaagcaaaattaaagtcaccctccccatttggttttctggaaaattccacgaggtccgtatatgatgacatatacagatgggcggctataaagtaagtttccagaggtaataccaggcaataaacagcttcaattgctcgtaacaccattgtatacctacaaaaacagtggaatagggatgagacataactggctggaatttcaactgtacttctttgcacaactagtcttggcgttctacttgatcattgcgcgaatggatgcactcgcaataattcccaatagtataacaggaggaacatttggatgcattaggtatattattcatcttctttatcatcaaaattttctcttcctttatgttactatgttgctttcttttaatctatgtttttttccctttcagttgccaccgcttttctgcaagattcatagttagatttgcaaatcaaggtgttttcgggccttgttaaagccttcgcaggcgaagaagaaagggaacgtaagctgcgtgagccgaatctatttatacaaaaacaatcaaaaaagtataactacagcataaactgttgtatatacgtgttgcaaaataggaaagaaaagaagagtaaaaggactcttgatattatctcgaaaaaaccacaaatagtgtaagatttaaacagtaagccaaaagagatgactttgaaaccttcaaagagacgtaagggcaggtctcgccattccaggaagaagcaaataacgtcagcgatactgactgaggaaggaataatgatcaaggcaaaaccatcaagtccttacacatacgcaaatagaatggcagataaacgaagtcgcagcagcattgacaacatcagtagaactagctttcaaagcaacatcagtagaactagctttcaaagcaacagtgataacaacagtatatttgaaacggcttcactaattagctgtgttacctgtttaagcgatactgatacaatagacagatcggaaacatcgacaacggatacaagtaaagatgatctttctgctaatccaaaacttcattatccttcggtgaatggtcaattgccagcaaacaccgttatcccctatggacgaattctggatgccagatacattgaaaaggaacctctgcattattatgatgccaattcatcacccagttcacctttaagcagctcaatgagtaacattagtgaaaagtgtgatcttgatgaattagagtcttcccaaaaaaaagaaaggaagggcaactcgctatcgcgaggaagtaacagtagtagtagcctcctgacttccagatctccttttacgaaactagtagaggttatatttgctaggccaagacggcatgacgttgtacccaaaagggtttcattgtatattgactataaaccccattcatcttctcacttaaaagaagaagatgacttggttgaggagattttaaagagaagctacaaaaacactagaaggaacaaatccatatttgtgatcattaatccgtttggtggtaaaggtaaggcgaaaaaactgtttatgacaaaggcaaagccgttactattagcaagtcggtgttccatagaagtggtttatacaaaataccctggtcatgctatagagatcgcgcgggaaatggatattgacaaatatgacactattgcttgcgcttcgggagatggcattcctcatgaggtgatcaatgggttataccaaaggcctgatcatgtcaaagcattcaacaatatcgccattacagaaattccatgcggatcaggtaacgcaatgagcgtatcctgccactggacaaacaatccttcgtactcaactttatgcttaattaaatcgatagagactagaattgatttgatgtgttgttcgcagccttcttatgcaagagagcacccaaagttatcatttttaagtcaaacatatggtctcattgcagaaactgacataaacactgaatttattagatggatgggacctgcaaggtttgaattgggtgtagccttcaatatcatacaaaaaaaaaaatatccttgtgagatatatgtaaagtatgctgccaaatcaaaaaacgagttaaaaaatcattacctggaacacaaaaataaagggtcgttagaattccagcatattactatgaacaaagataacgaggattgtgataattacaattacgaaaatgaatacgaaaccgaaaacgaagatgaagatgaagatgcggatgcggatgacgaagactcccacttgatatctcgtgatctggcagattctagtgctgatcaaattaaagaggaagatttcaaaataaaatatccattagatgaaggtatccctagtgactgggaaagattggatcctaatatttcgaacaacctaggtatcttctatacgggtaaaatgccatatgtggctgctgacactaaattctttccggcagcgcttccttcagatggtacaatggatatggttatcaccgatgcaagaacctcgttgacgaggatggcaccaatcctgctgggactagataagggttcccatgttttacaaccggaagtcttacactctaaaattttggcatacaagataataccaaagctagggaacggcttgttctctgtcgatggcgagaaatttcctctagagccccttcaagtcgaaattatgccacgcttatgcaagacgttactgagaaatggccgttatgtggacacagatttcgattctatgtgacactttacttaatcttttccttcgtactgaacaattaatcaaaaactagaatatgtcatttctatttcttctatattttttttacgttgttgttgtttttgttgttgtttgataactttatacactccatacttctttataaaaagttttaataccattctttaatacaaccatgtttagtgagtactagctcctacacatcagatcgtcaagtacattatgattatgattattattaatattatcagtacaattattatgtgctggtagttcactaaaaaatatgacgcacacaaagagttctccttatgccctatagaactgaaatattaggtgctaacactgacaagcgctttgttcctgctcctctgctgtagaaatatcaatgactcccggtttattttggtttgcactatttgcattttcgctatccaaaggagttgactcgctgttttgaaattcaggcagcgatttggcaatctttttgaataaagctttgacattatagcctgcctttgtggacgtttccataaagattttagcacccaatagttttgcttttttctctccctcttcggttgagatttgcctttcatctgataaatcacttttgttaccaacaatgcacaatataacattttcgtcacctctttcatttttaacgtcttctatccatttatcaatatattcaaatgattttctcttcgtaatgtcgtaaacgataatagcaactctcgaatctctgatatatgaaggtattaatgatctaaatctttcctgacctgctgtatcccataactgtaatctaattgtcttatcatccaaatacatggtcttggaaagaaaatctataccaatcgtggcttggtaatgatcatcgaacgtatcatacataaatctagtgatcagcgatgtttttccaacaccctgttctcccaaaaaaacaattttgtactttgtcaatgatttcccggatctgctcattgttaatctcttctttgtttatcttttactgttcagaatcaacagcttcaaacacttcttttcacacaaccttaagtgcccaattgtgatattcttacatcatacatagtaacaatctatatatgggcaatattttcctccactaattgagctgtgctgaaggctttattacccggaaattattcggccatttttcactagaagttaataccagcactaacgaatagaagcaccctattctactcaagatgcccggttcatgaatagggagaagtatttttcttattttccttagccatctataaatatttatccttatgcctgtcaccacaatagaaaagggtccattatatatcagttgttttcgtacctctagagagacacgcaaggggctttatttaggaaacctccaaatttgctagatgtaaccattatacatagtaattacgattgtaaaacatcggaaagaacgatatatcttgcaaatagcttttctttggtaatatatgtatttacttaaaaaacgagaactagaaaatactgagtaaatttttattagacgttgttaaaggccttttatttcttaccagattttttgataccaccacccactaaaggtttaccacttttcatattagccatcaaagctttcttagcagcagcatcggccttttgcttctctttgaaggcaatgtcttcaggatctaagtcctgttgttgcttcttcttttgctttagaggcttcatcttaccaccttggcgactagacatgattgcttagggtttttcagttattcttctggttttgcaacttactgtgcgtggaagagcaatcaattacaggattttaaacatgaaattttttattttcctcgttcattttcgtcgcgggaaacttccagaagtatagatttactacaatttttatctcaggacagaaagaataaaccaaaaaagccaagacaagccaagccaagccgaggcgactggaggagcttttcatcacattcaatgacaaatcacaacaggtttccctgttagaaaaggcatgtgcactcacaattcatattttcatacagaagatatacattggatttctggagatatcaggtaaggttcgacaaaaacaatggcgtttgccaaccctttatgatgggtgatcttgtatccgcttaattgtgtgatctaaaaaggcaaagtaacgtattattggctggtttatataatttgaatatgactactttttcaacgttaaaaacgataaatacttgctcaaagggttcagcggctaaataaactacgatttcgcagcaggatcagatggattcaatcacatcattcgcaaaacattcacatcattcgtgaagcattaaaggtaataagaaaaatagaacaaagattttttaatcagtgaggaccacaaagggacagcaaatacggtgataagaatggaaggtttgaagaaaaagatttttggtgtttgcctgaaaaatgacttagcacagactaggaatgaaacgaaaggaatccactatgggttaatgactttggaaacttctaaacaactgcaggaatttctccatttgctagtaataaagagagaagtaattcaaaattttgagttgttatttcacatcataaatgttgccgttaaaatcaccgattcaaatcttccaagtgatgatatctggcatttcattttaaaattaagattttcttctgagattaatatagacgaagactccaaagttttaaattatttacttgagactggcatcgcaatggaaaatccagtcagttggaaatgcttggccgttattagcagcatcctcagcagtgtccctcaatccaaaaagattataactaacctgatcgagacagaacatgccaaaaagattggtcagttgtttgataatattcaagatttgcaacaaggaaattttctggtggaaattctctctaactgttttaaaaaaagtgcttcaaattccaagaaagtggaaaaaatacctcagttatggcaaagcaggtctaagaacaagtttttctttgaaaatgaattttacccttttagcagcaaaaatgggagcttacaaacctgccaattcctgtgcaataatttcatgtcaactttatcctttacgggtattctaaggcaggtttcttatagcggatctgaaacattaaaaaatctccgtatatttaagaaaaaagacgatgaaaattcttacttcattcagtgcatttacaacaaaatctatctttggttagacgaaaaagcccctttggaatttgaaagaaagaaaatcaggattaccaaaaacttaaaaaataaaattcaaattaaattgaggcaacctttccatgaatgtgtgagaactaccgctgataaaacagcactcttatttaacaaaacgaaggggtttcagctggaatttgaagacgagaaattaggtgaaactttttttcacaatgtcaacaatatacctaagattagtgaagtacaaaactttttagttttagactatattgaagaagaaccagagaatgaaggtgaagaagaagagcaaatcggaagggcagatgagcagaaagaggatgaagaggaagaatctctcgatgaattatccactcccatggtatatccaataaaatcatctattccccataatcataacgaaaaggttcagttagtcactcccgaccgttctgtttccataagatctgatgaatgggatttaaagtcaaatactgaagacgaagaaggtaatgttcttgcagacctgaaaataagcagcactaaggaaacaaaaaggcaaacagactacgtccatattgattcagaagaccagtcaccagtagtatccgctcagatgagaaaaatgagaagagaatctacgaaaacactagaaatattgagacaagagtttaaagataaggatgtacaaaacaaagaagaccagtccgaacaaatacaaaacccgtttgtaaatacatcctcgttagttgtaggtaaatcctgtcttgttaatcctaaggaaaagcctaatattgatcaaacggtagtcggaataaccgaattaaagtcaaattcttccattaagaaaagggatatcaacattctcgacactatatttgggcaacctccgtccaagaagcaaaaacaattccacaaaaaggagaaaaagaagcagcagaaaaagttgacaaactttaagcccattatcgatgtcccttcccaagataaacgaaaccttaggtcaaacgctccgacaaaacccaaatccataaaagtaagtaagctgcgtaccgataagaaagttacaggggaaaaatcaagcccagaaacagcggcagagaaagttgatgatcaaactgtgcgtagcaacgatgaacaagcaatgagcagagcaactaaagaaaagtgctttccagatgtcaatgaaggcaaagaaattactaaggatgacgctaaagtatctctcgagtccaaaaaaaacaacgaaacttttgttgattcaagtgtagtagaaaaacatacccccccagacaaagactgtaacaattgtaacattacagatattttggaatctaccactgttatcgacttgcagtcaccccatggattatctgctcctggtcagaatactttcacaaacaaacttcaagaacaaatttatagttcaataaatcatttttctaacgaattggtaagaaaaatttcgataataaaccaagagttaaataagaaaatcttaaaagagttgtccgaaaaataccaaaaactattctccgaattacaagataatttccagaatgataccaatgagatgcttaaattcatgggcgagatcaaagacatgatgaatctcccggaagatcagctcgttcatgctattaggacaagaaaatttgataacaacaagagataaatagtatacatatacgcaattctttttagatttaagatggctaataaaagtaatataggcaagcttattcatgttcgaatcttttttttctcgcagagctagtactctggcaatcgacacttatttcgtacaaaatgatcacgcaacttttgacaattttttttttttcatctgttttccaggaaacttggatcttttttgctccatagcacttttggtcttcctcaattaaatatttctagatcccggtagttcttcttctttgatcattaataaaaaataagcaaagcataaaagagcagcaaaaatggattctaagaccccagtcaccttagctaaagtcatcaaagttttaggccgtaccggttctcgtggtggtgttacccaagttcgtgttgagttcttggaagacacttcccgtaccattgtcagaaatgtcaagggtccagttagagaaaacgacattttggtcttgatggaatctgaacgtgaagctcgtcgtttgcgttaaaggtatattaaaaaatttactattggtgctcttcgagcattgttttttttctatatttacaaacaacagcttattttttaatatttctcaaaaaatgaagttcgaatgattattttaattgagtttagtgatgaaatcgattgcaaataatataaacgttggtaagctcatctaaacaatcgaaaggagggatagaagacagtaggtgtttgtgctttggtcggtttttccattcggtgaattcatacatctcctttattaattttaatggattctttacaagggattttcggttgccaaaaacagagaacaaatgcgtagaaatactcaatgatgtcaatttttcaaaaaatgaattaaatgattgaagtcacttaatttttgtggttttttggaggtgggttgagtgtacaactcactataattgatgagatattcgacgaacttgttacttttttggattccagaatgtttactgaattttaagaattaattaatttgaggctaacctgtatggcatggaataacgaatcgacaagaagtctcttactgtaactttctttttttttggtgcatctatcgttaaatacaatttaaatattacattcatgtacttactcaatataataatctgattacttcatacaatagaagagaaagaaacagtctctaaaactgctgtcataacgcgtggtgttgtggttttgcttaatttttttagacccatgcaccagatattgatccaatttttttttgtggctcttttgccaatcgctcttattaagtaagtttacatccgcggttatgttttgcgtctaaatttcatttacagtgatggcgagcttgcgcggctattttttatgcagtttatcatttagacactcagaagctgcagtgatgtaagatactgcttgaaactaccgttagattaataataaacaattagaactgtcctaatacatataaacttatatgctccctatcaatggcataacgttaccattcaataaattaacattatcaatgcgtcaacaaaggaatagaactatttgaaaggtccaaccttaatttttgacgtttaattgacttgccttagttttttattctcacctttccaaattttctttttttctgtgggtattcttcgaccaaagaagaacttgattttgttttttctggtgtagcctcagattcagaaaaattctccaggcgaagttgcgaactggtactactttctctagattttggcttgaaatctgtctttggtttaattttaccgcggctatttggtcgagcctcatttgtagggtctgcttgcaattcaaaatcatcattataaaaatgattcaccgcaggaaatctgacgcgctcttttttgttaagttctccagattcttcaaaccgcgacacatcttgaaatttgtttcttaaagataataatgtttttaatgagtccgccagaaattcttgatgctggaattttcctttatgtagtaattttttgattatgtcatcgtctgtgcattgctgcagagattcataattcttagaattttcaggagcccattgactgataactttactcccaccgtctaaatcacgaagagaaattaaaagaaaatctaagcatttttgcttttcattcaaaatatcccgttgtacatagtggtattgggtggaaaggtttaccaattttaataaaagcatgcataaactttgcaaaatcatatagaacatatccttagtaacatgtgaaggtacgctatttatggaaactgtaatatccgcagatacatcgaaactaaaaaccaaatttgaatctaccaatccaatttggttaatttcttgaggagcttgtagaatgtccattagttttagtttaattagatttaatgatatactatccgtaaaaccttggctctggcattgctgtgataattgagtttgtgaaagtttgaaaacgtagggaactaagcgctccaaggaaactaaaacaatcattacaattgtggttggagatgacatcggtagaaataataggagacaatttccctcaccattaatttttttaacacaccattctgcatcacttagctgctgccctttcaactcagaatccatcacacatgtgtaagattaacctcctatctggccgttgttatggttattctccatagggtttccacttatatgacactattttgtgtttgcccgctgccaacactatcatccctttttgggacgaaaaaatccatgtaaaaaaatacatcaatcataaatacatttataaatcgaaatgatattgtttataaaatttctttttgtcaatggaccaaaggtctttggaaatctctttgaacgttttccaaacatcattaataaaatcttcaatcatgagatcactgaagtgctccatattaatgccctttttcagccaaattttttcagtctctattcttgcttgggacgctttatcgaataaaaccctacttacgcgttcaaacgccaaagttgaagttaactgataaaaattggaaactgcttttaacaatcgcttatttctttcattaacagcaaatatgctatcaataatttcgtaaaatcttattattgttcctgaaaatgacagaaatttatcagtcctaacatcgaatcctgtcaaaagttcatcaaagttttcttcttcatatttaatgaattgtatttttttcccagtgtcaaggtcaataaggaaaaggaatgccttctccctgaagattaacctattaaatgctaaactgtacacttgcgatactattcgtattaaaagtggattgattagaataatagacagttttagcccttcagttaacacgttctcctggtcgttgataggctctttaaaatgaaataccattgtattaacacagactgatatggatatcaacaagaactgaaccattctgttcttatctatgattctgctttgttgagcgatgatcatctcaatattgtatatactagcaactatacttagagatcttgataaaatcaatatatcaaagggatcaatatcagagtagtaaactgaatttgtataatgttcgataggtgaaaagttagattgtataaattcaatcaatctcaatgaaaaagtggtcaatttttcgttcatctctctcttgtgaatttcacgagtagtgaatcgggaaacatctaaaaaatcgtgcattagcttaactctcctaaagtcaatactcggtgattggaaattctgcgcagtaaatatacttaagtccaaaagatcatctgaaatagacggaggattacctatatcatatgaggtggatacatcaaggaataaagcccaaaaccaaatacacctcaagttttgtttggtttcctcactttcgttcaaataccatttatcaatatcatttaaacccaaacttatgcacccctggcatagctcgttgattaagtcaacgccttgagtcgcatcccatacaccgtccgtgcaatttatcattacactaatataggacaataagaaaaattgtagtttttccacgaaatttgagctcgatgatgacaaggacgctgcacttaaagtgtgaaggaaatgactcacggaagaagggatatcttggttataatagcccaagcaaagaatttgaagtacaatgccaagattatacttatcttttgcattaccttgcaaatcgaggaggatgactaggttcttgtccgtggtatctctaataaaaagtctgtccaagagggacagaatatcgtcttggttgaagatatgcaatatgccgaacagcggtccagcaaaaaaagatttaatacagctttccatttgaggaaaactaggcaaatctgctacaacatcattttcatttaattgcgatttagtgcattcaggaagtggtttcaagactttccataaattttgaaactcagtttgaaacttattttgttcaaacaaagataaagttttccaggaagtggggccaaacacatacctcgagccattatcacctaaaaccgaagttctcagtgaccgtaatggattttctgaactcctgcaatacaccggtttcgcattattgttatcgttttccttcagtagagtctgcaaattctcaatcttctgaaccaacgctacattgggcacttgctcgaacagttccgtattagacaagggatagttgaactcttctgtgtaaacgcattgcggtagttttctaattacacattgctgacacataggcctggcctgactgcatttcagttttctttttctacaaaatgcacatgacttgatgaccttcctcctcttgcccttcttaccacttgaaacgggctctccggtagtagatttcataggaaaatgggatccatccatcccaacaaactaagtgccgtttgcctctttcttattcgtcccgtaccaaccacgtgttttccacctgtcatgggcttttcaagagtttgtcaacgcggaaaggcgccgcattgcaccttgtcgtgatgtattctaagtacaagtagtaaagaagtaatgaccctgttgttattgctccactgctgaccgctgttaatgcctcttcatgatttctgagtcattgttgtaccctctggcgaataagccactgttggttttgtgtgcatgttggaaaggcgttgcaacggactgtaactccacacacgaaagaacccttaattttcagccgctcgttattttattcagttgatcatttcttgtataaatagatttaagcaaatttaaagttgatgattctatcttcacagctagagctctacgtgaaatttgtgcaatatataggctgtgatttcgaaagttatatattctccgggtagaagtgaaaaggatggttgccgctttaacgtatttgcctactgagcttatccaaaggatatttgagttcactgtggtggaaacagactctcaatattggttgtacaatttagtggctctaattgatttttctgtctcttcgagaggtggtggctctataacggaagacttcttgacaaattacgttaggaagaatttgatggttttagatctgacctgtgaggccacgcaagactcgattttacgagcggagtacgggtttctgaagagattgttgccatacattgacatggacgcacaatatatcagagttgttgatttggaaaccaatgctgacaaggcccagaatttaaaagcagaaaaacttattgttatatttgacgaattctcagatttgaaactcatagaaaccttcttccccttggcgaattccaattcaaacataatcgagttcgtattctgtgttcgcaatataaagagttcgttttattcacctttggaaaaattacatattgcgaacatagtcgcagatattgatattaacacattgtatctggacttcgtggattcaaatatctattcggatcaaaatttctttgggatttttgatcccgatatttttcagctgattaataaaaactatagaaacttcttttctaagactaacgaaaaggggaagaaaagaccccccatttgcaagaaaatctgttttccctttgttgaaacattgaatttggattatatggcccttgattcattctttaattcgatactgcataaactaacaacaaagataaaaacatttgaaaggaacaatgagtttgacgtggataaaaatttaaatttaaactcgacaacgacagtagcagctttaattatcaagtcgatcttgcaacaattcttcaacaattttcatatcagcttccctaatttggttaccttgaattttattaagatgtctacctacccaaacaataatgagattacccaatgttgtaacttcatagatttatcttcatatgttctaaacaaatgtttaagtgagaatatctcgataaatttcctctttcagttgcactctttgaaaaattggtcaatgcccaagattaaagaattcactgggcacaaattcaagtatgacgaaacaacattttcaggttcaccagaaaggtacatcaaatcattgaggggaaacattaaaattttgcaagaaatggcaattaacgaaaccaacgatggtacttgctatttcagagtcaagttgatacctgagggggtagaaaaaactcaaataatcaactggatcccctttacttcttcatttagcgatgataccttcaaacaaagacaccatttaaagaggccaatgatttgcttgaagaacaactctttaagatcgctcactgtcaaaatcatacgtattgaaaaatgttcatccatccgaatccagggattttacctaccaaatctgcaggaactgttcatcaacaataccctttgcgacaccacccaacaccaaaaacaagcgtcaaatgatatgagttgtatagagttcacttcatggaatgaactaccacaatgcaagaaattgggatttgctcaattagaggacgactctaactacgttcttaatatcagtaacctacaagaccatttaccaaatctggacctgcgggagagtttcccaactttcttcgatataagacagaagtttgtcgtggtttgaggtctaattttcaaccaaacgtgttgtactagcatatataattaaataaatttctctagttatcacttgatttatctaataagagacgtcataaacgaatttttttttagcaataaatcctcaacgctttttgttttcatttttcggtctttttctaccatagaagataaacaagtagagcccatgtaatataatatatctacaacctattattacccaaaaccaacaaaaaccctgacagtgacaccccgttacacactcacaattaagtagggatgataaagtcaacactaatctacagagaagatgggctgcctctttgtacgtctgtggacaacgaaaatgatccctcattatttgaacaaaagcaaaaggtgaaaatcgtcgtttccagattgacaccacagtctgccacggaggctactttggaaagtggctcctttgagatccattatttgaagaaatccatggtgtactacttcgtcatttgcgaatctggatacccaagaaacttagcattctcataccttaacgatatagcgcaagaatttgaacactcatttgctaatgagtaccccaagcctaccgtaagaccataccagtttgtaaactttgataactttctacagatgacaaaaaagtcatacagtgataagaaagttcaggacaatttggaccaactaaaccaagagcttgtaggtgtcaagcaaatcatgtccaagaacatcgaagacctactttacaggggagattctctcgataaaatgagtgacatgagttcttctttgaaagaaacatccaaaaggtacagaaagtccgcgcaaaagatcaacttcgatctcttgatcagtcaatatgctcctattgtcattgtcgctttctttttcgtctttctcttctggtggatcttcctcaaatagacgtcaccccatcatcccacatcacaaatcccgatcaatttggtccaagtgtataacatagtctagttcagtattagtatagtatggcaatttatttgacataattacgtatttttcaggcaagctggcaggtgacccgccgcacctgcactttttagggagtcttttcaaggatatcatcactatatatcgaaggaaaagaggctttccaactcttttggatgatcgaattgccatcactactctattaactgtctgtgtattaactaaataatcacatagtattaagttataattcctggaaaaaaaaagaaagcgaaacgacaaaattagcatataccatgtctcaactgccaacagattttgcttcattgatcaagagattccaatttgttagtgtcctcgattccaaccctcaaaccaaagttatgtccttattgggaaccattgacaacaaggatgctattatcacggctgaaaagacgcactttctatttgacgaaaccgtgagaagaccctctcaagatggccgctccactccagttttatataattgtgaaaacgaatattcttgcatcaacggaattcaggaattaaaggagattacttccaatgatatttactactggggtttgtcagtgataaagcaggatatggagtcgaaccctaccgccaagttgaatttaatttggcctgctactccaattcatatcaagaaatatgaacaacaaaactttcatttagtcagagagactcctgagatgtacaagagaattgttcagccttacatcgaagaaatgtgtaataacggtagacttaaatgggtaaacaacattctttatgaaggcgctgagtcagaaagggtcgtttataaagatttttctgaggagaataaggacgacggcttcctaattttacctgatatgaaatgggatggcatgaacttagactctttatatctagttgcgatcgtctacaggaccgatatcaagacaataagggatttaagatattctgacagacagtggttaatcaacttgaacaacaagattagatccattgttcctggttgttacaactatgctgtccatccggatgagttgagaattttggttcactaccaaccttcttattatcatttccacattcacatcgttaacataaagcatcccggtttaggtaatagtattgccgcgggcaaggccatcttgttggaagacatcattgaaatgttaaattatctaggaccagaaggctacatgaacaagacaatcacctacgctattggtgaaaatcatgatttgtggaaaaggggtctggaagaagaactcactaaacaattggaaagagatggtatcccaaaaatacccaagattgtgaacggttttaaataaaggttgttaaaattctcacatcatccacctttttcctactctcattttctttttttgaaagttgtttgttttatataccttagtttcacaacaacataaggcatgcctatttgagattttgtgattaaaaaataatagaatacgtactatataaccgtcggtttaaagtaaataaattaaagactaagaatgaaacaattaaaaacactgttcaataacgttgctctatcctcctgagtcttccggatcctgtctccatttttttgtgtggtgacgagttgagataaaaagatttccactgctgagaataatatctataatcgataatgaaagttagaacgatcacgttgactctgaaatatagtcaatagaaaaaattaggtatcaattcaattgtaatatttactggattgaatttaatttaagaattacagaataagaggacggacaataagaggtacgctacacatctaccatcactttcagggagggcataaaatggaggagagtaagacaaaaagaaaagaggatcgcatagatttgaagaatacaccgcctcagaagaagtcaaaaagagattcaacaaatgacgaaactgcacgcacatcactacgttcaatcatgcccaggggttataaaatgatggaaaacatgggttacaaagaaggagaaacattaggtagtaatgaaagtgccctaaaagagcctattaaggtagaaatcaatacaaaaaggaggggaattcgtgcagaaaagcccgacccatcaacaatgaatgacatgcagatgagtgaacaacgatttataaaaagagaaagtgaaatgaaaaataataagcggttaaaaaaaatttggtataggatccaaaaagttgcttttgaaatgatgggtgattccgatttatacaatccaggcgaagatccgagagactttaacgtactttggagatcttacgttatgcaactaaatgaggaagtagcaaaaaatgacctaaataatcacagtaacaatgataatgaagataagaataatatgataccaatggtaaatgaaagtttggaggcttcgcctgcaataaaaggtgaaaagtttggacgtccttctacattaatagattgtgatacttcaattatcggtagtcgcattacaaaagacacagaacttgctgaattagaagaattgagcattgaaaaaagaataacaaaattgaatatattcctgaggtccgagaagtactactgttttttttgcggaatcaagtataaggatgaaggtgatctctacgagcattgcccaggagtgaatgaagacgaccacaaatgaattttatcgagataggtaaagtcatatttcaagaagaaagaaatgaacagcttttatttatataataacatataatataaaacggaagaaacgggtaaacgtcagttcgattattcttttgcggatacaaccttgaaaccttgctccaataatgcagtgacgtcttcatttttgtatggtagattgtttagtacgaatgcaatatcatcccattgcttttgggtctcgcactttctcagtcttccaactaatttctcgtttaattgcttttggtgccgttccttatcgataaaagttaacagaaatttgatgattttcttgaaactctccttacccaataaatcatctgacgataaattactaaagatatcgatgaatccattataaatggcgttgtccttggatgctaactcggtgaaaaataatctgcacatatcacttattccctggtctggattgtctaggcatttggccatttctcctaattgtcctttaaccttaacctgtccagctaaaatcaagaaggtaactgtcattaaacatgttctttgtaccattaagttttcatcatgcaaacggcgatacaaataatctgtgttttcgtctactaagttgttgaagcatactgccatgtcacctagtcctaagacagcatttgagcgaatagtaggatcaggagatttttccattactgtgattaatagcggcaggctcttttcacaatattttgatgataaacacattagtttttctagacataaggttgccgttctttgaagcattggatcgctaaacctgcttgaattagaaacaatctcttctacaattgggcaaaacttccctaatatagatttttctccaaatagtaattcattctcttttacaaattgaatagcatccgtgaaatcgtcctcattagtacctcctatcatttctagctctttatcaccaccgttatcttgtgtggtgttagttacatctgcaccttggttttttactttaccgttccgagtttctgcctcgatctttcttttcttgaattctgcctcacatttctctagatagacaagtgttttaattgccacttgtcctacaatgaataataattgactgagagaaacaactctagatgattgttctaacgacaaaatagagtcttcctcttcaggtttaccaaatgtcatcattgtcttttctctaatcagatctgtagctagtatatcgggcttagaagagattgtaaacagtgcactaagcgcttgttcgcacataggataatattcattatccttggtatagttgataattatggcatacaactttttcactgcaacatcttcaagctcttgatttattgccttggtaataatagtgcttctcttgggaaccattctctctaacgctaaacaagaataccgacaaagggtcagatcttttaaaccaacggcaccaagtccaatgtttaaaagtgactccagtccttttaatgctatttcgttatcggctaacgataacattcctaaaataataatagaaccatgaatttgttccttagaaaaccctttttcggagtcacggttgttcacattttgttctttctgcatactggccttcgatgcagaattgtaaatagcccaaaggatattaatgacatgttgatcaatcaatttttgttcatacatcattcctaatagctgttccaaagaggccaagtctgcaatagatgcgccgatgcttagattaattaaatttttggcaatatgtgccgccttctcctgcatattgcaactatctggcgcggttaaaaatagctgcttataacattctatcaaatgtactgatatactcgttccttcatcgtttgtgcccttcatccaaaccaaatgcagcattttttttataccaaattcgcttaactcaatgtcaaaagcgtctgctaaaactaggaagtccattgattctaaaacttcgtttctgttcttagaaaacagcaaattagatatcaattcaatactcttgtgtatctctttaatgaaactaatggcatctttatagtaaacaatcattaactttagcttcatgagaacactggtatttgttgcatttatattctctacctcattttctattctagaaagttctgcgctcttattgaaagaaccttctaactcggtcctacattgaccttcatcttgttctacctcttcttcaatcaaagacctttcaatcgtgtcattcagagtttcttgtgactctactttctttaaagtggaatttagctgtgattcagatcctttgagatattcttcccattcactcagcctcaattggctaccatgtatggccttaaaaggatgttttagcaataattttgaaagtaactttactgagttcctacgaactaaagaggagcggtcctgcaatgatcgtactgccaacgaagtaaatttagctttgcttttgttaaatttcgaactcaaatcgcagatctttgaacacccttgtatcgccttcgttctaacgtagggatttgaatcctggaatctttcttctagtaactcaataagtacggctatttgttgtttataatgttccatagtttgtgggtcttgagccaattcagccacaatatttccacatgcttctacaacggaacatctcaatgttatagaactattgttgagtaaggtgatgacaagattcatctgtcgaagcattattcctggtgatagctctgataatttaatcaaaaaatttgatattgcctttgggcctgtggtatcctttgcgttaaataccctggtgctgatttctttcaagatatcttctgttagttgtggatagttatattcatcattcaatagttttagtaattctgcattaaaaaccgacaaatgaagaaaataagttaaatttgtcatcaatgaactttgtatacttgaactttgaccgtgatttttaacacacatagccaaaatcctttgaataaacatctttagtgatgataccttcgtcacaggttcaatctctaataacacaaataatggtcttgtgaacaaaccaataaacaaatccttttcaggagttgtctgaaatatcttagataagttaatctccagtagctttgttatagattcaagcaagttttccatttgattacagtctcttttaaacagctcgacgtttgcactatcattcttactgtttttggcagaacggtttagattggtagactgcgaggagaccttatgtaactcatcttgtaaaaacgtcaaaagtacctgaataaggtagccatactcttctaaatgccttttccactgcggtatcaggccaccaatttcagtaaagttaacatttgatgagagattagccttaatatcttttgacagattcgacagagatgaacttatcaaatagcttagttgagtttgtaatttcggtgttaagtgcgggaagtcatggcaaagatctattaatgcttctagtgaatctggactagcatctatttgttcgggtgaaacggccaattggtctatgataacattcagttctctggatgggtcctgcaagcgaggatatgattctcgatctgttgtttggaacttggtcagatactcggaaaggctaaagccggacatctcataaagtaacgaagtcagttaccacctatcaaaggataaagatattgttactgctgcttcctttacctttcttttttttggtcagtgacaggttattttctttgtttactaaatggtcgcaagattttcgcgatgcgtttaattttcatattattgctttccaatttacccaaagtgcaattgacaaaggccattagtctttctttttacaacagtaagaatataaatatacaagtgcagtatttaagatacttaattcgaaaagtgaaaaaaaaaaaaaagaatctggaattggttattttaatttctcatatgaattgctttccaaattcttgcaatcaataacattttttatttatttttttttcaagatcagaacatgtatatatatatatatatatactgttcataccaacaattatcatttagtagtaaagtttgtgataacgatcaagctagaaactccatagatatcctgacccttactcgttgtaaataaaaggctcgcgacaagaaaacaacgcgttacttgataataattttaaaatcaaacaaaagaggtgggggaaagaagcccttactattgaatagcagacattttattcatctcgcaatactactacatttctatgaaatataacaggtataaaaaatgatttcgcccaggatcgaactggggacgttctgcgtgttaagcagatgccataaccgactagaccacgaaacctattatttatgtttaatccacgttacaccaccaattatacaaaaataaaaaagaatgacggcaaaaaagcaaaaagtgacattaatcatatttgtttatgtcttattctactggtagtattcatccattagtatattactctctgtataaggttataatgttgaaatgataatcaactattgtgtatgatcaattggtgaataatttgataattgttgggattccattttgcttaaggcaatataatattatgtatacacaatatactagaagtttctcctcaaggatataagactcaataacatggaaacaacatttctccacaaaattttgtaattatctttcttccattttatatgtttcacatcctattaatcctcaattctcgcatgttcggtttcatattaaatttgactactgtttcacatagtatatttgttgaaatgaaactctaaaatatcatttattagtagtattcatgttactagaatctattatcatatgcggtgtaacaagatggcataaagattgggaaacagtcatcaaatataatggaagctgaaatgcaaggactgataatgtaataggacaatgaaacatataaaacgaaaggtgtaataattataagattttgtggagaaatattgtttctcttttattgattcgtatattctcgaggagaacttctagtatatttcacatactcaataatataacgtttactaaagatggtgttaacatgttaaaaaaacttcgattgttaagagtccttttgttatacaactctttaaacgactgtttaaacctatcatttcatcacaaactgtaaaggtaagagttaaagcagatatatcacctatcaactgcagctaaatatcgtgaaatgaaaaactaatcgttatttgcaccaataaagaacgaaaatcccccactgaatttaaaatatttctaaagaactaaagtcatttcgactaatgagaaactaaagtcagaaacaaaaatgcaaaagcaatattaacttatgtgagcaaaatatttcatatctaatctatgaaggcaaaagaatatgattaactattttattaattttaattaaaattttattctcttcattccaaggattttgttattattgtaatatgggcgatggttagggtgacggcgacttataaaaataatcacgaaaaatgtgaattttattagggctaagagaggttctctcctcatattctcctgagctgtcactcatattatcacctggaaaaaatggtaatgaggttgtggtattcaagggagaaatttccggagatgagctttccctcccgctgttgatataatcttggtatagtaaatcttcttccgcctttatggttgcaatggataactgagaacaagaggctgattctactggtcgctcctcttttcttttcatcaatgtatcggtagaattattccaagtggtgtaggtgaaggaagttctatgctcatcatcgtgtaatggcgtctcgtttaacgtggtccttgtcttagcgcttttccactctttggccaaattatcttcaagcttttgtgtttttgaacctaaggtcctatcatcggtatttaatgtgaatgtgtcatctattatgggaggcctgctaaaaggctctggttttggataatttttaaattgtaagatatctgagtcagccagtgctttccctagtccgtggttactaaattcccaatagttaaaatcttgtagcgataagtcatatgagctatcggacatgtcctcattagtttgggaatcaggcggttcaaagaaataattaaatggttcaatttcacaatcaattgtttcagctttgaaagtttgggatacaggttcggttttacaagccgcttttgtttcaaacgattgataaaatttgtgctttaacggggagtcgttgtagtaatctgtatctttaatgaattttctgagaggctttttagaattttcattatttttcgacatagtaacctctgcattgctagcccccattttggaaggcccaagattggaattaaatatcgatgaattcgaaaccgcacgatttagatttattgctgacaaagagatcgttatttcatagtttttatagtcattattatcgtaaaatgatctatattcgaaaccatttacatcataacgacaacagaactgcaaattcaggagacaagtagttttcctttcaaaaaagttagtgtaaatcaagttttttgatattagatttaacttcaacgcagatatatcaataataaatttgaattcgtcaacatgaggggtgacagacttgttgtagtgtgcattaatatagtgaatatctgcccagttatttaaagtaaattttatctctatttttttctcgaagttcaaattattgacaaatataaggccccagatttgacagttaccaaaattattgctacaaatatcctcgtagcttacaggatcagatagttctaatgaatgaacctttatattttgtccatttaagtatttgaaaatcttgtcttccaacccagtaacgtccactttatagtcacttttgaatggattcaaattattactgaccagtttccaatctgccatatcgaatgtctcctcttcaccaaagcagagaatctccttttcaatgaacatgctacgatcatgcataagcattgcattatcctctacgtcactctcgttgtcatactcaacatccttattgtcatattctaaatcactgtaatctaaaatgtctaaactataacgatgatcttcacctccaatgaaggggaacgttagtggaatggcattgttatgcaaatttcttgtaagatttgaagcggctttttctgatatcgagataggcgccaattttgtgttgaactttttgactgtgtataaatgtgcagcaaaccttaccgatttccctgatgatgaagatgatgtcgacgaagatgcagatgtagagtcttctagtggtgaaaatgaattagaggttgttgaggaaacaaaagaagaagtggagattgtttttgcgagtttcaaagacggtttaagcttcttaccatggctgtaaggcatttgtaaaaacaaagagtaaaattattgaccttataacaagcgtcaaagaaacgagcatagaagtattatacggcctttatttgtcagattatactccagacttagtaaaaaattcaattaaattccaaactgcttaccccagatttagtgaataagagccctttattctacccgcttatctctggatgtaaaacaaataaacgcgtaatagagcagtcaaactaacagcagtaaactgtcaatatcaaaaacgtaacaattgattcaaatcagtttattctaagccgcctatgccagcctttaattttcttctcctcctcttcactcccaggttaagccatttagtttgttgctatgcggtgtgtggcgtgtttcccttttaggaaaagtgattacttgcagtttcgcgaaatctcgaagaattttttcaacttattgaaagaacatgaatatacttgttaacgtgattaaacgttttatcagaacaacctaagagtatctccttggtgaattagaagccagataatgtcatttgatagaccggaaatatacagtgctcctgttttacaaggagaatctcctaacgacgatgataatactgaaatcataaagtcctttaagaatttcattttggagttcagacttgactcgcaatttatttacagagatcagttaaggaacaacatccttgtgaagaattattctttaacggttaacatggagcatttgatcggatataacgaagacatatataagaaactatcagacgaaccttcagatatcattccattattcgaaaccgcgatcacacaagtggctaaaaggataagtattctaagcagagctcaatctgctaataacaatgacaaagatccagaaaatactagtatggatactgattctctcttattgaactctttaccaacatttcaattaattttaaactccaatgcaaatcagattccattgagagatttggattctgaacacgtctccaagattgtccgtttatcaggtattataatatccacgtcagttttatcttcccgtgccacgtacctttctataatgtgcagaaattgcagacacacaacatcaataacaatcaacaatttcaattctatcacaggcaataccgtcagtttaccacgttcttgcttatctacgattgagagtgaatcttctatggcaaacgagtcgaatattggtgatgaatcgaccaagaaaaattgtggacctgatccatatattattatccatgagtcttcaaagtttattgatcaacagtttttaaaattacaggaaatcccagaactggttccagtaggtgagatgcctagaaacttaacaatgacttgtgaccgatacctaacaaacaaagttattcctggtacgagagtcactatagtaggtatttattccatctataattctaaaaatggtgccggatccggaaggagcgggggtggaaatggaggaagtggtgttgctattagaacaccttatatcaaaatattaggtattcagtccgatgtagaaacctcctctatttggaattcagtaactatgtttactgaggaggaagaagaggaatttctacagctaagtagaaacccgaagctttatgaaattttgaccaactctattgccccctctatttttggtaatgaagatataaaaaaagccattgtatgtttattgatgggtggttccaagaagatattacccgatggtatgaggttaagaggtgatatcaatgtactattattaggtgatccaggtaccgccaaatctcaactattgaaatttgtggagaaagtgtcacctattgcggtatatacatctggtaagggatcttctgcagctgggttaactgccagtgtacaaagagatccgatgacaagagaattttatttggaaggtggtgctatggtgcttgccgatggtggtgttgtatgcatcgatgaattcgataaaatgagagatgaagatagagtggccattcatgaagctatggagcagcaaacaatctccatcgcaaaagctggtatcactacagtgctaaattctagaactagtgttttagcggctgctaatccgatatacggccggtatgatgatttgaagtctcctggtgacaacattgatttccaaactactattttatcccgttttgatatgatttttattgttaaggatgaccataatgaagaacgtgatatttcaatagctaaccacgttattaatattcatacaggaaatgctaatgctatgcaaaaccaacaagaggaaaatggcagtgaaattagtattgaaaagatgaaacgttacattacgtattgtagattgaaatgtgcaccaagactttcaccgcaggccgctgaaaaactgtcatcgaacttcgtcaccattaggaagcaattattaatcaacgaattagagtcaacggaaaggtcgtctattccaattaccattcgtcaattagaagctattattagaataacagaatcattagccaagttagaattaagtcctattgcacaggagagacatgttgacgaagctattagattgtttcaagcttccacaatggacgcagcgtctcaggatccaattggcggcttaaatcaagcaagcggaacatctttgtcagaaatccgtcgttttgaacaagaactaaaaagaagattacctataggctggtctacttcttatcaaactttgaggagagaatttgtagatacacatagattttctcaattagcactggataaggccttatatgccctagagaagcatgaaacaattcaattgagacaccagggacagaatatttacagaagtggtgtatgacaacaataaagtcttagcttgacgccttttctacttgtttgcatgtaatgaatctaaaaaattcgctacaaatacttcattattatatttctatataaattctgtaaacgaaattatactttttgaggtttcatctgcgtctcatattctttttgtataataaacgcacagacttgatatgaccgtcaatcaaaataattcaaagcttcttaaaaaagaaattgaaatcaaagacatacgaaagaaattagaaaatagaggtcgatttaccactgaacaatcctacagtacatgagctcttgaagtgactttatggggaccaatttgtcctatcgtgatattactacgggtaatactaccaaatgaaaattatcttactcaaaaggtatgacaagaacatcatcactagaacatcatcattcttaatagcaagcgccatcacgtttgccccgcctttgacagttgattagaggagtattataaaaccgttttatcatgtcgtatgtttgatcttaaccatttttacatcctataatttggagtgaatttttatatactaacttaaaagtaattgatttgtatctttccagttcacaaataattgatcgtccaaaacatgaactctctagagcagaattagaggaactagaagaatttgaattcaaacatggtccaatgtccctgataaatgatgctatggtgacaagaacacctgtgataatctcattaagaaacaatcataaaataatagcgagagtgaaagctttcgacaggcattgtaatatggttttagaaaatgtgaaggagctttggacagagaagaagggcaaaaatgtaattaatcgggaaagattcataagtaaactattcttaagaggtgattcagttatcgttgtgttaaaaacccctgttgagtaaaaagtaagacaagcagccctcaatcaacaaggaaagcaaatcatcgtaagaaactttacagtcagcggaaagcctttttttattttggaagtaagaccaattattattggctgattttctagctcttgcgaaagtattatattcaagaaaacgaataaagcatctatattatcacatttaactaaagagcatttttaataagtagatttttacataaaatatagaataaatatcaatattattaatcatttgaagttcttcaacgggtctactttaccattctttggcttactgactcttccctttttatgtgaatggcgcttcttagcattgtggaaaggaacaaacttgactttggttccatttcctctggctgattcaggaagcaagtaatctggaacacgctttaaatgctgttgcactcttgctggatgtaattctttatcgtgtcttaaactttgtagctcttttggattctcctcaaaatgtcttttcaacttctcacttgccaatagttcttgtttcaactctttgaccctagcttctctaatggcaacttgagtaacagcacggaaaccgtcttccattctgtaacggaacgcctcgacctgcttttgatcgaatttgtaaggctgtaattctaatccaagtttgctctgttgtttgatgattcgtgaaagaatcctttcatccttctttgctgtctgtagcattgatggcttatgcttaccaaattctttcagtgggactacgaatgaaattgcagtaccggtctttccgccacgagcagttctacctactctatgcacgtaggacttagccgtcgtaggtaaatcgaaattgaggacacatgcaacatttttgaaatcaacaccacgagaaacaccatattccttatctttcttcacttggaccttctttttcttgcttggtttcttatcgttctcaggctcgccttccaagcttttttcttcttgattttctgtattgtgcccttcttctatttcgtcatcttcctcttttatgtactcggtgtcatctgtggcaatcaatagttggtaaacgtttttattgaattggtcaacaatatgttgcctcgaattaacgggtagctcgctgtttaaaatacaggacttgataccaaattgttccataactagcttgagcctatatcctctgtcaatattatttacaaaaattaatgttttacccttgattaagttaagtttaaaaatgacatagcatagtaagaatttgtcaaattcactgactttaacgtaatattgaagtaatttgttttggttcttatttatttcctcgtcattgaatttaagaatagctggagaacgacaaaatttttgtttcaaagcctgtatatcgtcatttagggttgcactcatcaaaaatgtttgtaaattttttttcaatggtaagtactctccaattttgtttaaatcatcttgataaccaaatgttaacactaaatccacctcatcaactactaaaaattttagttcgttcaatgagatagaattaatctttgtttgcaacaaatccaataatttaccaggtgtaccaactatgatttctggttgatccataagtagagtgctcaaaactgagtcagacatatcggatgatatgttcagagttcttatatcttttgaacaatataagactagtttttctaaaacattatatacttgttgagccagttctcttgttggaacaagtataatacctagtgtaccattttcctctccgttatcaattgtttttttatattctaggatagtttcaattacaggaatgaggtatgccaaagtttttccggaacctgtagcggcctttgctataatatctctcttctgttgtaaagccaaaggaatagcatgtgattgaattaatgttgggtactgaaatcctatattcttaatagcttgtaataaacgagagtcgagatgaaatgcttcgaacgttgtagaatcgtcaatataagcgccttccacagactttttctcatagctcatttttttgatctttcgttgcagttttggcttagtctatttcttttgtgagataaattgtagattgactataactatcagccaaaacaaaaggctcttactcaatgaaagaaattagaagaatcgaaatgaaatgagatgagatgagatgagatgagatggtctagaagagttattctttatgttcgtgaaaaaaaatttttaaaatttcatctctaggtttcattacgtaaagagtgattaaggtaaacaataaaaggcagttctaaccagattttggtttggtattacttctataaagtagtctacttagtatgcgtaactgtttttaacatagcggtgtgaccaaattaccaccaatatttaagaggctttccaccctacctttcaaaggatttgaattacattctaaaattttcatattgttgaagtcaatcttagcagtgcttttacctatggtaaccactccagttatagtttcctctttattacttgcatattcatctttattgagaaataaagtaaaacagtcaccaaactgttctttaaacaaccttgagatttgcttcaccctctcaacttcatcaatcttaccttgtgcattagactgcacattgttatgatcatgatcatcacaagaatgactcgaaagcttgacactggcgggagctgaatccacattcataagtatagcaataatggagtctgctacagtgtcattcattaaatcttgagtccattccacaacggctagagtattaacaatagttaacttaatatcacccattatctgtagaatcaatttacctgtattggtcagattgtcttttgactcttctttaacctttggttcttgatttgttactctatcatcatcttgaagaacttcagcctctccaaacatttgtaaaatgtgccagtaaattagctcctttttacaatttacacgaactgactggcgctctcttaatatcgttgtagaaagatcgggatggtgctctcttaaatcagacaaagaaaggaagtctaattcgaaatttttgtcatctgaaactagaatcccagaaacgactatgtctttgtgttcctcttcatcaaccaaacctttttctgcttgagaatccaagttgtcttcgttttcttcctttataggttcaattttagccgcaatttcttcctttatctctacgttttcttctttatatatttcgttcacaatatttcccacagcttttgcaaccttgacaccttgaaattcaagatctacttcaacacagtttctaggattaaaaacatggacttcattatctgtaccctttaaagacgcgaaattggataacaatgcagatttcaaacggcccatgggattggcttctccatgaacaaggatgatatttggcgcactaatcttttcaataaattctaaattttcctggaagtcaacgtgtgcggcaaaggagatttcttcaacttgacaacgtcttggaatggttatttccggattatttatggaaggtattgtatctggctcaagcataataaatttcgccattgttccttcgatggagtaaccggtgattagtactagatttttatcttcagggcaccacctttcaagtaaatctcttgataacccactttgcagcatacctggtgaggccaacatcacactgggaccaaaatcttggaaatcctccaagtttctaagataagatatatttttgaatatgaagggattagtctgagagtctctaaatttttttctaatgtcatcattcatcatatttacataggtttgaaaaacgctcatacatttttttgccaaatttgatgcataaaatattgggacttgtccaccaccgagttcatcagcatgttgagaccagtactcatccagtataagcatgatttcttgagctctccctaaagcaaaaacaggcagtagaacacggcctcctctcatcactgtggaatggattagttgggttagcttcctttctctatttaaacggggctcgtgagtagcggtaccaaaggtagattccacaattaatacgttggatgaaagtggaggcacctcagcagaatttaagtgacgatctacttctctcgaatagtcacctgtgaataacaccctaaggccagcaatctctatttgaaacatcgctgcacccaatacatggcctgcatggaatgccgtaaatttgataccattgacgtcaacagtagaatgatagtccaccgtttcaattttatcgaaagaatcaactaaatcctcatctgagaatagaccttcgtctttagtccccatagaggaggatgaagaacctatactagtaactcttacaaaatctcgcagtagccatctgtaaatggctttggttggatgtgtcatgaaaactctgccttgaaagttagtccgttgcatcacatacggaagtgaagcggcatggtctaaatggaaatgtgatatcagtaagatatcgactttggaaagatcaaattcatcgtaaaaaggtaatgaagctaatccttgatatgccggatgaattcctgcgtcgagcatcactgttttacctttatattgcaatatatgacatgatcgtccaacttcgttacttcctcccaatgaaaaaaatttgaatgttgttgtatttgttcgctccatatatgcgtatacttattaatgttaacttattatgttactttttatttcctcaatggacaaaattcaattgataatacaatgtttcttttgtgctgtaacttttgaagtactgaaaacaagggtaaaagaaataaacgcttatacccgtgaacattttgaacctattagatgtgatctcaatatgtattgcgctgaagcagtagaagttgttaaagatccgctagtttttcataattttcggccagaataactgcttacccgtatttatttgcaaacacgctacttagtcttttggagaggactttatacaggaaagaaagagttttattgattttaaaaacaatataaatgaaagaaaaaaatgtgttttagattaggcttataagatatgacccatatcataattaaaaaaagcgatttagttgttcttttaaaaaaaaagagaaaaaaaaaaaaaaaaaaaaagggaatgagtttgtacatactattatattaatgtagtatcacgttaaaaagccgtagtcatcattaatcgtccaaaagtcttctaccggaccagatgtcatcatgttatcccagttagaacgctttttcctgatgtctgcgttagttactgtaggaataacattgtcgaaatgcagatttgcgctagtgtttgcttccacctgtgttttaggtccattcttctctgtttcgtcaagattatattgtacaccttcctgattggacatcatgaacaaatttctgttatacgaagggtcattctgcgtctgttgaaaattattagcggttacattgttttcagaacacatattttgttgttgatgttgttgctgctgtttgtccatggacagagatgaaggctcttgactctggggaaatattgtttgtagtatggacttgctattcaaagcatctagaacggagttattggtccaggtggaaatattgttgatcatgtcatgagcaccgttgctgaaaagtatatcgcccgaagaagagccatttcgagcttgtttgacactgaccggaattgaattgctagtaaatgacgctggtatcgaggagataatattattgccataatctgctcttaggggtgatgtactgaaatttgattcttcgacatctcttaattgcttattttcacttgtatggttagagaatattgcagattgtagaggattactgttgatcataccattgtttaattgattcgtaaaattgctttctgagaatctttgtggagaagtaatatgttgttgtggctgctcccgctgttgttgcggcagtggtcgtgatacatgctgttgcggtagcatattggaagtttgaggatatggagttgggctttgcgtcatcgctattggaatcggatccgaatgcgaagaggctgtagatatgctagaagattttgaaggacttctattggtcatagtatcggtgttcagggacgatagatacgcttgtaaattgtgctgagctagttgctgttgtagaaaggcctgctgttgaaatacttgccaatcaaactctgtttggttggttggtttcttgacgatatattggtcttgaataggcctttctacatcattttccatagttacgttgttgttacgaacatactggctgttgttgccattattgcagctgttgttggtagtgcttctgctattactttcattatcattattattaacattattattattattactattattattattattgttattattattattattatcattattattgttgtgattattgttgtgttctctgttgacgctgctgatggtcataccattgttatcattgtttacattgattttcaggtttttttcttgggaagaaggaaacgataatgtcgacgatgatgacgaagaagaagatgatgacgaagaagatgttgtataagacattgaagaatttgaaatacgtgacctgtcatccattttggttaataggtgagctaaacttttgggtacagaggtcttttctaaaacaccttgcttcttcttgaatttctcttgttcagccaaatccacttgtgaattttccacaaaaccggcgtgctcttcagcttgtcctttaccaaatattctagccacagcaggcggcataccgccattatgagatatatttttatcgtttgaattggatagattagctgcatttgcggagttagaatcatgaagagtatccccagatgaaattgccttattggcctcatcattgatgttcttgggttcagtacgcttggcgacactactagccatgaaaattaactcagaagagtctggaccacatctttcaatcaaattacctaccgtggcattcattaactgatcgaaagtatctctaaaggttcttgcaaaattagacctttctgtcataacatataaacaaacggagcaagctctcaaatcatccatcgtcgaaaagagacttgcactgattaaaggtctagtatgcttcgaagcatcgcctaatttcttcctcctttgatcgtcaaaattcctggctaaccacatacagtagattaaagttacgccagctacaaaaaccgtatgcactgctggtgtagaatgaccattaagcgttttttgatggaatatcttgtataactgacaaatttgacccgcagcagcttgacattctctaaatagtctatcctccggggcgaaaaattccaaatatggttgtataagcaatcgcactgatctatagtaataaagttttagtgtctcgttttcgaaatttttcacgtcaagagtggaataactttttctccaaacttccaaatcttcaaaaaattttcgtactaggggcaattgatcaatggattgcttcactgacctggaatcgtttttcaatagctgtaaagtctctacaaattgagattcaattcttcgcagctttagagactgattgatgaattgcacaccatggtcattggttgatggagccgccgcatgcacaccttttgtataaaaagagtcgttattgaaaagaggtaaatttatttccgactccttgattgtataaggtttccccacagcaacacaaatcattctttccaacaggtaaacacaccaaaatagtcgcagtttcttatttgcaaatggatcattaggataccattgatttagatgaagtttcttcttggatatgcccatgacatccttgattatgtcatatagtatcagagaatctctatcagtcctaataatgtaaaggacaagcaatgtcaacagttctatttgctgaacataattcaaatgtagaccacacttagtgatgtgacggatagcggtggagaaatatcggtgaggtggaaaccccttgtacttacctgtggtcatcagtaagtaggcgctgatgctgaagacaagccacattctgccggatagaaaatgaaattctatttcagaatacgaatgtgaattcgacggtggtgctgcggaagacgtggcgggagaagatggtgggataagaatcttgttgtggaggtagtggtcataaaaagtatagatttcttgttcgtctaagatagggtacttgaattgtaatcttgtgaaaaaagtgtccaagaaggaacgtgacagcttctcattcagttcaaaaatagggtcatacatcaaaaactcttttttcaaattgtatttggcaaaaatacacttagtgaagtccagcgtctctaaagggtcattcaaaaggctcgcggattggcagatagcattattgttgtttatgttgttcgtactggccgatgtatcgttagtggccgcattaacgttgctgccgttattgtttgtgttctccaggggtttgttggaaggagatggcagcggcagtatgaccatattgctgctgttcggtctagagtaatcagaagtgttgttactgaacaaatgagaaaccttcttgtactgggataattcgtagttgtactggttgcatcccggcgataaatcgagcaaagtctccaaactttttagttttttctccaagaaaatcgtatactgatctttgtcttgcctcatcaggtttggattggaatttgtcgtgacggactttatcgttttcctgaattcattcgcgtcgccagcatcaacattactattgctagtggaaatgggttttattatcgtcatgtcattcagagaagtggcagcgccagcgccagcgccaatactgctatcttgcagctcacgttttattacaggatgaggtgtaggaggtacagtgccagctgtaggggtgttgttgttggtgttactgttcgaagtggaagaagagtacttggagggctgcacgcactttattcctgctttcaaacaggcggtacaactgggtaatttatggtcgcatcgttgctttcttcttctacaaagaagacaagacctggaacggccctttttgtcttgcaacaagacgtctgtcctgttaccggccagctccagttctctcttcaactgttgtattttctcctggctaacattcttccttggacggcccattattatttacgtgtattgttggtagttagcccgaagattatgagtacgtgaaatacacttgtctttatgaaagagtggaaaaatggtggggagtaagttatactattgacgtgtaaaaaaaaaaaaaaaaaaatgttaatggaacgaccgatctaaagaaccatatataatgaatgactaaaaaaagcaaaatagttaagaatccaagaaagatactaagaaaaggcgaaaagaaaaagaaaaagtatgtccgctaacaaagattagcgtataagcaccacacgatgcgattcaggtctcaacgtgcagtgtgcaggagcaggaactattcaatgtattgttgttccagggtttttgttcgcaacccacgtcttgaccgacggtacccgcaggtgaaaattttagcaaagttacactttttttttcatttttttttttcttttctcctccatctaatttcacctgcggttaccggcggaataactcgcgcaccatttctctgtctcgggcctcgcgttcctctttttcgactcgagcggcctcttcacgctgctcgtacttcgcgacgctgcgccggcgctgcgagcgtttctgttgacggtgccactgtagaagcgcctcctctctggacggcatcgtgtcgtacgacgccgcaagttcgcgcgcgagcttaagccgggcaagctttcgattttgctcacgtgaccgcgtttcttggcactcgacaacgatcccagtgggttcatgccgtagttgtaccttagaattacacttattaatcttttggccaccgggccctctgccgccatgaaggaatttctcagtgcattgtgcttccatctctggcgtgaactttggtcgcggtggtagcttgttctttttaatcagcagcactgcggcactgctgattgacctcttactcgctcccctcatcatagtttactagtctcggattcttctgcgctttttccagggtcgcatagcttgtaggttggtagcatagacttatatataaactcatatccgttctaggaacgtatagcgcgctatggtagtccggggaaaatgcacagtttagttaagtgtatagtaattttatcgataaaggaagaatggaagaggtttatgtatacatgtaaactctgaacatctaatagactaatgatgcggttaatacgtacattgccgcttcgatgcttcaaaactagaatacggcggcaaggctcgttgttgtgtttgcggtgctttagttcgtattcaaaaccacttttgcagaaatcaatgtcattgaaaaatatccagttatcagacctatcctcatcgccattatccaagaacaaggagaagcaggagaagccagagaaggaaaacgaaggaaagcactccattggcctgttagacagattttcagaggactttattactcagggcaatggattgaaacctactacttcacaaaatcaattggatactataaagttttatcaaatgcttcgtgaaagaggcaatttttccgatgaacaatgtaaaattatcatagctctattgttgcaactactaaatgatcagttttattcctgttacaatgatttgttcttaagggatatggagctgaataaacaatcacatttgttcagctcgctagaaacagaattgaaattcgcaattcaaaactctagagacacgcaactaaatgagcaccacttgcaattattaaaactcaagagagaacttaactcaatccatgatgaactgaatgaaatcataatagatcttttgcaaaaggacgctaaattagaatttaacaatcaaaaattagaaaacacccttttgtatcgacaattaaacctgaaattgaacgactgttctaacaagattcaaaccaagatactgggggatatcaggtcacatatcgaaaatttaagatggcagacaaccagaagcggtcttttggtaatattagtccttgtttgttcgattatgatcggtgtaagcgcatctaagaaggaacgcccaggtttacaggaacctgaggaacctgaaattttagcaccaaaggaagacattgatactaccttccctcaagatcaacatgatatagattaattagcatacatattgtctgtacataagtatattgtgtgtgcgttttgtttcactgagaaagcggacgtcataaacgatgcttcctttgtttcgagcccagctgcctaaatctttttaagggctctccatctacccaatacttgagagattcatttacttccactgagttagccttattgaatgcatcgatgtggttcgatttcagcaattttttcatccctaagcaactgggcaggtatagccctttcactttctccctcaattcttctaagacctttgcattgaacgcttcagcgtttgaagatggcatgttaaaattcttgcttataaatccgttctcgcacattatatcgtacttgaatggtttgttgaacatgaggcattcatacgtcgtatttgtgccaaacttcaatggcaaagagaccgttgtaccaccttcggtaattagtcctaagttagcaaaggggtatagcaaataaaccttgtcatttatactgtacacaatgtcacataacgctaccagtgccgcgctcaaccctattgctggtccattcaaacagcaaattaaaactttggaatgcttgatgaaggcatcagtgacataaacatttctagcgacaaaatttgacacccacttgcttgtttccgaaggatatttattggtatcatccccttgggcttttgcaatacccttgaaatcagcaccactggaaaaaaatctaccactgctttgtataattgtaaaatatacatcacgatttctgtccgctagttctagtaactctcctaaataaatatagtcttcaccttctagtgcattcaaattgtcagggttcattaagtgaataatgaagaatggtccttcaatacgataactgattttctcattttgcctaatttcttgcgacatattgttcttccttcctttactgtgcgagcaatttgtgccatacactccaattatctatccatatgttcatctttcagttcttatatatagtgcttcacttttattaaccgctcttggggtaaaagagaaacggtcactgctacagcctttcggaataatatttcttatgcccgtcgccaatttcagattctttccttcgtgccgcatttattttatttttcaaaatgacgagaagttaaaatctaaaatcaggaaaaagaacagttgcagatgacgaaatacttcgagcattatcgcaataaataaggcgtgtaaacgtatgtcagatatagaatcattgggagaggcagcaggtttatttgaggagccagaggattttcttcctcctccaccaaaacctcattttgcagaatatcaaaggtcacacatcacaaaagagtccaaatcagatgttaaagacatcaaactccgtctcgttggaacgtcaccactttggggtcatctcttgtggaatgcaggaatatacaccgcaaatcacttggattctcatccagaattaataaaggggaagactgttttagaattgggtgctgctgctgctttaccttccgttatttgtgctttgaatggggctcaaatggttgtttcaactgattatccagatcctgatttaatgcagaacatcgattataatataaagtctaacgttcctgaagattttaataatgtcagtacggagggttatatttggggaaacgattattctccattgttggcacatatcgaaaaaataggtaacaataatggaaagtttgacttaatcattttaagtgatttagtcttcaatcatacggaacatcacaaattacttcaaacaacaaaggatttattagctgagaaaggtcaggcgttggtagtattttcaccgcatagaccaaaattgttggagaaggatttagaattcttcgaattggctaagaacgagttccatttggttcctcagctaattgaaatggttaattggaaaccgatgtttgacgaagacgaggaaacaatcgaagtcagatctcgtgtttatgcgtactatttaacacatgaaaagtagtaagtgggcggaattggcattctcaacaatcatttttatgtttgtaaaccagtgtcctttgatatgtaacaattaaataaaataagtcatgatggggcacgaattcgcaaaatggtagaaacacagtaaatcgaagaaaattaaataattcgttatagatataaagtagtcgattataaaaacgtaaaaacatgaaggcagggtaccttgacgaaataaaagagaggcggtgagatgaggtgaaaaataaagaatattgcaaaaaaaaatattcggactctatgaatcaatctctaataactttaaaagtaattgctttccaaataagagaaattacattgggtatagactgagtcgccggagtcataagcataacatgtggttccagaagcacattccatgtaaacccaagcgctatgatcacaaacggcgaacttcccatcagcagagcatgcaatttcaccttcagtacaggtagatttaccgttcaatttaccagccgcatattgagcattcaattctttagccaatgtacgagctgtactgtctgagcttgtactacctgagcttgtactacctgagcttgtactggtcgttgttggggaaagcgtactagtagtagctgtctgtagggaaacgacagaagaactcttcgttgctggcgaaagagtactagtgatagctgtttgaattggggccgaagaaactatgctagtagtagttgtttgaggggtcaccaaggcagcactggttatttgggaagatagagtagttttcatacttgtgatagcaactgaatttaaagtgctctctgttgtggtggtacctagactagattttgtcttggtgctactcgtcaatgtttttgtagtttgagtaattgatgttttgatagcgctgcttgcagttggagataaagtaactttgcttttactttgtgtagatgtcgtagattgtgtggtctttttctgagaagttgaagcagatgaagttgaagcagatgaagttgaggctgctgaggtttttgaggtggcaactgtagtagtggcggtctggctagcacttgttagcaaattcttcaaaatctcaacatatggttcaccatttagctcgttggaaaaggcttgagatgcatcccataacgcaataccaccaaaagaacttgaagaggcaatatctgcaatagttgattccaataaagaagtgtcagaaatataaccagagccagcagcagaagcagaaccaggtaaacctaagaacagtttgatatttttatttggggatacagtttgagcataggttaaccaagtatcccaattgaattgaccactcacactgcagtaattattgtaaaattggatgaacgcaaaatcaatgtctgcattttccaacaagtcaccaacagaagcatccgggtatggacattgtggtgcggcagaaaggtaatattgctttgtaccttcggcaaacaaagttcttaacttggtagctaacgcactatagcctacttcgttgttgttttcaatatcaaaatcaaaaccatcaacgactgctgagtcaaatggtctctcactggcacctgtaccttcaccgaaagtatcccataaagtttgtgcaaaagtttccgcttgagaatcatctgaaaagaggtagctaccagatgcaccacctaatgataatagaactttctttcctagggactggcaagtttcaatatcttcagcaatctgggtgcagtgaagtaagccatcagaaaaagtatcagagcatgcgttggcaaagttcaaaccaagggttggaaattggttcaagaaagataataggaaaatatcagcatcagaagattcacagtaagtagctaaggattcttgcgttcctgctgagttttgaccccaataaacagcaatatttgtgttagcagacctatcaaaggcatcggttggcagtagtaagaattgtgtgaatagaagaatgatgtaaaggagtgacattctattattaattattttatatttaaattagaatttcaatgtattggaaaaagagtggttttaaaaaaggtaggttgtgaaacgagcgacagttattatttttggatataaaaaggttcaaaggaatgacaggtttattttttttatgttattgagtcttaaatgagtgaaagatcttcaatgttatgaaaaaacttgactgatataatcttaatgtaatgtattgttgttgtccattctataaattatacaaggaaaggtaagtgagacgtttttcctccatccaaggacctaatacctgcatctttttatatctttgaccaatgcctatgaagccaaatacttccgtccatattagtttttttttgttccttgaatcctgcaccgaaccatcgaggggcttagttcttacaccaatgctaatgtttactcaacatctgaaacacataaacaaataaacaaacaccaaacattgcacgttagaaactcatatttactcgcacatatctgttaaggcgaggctggttattttttcaagggaccagcatttccaatttttcaccagcggcaaagaaaaataccaacaagcaggaatcacacccacgcatctcattttgcgttactatgacaactacaaaatttgaatttgttaacgagaatgacgtatataagttcgattttgttgaggatatcccacatattcccaccaaccaaccactatattaatggacatggtttttgccgtgaccgtggatctcgcagctacacaatgatatctcttgtatccgttttagcatgaatttctaaacaagactgattatataccatgcactgtaacattcagagaaaatatactaaaacaattcattgaattttatctcccatgtgtcaatccatttctttctttttggatcaccttcatatagtttactcatttggataagaacttttttagttactgcaactaatgcagcctgttcttcttttacctcctcattggtaaagttcttcggctcaaattgtacagtggataccacttcatccaaaagtaactgtatttccttcagatatgtatgtatactgtctaaagtttctgcttgattcctcttaggagtaaaatcttttgacaccagagttttcctgaaagttgatacaagtaatttgattagctttatcttcctcgtaaacccatcgaaaaacaactttatattttcatagaccttttcctggtcaaattcctctttctgtgaatcagattcggattctgaatcctcaaaatccaaaaatatatcgtccgagtttgctgaaaaatcgggttcctcaagccactcttttatttcattcattgtatcgtccattatggccacattatcttttaagatgtttgctaggatcccataaggtccagccttggaacaattagagagagaatcgcacgcattgaatattttaccaactgaggttaacctttctttgtctagagatgcattttcgtcatttttcaatctttcttgtaattcggcaatgaaatctctcaagccatcgagcaattgtagcgtactttcatccagttggtctgtaaagtatttggggcaatccttgttattgtaaaacaaagggaataaacttagtaagtagaataatggcctactaaaattttggatttcggtaatcacaactttatgattgttatcaaaagttcctggcttgcaaacaatacctatttttgtgcaatgtgccttcaatacagaggctaatttgtctagttccttagttggggtggaaccttgtagtttggtagtagaggagattttacgcaagtcttccggctttttgtatggcactaaaaactgttcatctatagaattcagcagttccaataatttgacgtcatcctttctatcactgcttccagtagacattattgtataactggtatttctcttataaagtttataataggcgtctctggtgatgcttgttgacctcaatggattttgttaaaaggaggcttcatgtcatcgtcaagatcattgcagtttttttctagttttttttttttcattgccacattatgaagcgcccattcaaaaacaactagaaaaacgtttgccaaccctaggtacggcaagatcctccttattaataaaagcatcacaccaagacagcaaagaagtaaatcgataatatgaatagcataattttgcgaagttaaagtcctaaagaaataatttatagttaacactacttacataatttcaatactgctttatatttaaagtaaaaaacgcataacggaaatacaaatacaagtcaaaaactatcttgaagtaaagatggcatgactgctattttgtttcttgttacttttaagctccttttccacaactgttaattttcttattggacggatggacctgggttcattcttctcttaccgttaaccaaggtaacgttaacgaatcttctggtgtacaataatcttttgtaagcacgacccttaggcttctttggcttttcggttttttcaacctttggtgtttgagacttgactttaccagcacgagctagagaaccatgaactttagcctaaataaataatattaatattaaaaattaatgaccatgttagtatagtgaatttttgaattatttggcgtatcagcaaggatgctaaaaataaacttcactctgctattttctcaaagcctttttaactctccgtcaaaaaatgttgttattaaactcgacattatgttaagtccacgctgttgccctcgaaaaatctgtgtcaagcaattacgtttttgatgtaacagaactcaaatttaaaaagtttcctatcatattctcagggtggagccagtttaaagatatattgcgttttatttctttttctgcggtatatatagatatgaaacaccagtaatatattcaaattagctatttcttgttattcattcctcgctgaaacgtccatttttttcatattttaaaatcctaatgaggcattacgtaccatatttgcgtagtttttgtatggggatatggaagattattacagtggcaaatttaatgtgcagttcatgtagcctttaaaatgcaacataccgttcgtaaggctgttttgttctatctattttttctgaggtttccgacaacctcacgacatttttttttttcgaacggaaaaaagaaaagcagttagtatgtaaagcacggatttttttatacatatgtacggatgtgatagtctgcaactctgcaactctgcagttctcagccatgtcagatttaaagagtttccttagcaacgtagcaaagaaatgtaccgctgtagggtttacaagcccttcgatcttgctatataatatatgatttgtcctctttcccttggtttttccacatcttcgctatcttccaagctaccacgatccaacgaacagtggaatacgcaggattcgtcgtgagaaatcgccaaaacaacttcttcaaatgcagcgtataacttggaacacaccttccaatctttgcaacggatgattacttcatgtgtggacgaactttcctgttcagccttttccaccataacggatatgtcattaaattcagtatcaccgctagtatcagctgtgtaaatgtttccccgcgtatctgcgatcgagctatcctcaattcttaataaatcttcatcgtagcggatattttcttccatctctcgatctctagtattggtatatagtgaagacatcggtttatccgcttcgataatcggaagagatccttcctcctgccggccgtctgtgtcgatgtgctggttttgggaaggattgtcagtgagcccttcttggcgttgtatcacagagtctaagggtccattccagcatatttccaaatgccaatctaattcattcacaattatcttaagttctacatcatcaccttcatttccatgctccttttttttgactcccattaaatgaatgtggttgacattactgtaccgttcaacacgtctaataaacccgtggaaggcggagccaaactcgcccgatattggtggcagcttgtacatcatcagttgaatatagttaatcattggctcttgtattcgcgtatcttgtgctcggaataatagtttgacaggtactttgaacgaatgcatgataaccttattgcttgcgagtagatttcctgtgcctactgtggttggtaaaccattgtgctcatccactcccccattcataactatagcgtcatttgggccgctagtatgtacaatttcttcgaatgttatacctagagcacaaatggggttcggttttgaggttgtatctacgcctcctgctgttcctcctgaaagtgttccgttatttgtattccattctggcattgactgtagttttatagtcatattagaggaagatccttggttcattactcgatcataccttttaaacacactcaataaagaatcacaattacactccattgttattgtattgagctcgcgagctgatataactgtatataatctgaatacatcatgaggaatggtacaccaaagctgaccagtatcccctcgtaatattgtaccgttgttactgctgttgagtgatgattttggagtggatattattgtcaatctttcactattaaatcttaagatagccgtctttcgtagcgaagcaactgtattgatagtagttcttagcaatttataatcatcaggtgcttcacaaccatttactatcaattttaatttcatttaactgaattaagacacaccttttgtcttcttttttctctcatcatctccgtatgtttatgttgctattttgatgtaaataaaaaagttgaataatagacgagggcaagtataactcgcctatatttgtagccgcaaccattgaaaaagagccatgaatatgggaaactagttgcacataaaaatgctgaaatttagaattaggccagtgagacatatacggtgttataaacgacacgcatatttcttacgatataaccatacgactacccctgcacagaagttacaagcacagatcgagcaaatacctctcgaaaattacagaaatttctctatagttgcccatgttgaccatgggaagtcaaccttaagtgacagactgctggaaataacgcatgtcatcgatcccaatgcgagaaataaacaagttttggataaattggaagtcgaaagagaaagaggtattactataaaggcgcaaacatgttcgatgttttataaagataagaggaccggaaaaaactatcttttacatttaattgacacgccaggacatgtggacttcagaggtgaagtttcacggtcatatgcgtcttgtgggggagcaattcttttggttgatgcatcacaaggcatacaagcacagacggttgctaatttttatttagccttcagtttaggattgaaattaattccagtaataaacaaaattgatctaaattttacagatgttaaacaggtaaaggatcagatagtgaataactttgagctccccgaggaagatataatcggagtaagtgctaaaacaggattaaatgtagaggaactgttactaccggctataattgatcgtataccaccaccaacggggaggcctgataaacccttcagagcattattagtggattcttggtacgacgcatacttaggagcggttcttctagtgaatattgttgatggttctgtacgtaaaaatgacaaggttatttgtgctcagacaaaagaaaaatacgaagtcaaagatattggaatcatgtatcctgacagaacctctacaggtacgctaaagacaggacaggttggctatctagtgctgggaatgaaggattctaaagaagcaaaaattggagatactataatgcatttaagtaaagtaaatgaaacggaagtacttcccggatttgaagaacaaaaacccatggtatttgtgggtgctttcccggctgatgggattgaattcaaagccatggatgatgatatgagtagacttgtcctcaacgataggtcagttactttggaacgtgagacctccaatgctttgggtcaaggttggagattgggctttttaggatctttacatgcatctgtttttcgtgaacgactagaaaaagagtatggttcgaaattgatcattactcaacccacagttccttatttggtggagtttaccgatggtaagaaaaagcttataacaaatccggatgagtttccagacggagcaacaaagagggtgaacgttgctgctttccatgaaccgtttatagaggcagttatgacattgccccaggaatatttaggtagtgtcatacgcttatgcgatagtaatagaggagaacaaattgatataacatacctaaacaccaatggacaagtgatgttaaaatattaccttccgctatcgcatctagttgatgacttttttggtaaattaaaatcggtgtccagaggatttgcctctttagattatgaggatgctggctatagaatttctgatgttgtaaaactgcaactcttggttaatggaaatgcgattgatgccttgtcaagagtacttcataaatcggaagtagagagagtgggtagagaatgggtgaagaagtttaaagagtatgttaaatcacaattatatgaggtcgttatacaggcccgagctaataacaagataatagctagagaaacaattaaggcaagaagaaaagatgttctccaaaagctgcatgcttctgatgtctcacgaaggaaaaaacttttggcgaaacagaaagagggtaaaaagcatatgaaaactgtaggtaatattcaaatcaaccaagaggcatatcaggcttttttgcgccgttagcattgcatattattgttattaccattttaaaattataccaagctgtatatagttaagtacttttcatttgtaaataaaagagaaaaatagattaataaatataataatggcataatcattatgctttaagtatttcctcaagtgtaactacccctttaaaatctgggttttcgatatttttcaggacggatttgcttacctgctgagtggatactgttggcctaatcaagtcgttcaaaagctgcagcttatttctcaatagaaatttgttaccgcagtaaagtagttcaagtgcagtatgaataaaagaccgtggtccaattgcatttctgtgctcatcgaacataaaaccgggtctcacaataataggcctgaaatatctctgcattttttctagttcaatctccgcctctcttttcgaattaatatagccactaggaatcaatgggaaacctttatcggcggaaatatacgtaaaagatctttgatttgctttttcttgctcctttttgcttttctttaggattttttgtttaaatgtatctgccaaaataatagcactttgcttattcatcatttcataagtaaaataaggactgcttttttttaaaggatttggacctgcaccaaaagatagaaggcgtgattttgaatcatatgtaggggatttggatagagtttgcttataattttcattttctaggaggattcccaaagaatgaactacgttagtagcattattcaataattcatggtaagaatcaggcttaaaaatgtcagcagcggtccattggacctcctgcatccattgcttatcatttaattcattgctatgaggagctttaccggaccttgacacagaaacgacttggtagcccgaagtcactgcttcttgacaaattcttttacctaaaaatccattgcctccaaaaactataagctttggtatcattttctacttcagttcaagctttagctgtatttttgtatacgatacatatttcccttatttttttattttttcaatgttttcctgtttttctattatgcaaaagcgacaagatggcattacgaggagacactcaactaaaaaaaaaaaatgagtcaaattgccagactttgtagagaagtaaaaagttaatgctaagatgctctttatgtattagtcttttaacatattcaaggatacgtaaatattctgattatatactaataattaataataaaaaaattgttttgatctacaagatttttatttattttcatgagtaatgtacaaaagacacatcatcacgccttatttttatccaaatgcacatcaatttgcttgtaattatcccacgcaatacgatatataaaacttggattgaacccaccgacgtttgtaatgtagatatcaatattttcaggcggaacataatcggtaatttgattaactgtatctaatctttttcttggatccattctaggtaatatacgttgggacccaccaaattcgacaaacttctctacgtcgaacggatatagaggagaaagcttatacaaacctgcaacagcaaatacaggggttctaaattctcgggcgcattcacaaacggatgatacacctgaatttgacgagatagtccccccattgacaaaaacggctttagtgccgataataaccttacccacacgggacattaaagcaaaaacagctgagtctgggactactagggtttctatgttgtgctgtgctaattttttggcaaactcatgtgcattcttggtgttattagggaacccctctgtaactaaaaccgtaaatgttctattactacgttcgcgagcagtaatcagaaattttaatacggtttttgaatcaggtgtgggagttaataaaatctcatgatcgtgaatcaaatcaatagcaatttgctgaataccttcatcaatgttttttatctcatctataagatccttgataccctgaatggctacttgacggtaatcagtcttggttttcatactagagctccctgaactattttttctattctgatgaggttgctccggtttctgtaataaattaaacatagaggaaatcaaaggttcagcaacggatgtggatgtgacagttgtgctcatagtgtcttcttctacttcatccctcaaaacagccagtattcttctaattacgttaccgcaactgaaagcagtaggatgagctttttctagactattacctaaatctctgatttgttcaataaggtcattaacatggttccaacgagctgcagagataaatcgcattaacagttgtaaagtttccaaggcgatggcgtatgaaccttgcacttgtcttctttttaacttagcaacgaaagtgtcaatggtaacattcacatcagatgttgccgcattcggatgtactgaagtgaatgcttgagaggacatcttatgttgggcaaaagttcgaaagttggcgtgttgtgtttactggttccgcacgagtaatgaatggtctgtttcatttatgaaggttttttctatgtccatttttttttttcagcatcacgaagaaaaaaagcttgcggttgggaagcagaggtatcatatactcaagctgtatagttcaaagcctttcataaaggctattccttagtatatatgataatgggcttgctatgtgtttttgaatctatctaaaatttcttgctatgtagtcgtgtgtagcatagagacatatcaagaaaaggctaaaatatcttcggttatgcaccttattcaccgttatattcggccagatttcttgcagtttctattaaaagggctctaagtttcatatcctctggggctaaagctaaacctctctcgcatgttgccctagcctcttcccactgtctcaattttagcaaacagtccgccttcctgacaaatacgtctggttggataagtcccgtaccaagtaagaaatccaagtcttgcaacgcctctaaatgctttccgagtattaaacataaatctattttactacgaagcataaagtgtagctctggtagctgaatagcaaaagcttcccaaggcgctctttttctttgtgccatttcgattgctaaagaaacattcttcaatgcctcattcaattttttttgttgtaaattcttcataccactttcaaataaacccttgatcattttgcttagagcttcattcggttgtggtgtaaaatttgggttggtttctccaatcaaagatgtagtgagaacatttatttgatcgatattagtttcggtagatagtgcaacaacagcatcactcgcagtgatcagtttactgtttgcattgtattcaagggtaaccatggttgaataagcttgctttggtatgcctttaacgcaagttgaaggagacgtttctttgattttaaggctattggttttatgttcaaagatataatctaattgttacgtgtgctcctacatccgtttgaaacgatccataaacgatctaaaaaatataatattagacaagccaaatacgtttaaatatacttaaatcacagcatattcacattcaactatttgttatatatttaaatctgttttataaaagacaggagtaccagttagtttgtgttttcttgttgcaattataaaatcttcaaaatcatgtggatttttattgaatttctatatcgagatgaatgtaaatatgtatacagtttagggtagggaaaaaagaaagcttgttctcgtttgtcccttataaatcagcatcatcttcatcaggcaatggcaaagcagtagcttgttccatttcttgttggtattgttgcatcaattgttcatcgacttggacttctggtggggctaaagctggagaagcaacaaattctaattgtgggttaccagccaattttctggccaaccataagaaaggcttttcaaagttgtagttggacttggcagaaatatcgtagtattgcaagtttttctttctgtggaaagtgatagtcttggccttgacctttctttctttgacatcgaccttgttaccacacaagacaattgggatgttttcacaaacacggactaaatccctgtgccagtttggaacgttcttgtaagtaattctggaagtaacatcgaacatgatgatggcacattgggcgttaatgtagtaaccgtctcttaaaccaccgaatttttcttggccggcagtatcccagacatcaaatttaatttcaccgaagttggtgtaaaaggataaaggatgcacttcgacaccaatggtggcgatgtacttcttttcgaattcaccggtcaaatgtctcttgacaaaagtggtcttaccagtaccaccatcaccgacaagaactagtttgaatgttggaacttcaccgttagcagctggggcagacatttataatataaatgagtttatttgattttccttttgtactggactaaaaatcgattgagggaaaaatgttgaaggagcagttcttcctgtttaaaaacgaaacaaacttaaaaggtgaggaaaagttgatcatacagttcaaatttttcaaaatcttcgccaaagaaaaaagaaacgaaaattttttttctatctcggtgggatgagctttcgtccagagcgatattatcctaaggtgacgaaccacgcatgtccttcataaacggatcattatttatttaccaaagaagcgtaggtcatacttagaaagtaatagttattgaaataaaagaatagtagtaataggaaagataaagacgtgtctatgtacaattgtattttttgtttaaaaaataaattctgcattttgtgtggctgattacaaagagtgcgtagtgtattttgctttttctttattgtactggattcgaatataaaaagatgagaggaagaaagccaaaaataatgatcttgttcagcttgtggttctgtttgttttttcttcgacaaggaggatgctatgaaaagttcaatgactttctttggtttcctcagcatcatccaaaactagccaatcctcttcaattggctctgactcaccctcttcagactctttagcaacatgagcagtttctacattttgctcggtgtaagcctttaaagcctctgggccttgaagttccaattctggtagatttggtttttgtggtgggttccaaggcttaacattaccttcagcatcttgcaaggtacttggagccagtttggtgtcttttagttccctcaaatacaaatcttgtatgacgttgtaggatattcttgtggtagtgaaatttctattgcacagtctcaatggcagaactgaagcattgagcagtattcttctggaagcgatagggaacattttgattaggactggtacgcagacggttcaagtttgtatggactggtgactggtagatgaacctgtatataagttaacaccccttccttataacatctgagcagtgggtttttttttttttctttgatattgaggacaaaggaagaagttggttggtcgggtaaaagaactacgctttttttatgatgcataattggttcgtgtatggcgatatgagaatcggcaatcaaatacaataccaacatacttgttttacataataacaagcagtctggacaagcttgatagactaataatcttgaatgatgtttaaatgctttttcgaggaaagcggcatttgaagataagcgcaagttctcttacaataagctcgatttcaataaaaacaagtgtgtatgcacaagaggcaacagaacgtcaatgcccagaaaatgaagtatttcggcttttccttccaatgcatttttttttcattagaacgctgatcagctgtgtatagtttaattttattctcattttcattttacaattttaagagccgccgaggcctagaacgagaaatccgtttcccgctttttcttctccttacgtcgtcagattctatatgggcagttctcgcgttattcgtcatcaggcaagtaattatgcccaatcagcttaccaatgtcacataaaggaaccactattatccctttttggtaatgaaaaacaacactcttccggtacgacagccgctgcggcaattacttttccccaaaagctcataatcgatcaattaacgcgtaaacgaaaaacaaaaaaaaaaaaaatacgtaaattaggtcttcatacgagcgtttttttttttttgaggatcgtttgcatgtctagcgcggcaagcgtgtttacaggcattcgttgtgtgttcatgtttagaacaaatgctaagtgataattataactgaatcctactcataacaattgcacaccttgtcgctttcttttactcaagggcgacaaaacgagaacacatcctcgagctatagccgcggggcctgctgactcgaaactcgtcgggctttgcagccataatccagggcagtggccgcatcgttcgggtcgaatggagggctagctacttgtgatttccgaaaaacggactgcaaaaaatgaggaacaatagaacaccgcgcgctttcttttggggctgtctggagaaaccagtgaaaagtgcgcacgcgtattgcggcttaaaaagatacccgtccattcaagaatggccgatttaacagaaaagagtaaagagatgagttttgcgagatcagaaacaaaaacaaaaaggaaaaaaaaaggaaatttttttgggagaaggaaaaaagggttaagtctgtagagaaactccgtagttcccttctgtattactaattggttaccaagtaataaatacctgagagtagtaatatataaaagagaaatcgtataaggaccgtgttaaatttatatatattaaggaagtctttcggttggtagtgtgagataactaattctttttggagagccttcttctttgctctatcgtggtaataatctacatattctcacaatcgcacacgtacgctttctctctcacaagtaacaaattattctttttgcattatagactacgtacgataaaaatataaaaacagaaaatggtcgaaggtgattttgtcgatgagcaatcgaacattgccttactaagctccaaatccatgtgtggtgatcatcatagcgtcaagaatagcataggggatgagatctttaaattattgacaaagattttaaattcggatgagaaagcaagcggagatgtgcacacactcgtttctgggaccccggatctctcaaattttaacctcgataatgaaccactggaaaacatactcgctgttttcataatatcttttattattgtagtggttggagttttactacttgggttgattggcatgatattcatatctctccgttcaggcagcagtaatgataagaaactacagtccaacgatgaagaaaagcaagcacttgctgaaaaagcatgaaataaaaatagatataatagatggcaccgctcttcacgcccgaaagttggacattttaaattttaattctcatgatagtaacgatcgtgcacattcaattaattatcgcataccaaacattttttttcctttttcaattcaactaatctcaattttttaattttcctttttttatttcctttttttttattctcatcataccattttcattcgttgttgatatctctattgttttttttggcaaaatatagtctacatataatatttaataatctaatctgatagcgttaatttccataccgcctccttttatatccgttggcactcgacggtttccgtatgccgtcggaatgcatccgcttcttggactccttgatcgtggtttgcagtatatctacactgtaaaatatagaagtttttggaatggtgttactccattgtgataatatctttgggggttctagcttctttgggttattcaacctaggaaatggattgctctcgcacgtctcatctctggatcttgaagtttgcttgaaggaatggtgtgcagatttttcattggctctttggggtaatttgctggctttaaccaaatctcctatatcaaacctgttagcatccacaaatactttggaatatcctggtgagccatcgtataacaatttcaaggtatctattgaggtttgtgccagttctttttggttcattttcttcacatgcatgatgtgtcttttctccttatttgaaaggcatgtaacttttagcgtctcattttgactactgttttctctttctttcctgcctctttttccaatgtggcgtcttttatgattatgtttattaataatgtctcttgctttgttcctataatagtcagctgttatacgaaggtgattcttaccgaccaagtgcgatttacgaacgctcaacgtgtcatgggtcaaatacgaatgacagtattcacaatagtatctcgtcattgcctatctctttcctctccgttacttgagcaccttcatcgcctacactaggagctcatattatatcttcagtatagcaagaatattttctgttatccttaacgcttacccgcctatgtaccttgacacttgcggaaatctagtgttcaatgataaggtactgtgtggaacatatgaaagtgaaaagagtttgaaccgtttattatctctatacaagtgtctctattcacatataaaagagtgaaaataaaaataacttttaagattttattacctacatgagattagaaaaatcataactatattactcagcggctgtgcctgttgttgatcaaaagaaaagatccgccccttcgaacgtcttagtgccgccttttgcccgcttatcaattttctctgagggaacataacggcatttatctattcgacttccaaatctacatacacgtatatagatacatatatatatgtgtgtgtgcgcctgtgtgtactagcacttctcaatattataattcttccgtaaagttcgatcgtgacttcctgttgcacagttatcttaaataatagaataaaaagctaacgcagattcaagtggggcgttgtcaggcacacaaaaagacaagacaaaaagtagcgtactagacttacagttatgctgttgtgtaatagaaaagtccccaagactttaaatacctgttttatactgcatatattcactctgttaacactgggtgtgttagtgtccggaatgccgtcaaaaatggtatcattcgcctctcaggagactttgcagagaataaataatctccttcgagggtctgccaatcgagatgttgacattattgcagaatatttgaaaaaagacgacgatgatgatggcggcgataaggatcaccataacatcgatattgaccctttacctcgccgtcctagtttaacgcctgataggcaacttctaaaagtcggtttgcatggtgctataagttcagatttagaagtctgtagtaatttgactataaatgaggtactcctgaaatttcccggttctaacgctgcagacgctgcagtaacacaagctctttgtaagggtatggtgaatttttttaatagtgggattggaggtggtggctacgtagttttttctggcaaagacgatgaagatcatctatccattgattttagagaaaaagcacccatggattcacataagttcatgttcgaaaactgctctctatgctcaaaaatagggggtcttgctgtcggtgttccaggtgaattgatgggtctctatcgcctctttaaagaaagaggtagcggccaagttgattggcgtgatctaattgaaccagtcgcaaagctgggaagcgtgggttggcaaataggcgaagcactcggtgccactttagaactttatgaggatgttttcctgacattgaaggaagattggtcgtttgtattgaattctacccatgacggtgttttgaaagaaggcgattggatcaagaggccggcactatctaacatgctaatggaactggctaaaaatggttccgtggccccattttatgaccccgatcactggattgcaaaatccatgattgatactgtcgcaaaatacaatggaataatgaacttgcaggatgtttcatcgtatgatgttcatgttactaaaccactgtccatgaaaattaggaagggcgccaatttcatccctgataacgatatgaccgtattaacaagtagcggctcaagttccggggctgcactacttgcggcgttaaggataatggataatttccagaatcaagaagggggcgattatgaaaaagaaactacctatcatttgcttgaaagcatgaaatggatggcaagcgcaagaagcaggttaggcgattttgaaggcgaagcattacctaagcatatagaagaggtattggatccagaatgggctttgaaagcagtgaaatcaatcaaaagaaactctcaagacggaaattttaaaactttagaaaactggacgctttatgatccggcatacgatatcaataacccgcatggaactgcccacttcagtatagtagattcacatgggaatgctgtttccttgacaaccaccatcaacttgttgttcggttccttagtacacgacccaaaaaccggggtgatcttcaataatgaaatggacgatttcgctcaattcaacaaatctaatagttttgaattggcaccctccatatacaactttcccgagcccgggaaaagacccctatcatccactgcacccactattgtgctgtcagaattaggcatcccagacctcgtggtcggcgcttccggcggctcaagaatcactacgagtgttttacaaacaattgtgaggacgtactggtataacatgcctatattggaaacgatagcctatccacgtatacaccaccagttactgcccgaccgcatagaactggaaagcttccccatgatcggtaaagccgtactaagcactctcaaggaaatgggatatacgatgaaagaagtatttcccaagagcgtagttaatgctatacgcaatgtcaggggagaatggcatgcggtgagtgactattggagaaaaagaggaatctcctccgtatactaagatgtggggtaagaatggtactgtaatatagttcaagataatagtacgtaatgtagggagcctgcttctgtggtatataaataaatactgggcttgcgtttatttttaaagaatcaatatttacttttcattaacaaagggcatacgcccttaaaacaaaacaaaaaatccagatcatgcgagctttgcctttttcagtaagtttccctaccttgcagccgagacgcgacttcggaacgatgccagcatacgtatttaccattattaaaaaaatctgatggcttgatactgcgcgtttctttttatagcattaatacgcacacatacgcgcattgttgtttactataaataaaccgtggggacctgacccagtcatcctccctgtgtttacagtgcggtgcacacgagcctgagacaagcccgtaaccaggcgcgttgccgcaaatacagaggcgccccagacaacaccgcagtgtgaagcactgtcaatttaaaaccgtggcttgctggagatgcccagaccaaccctgttgggtttttctctcgagcacgccgttataattttagcgtgttccgtacctgtgtgcacatcaataagcggtgtaacaaacttgaacttgccatctcatatcgtcatatgagcagttgcagagaaaggcactttaaataaaaaggcgtggatgataaaaaatgtatataagttggatggatttttgggaaaaagtaatgtttttgcagacgttttaaatactccctcccttttcttagtaatttttattatgtattgactaagtcaaaaataactatagaaaactaaagtttacgagaggacccaaaagttttgaataacacgtgcctttgattttttgtttactttctttttctagttaattaccaactaaaatgctttcgcttaaaacgttactgtgtacgttgttgactgtgtcatcagtactcgctaccccagtccctgcaagagacccttcttccattcaatttgttcatgaggagaacaagaaaagatactacgattatgaccacggttccctcggagaaccaatccgtggtgtcaacattggtggttggttacttcttgaaccatacattactccatctttgttcgaggctttccgtacaaatgatgacaacgacgaaggaattcctgtcgacgaatatcacttctgtcaatatttaggtaaggatttggctaaaagccgtttacagagccattggtctactttctaccaagaacaagatttcgctaatattgcttcccaaggtttcaaccttgtcagaattcctatcggttactgggctttccaaactttggacgatgatccttatgttagcggcctacaggaatcttacctagaccaagccatcggttgggctagaaacaacagcttgaaagtttgggttgatttgcatggtgccgctggttcgcagaacgggtttgataactctggtttgagagattcatacaagtttttggaagacagcaatttggccgttactacaaatgtcttgaactacatattgaaaaaatactctgcggaggaatacttggacactgttattggtatcgaattgattaatgagccattgggtcctgttctagacatggataaaatgaagaatgactacttggcacctgcttacgaatacttgagaaacaacatcaagagtgaccaagttatcatcatccatgacgctttccaaccatacaattattgggatgacttcatgactgaaaacgatggctactggggtgtcactatcgaccatcatcactaccaagtctttgcttctgatcaattggaaagatccattgatgaacatattaaagtagcttgtgaatggggtaccggagttttgaatgaatcccactggactgtttgtggtgagtttgctgccgctttgactgattgtacaaaatggttgaatagtgttggcttcggcgctagatacgacggttcttgggtcaatggtgaccaaacatcttcttacattggctcttgtgctaacaacgatgatatagcttactggtctgacgaaagaaaggaaaacacaagacgttatgtggaggcacaactagatgcctttgaaatgagagggggttggattatctggtgttacaagacagaatctagtttggaatgggatgctcaaagattgatgttcaatggtttattccctcaaccattgactgacagaaagtatccaaaccaatgtggcacaatttctaactaagtcgccctcagtccgctcattttagctgaattttctaatgttatttttcatcagcaaaacttaacagaacgttaatttatctaccccttttagttcattatctcttttttatccaacattttacagagatctctcacttaagtctaagtaaagacattattttatatggtacacttatagaatatacgataataataataaaaactatgtaacataaccttcagaatttaatattagtttcctttttacctcattgcactaataaaaaaattctacagaatctccgaaaaagaaaatccagcttactctttttgttttcttcttcacacgtgagcttttccgccggcatacgttccgttccgtgtcgtcttgcataaaatttccgaatcacatgttcgtaaaacaaccggaagtgccccgaatataaagtcaattctcaccgctgttgtaactggagctttaaggtgttatctaaggaaggataaaagaacttaaacaacaacaaacaaaaaattaagttacaatgccagcattattaaaaagattattgtttcaagtgggtcctcatccaaacgaaagaacattcaccttatcctctgtttcaactgatgggcactatatttccttgagaccatttgttaagccaagcggtgatgagttatcttttcctttcgaatgggcctttgccggtacaaacgaaacagttaaagctaatgatcaaggaaacggtgtcgttactcaagatttcaatttctggttggatacaaatgtgtacttgaacgttccaaacacccatcgtggcgaagtgaacaccacttggaaaaattgggattctggttgtgtcgaggaaacaggcgctgtttacccattcggtgccgacaaagaaagcgtctctttcagagaattgtggcaaccagttgacccatcaagagaagatctagtcatcgtctcaccaaacaatgagaagttctcgtcgaatgctaggtcaattgtcctcaaagttactgacgaagcttatgatggtttggttattgttattggtagatggattcaagggtttttgtcccaaaagaataataacactattgaaggcttgaacttcatcagattacttgaaaaagattcaggtaaatctgagttcttattaagctacggtaaggaagtaaacaaaattccacaaagctacgaaaatttgaagaaaggttccactgtaaccagcaatgggttgaactgggaagttattgaatatcacgcttaataaaggagaataaatcgttttctactttcttctgctgctataataagcacctatgggatctatatagtatttttataacgatagactttataaaagaaaatacctaagtgaaaatttggtgaattttgagataattgttgggattccatttttaataaggcaataatattaggtatgtagaatatactagaagttctcctcgaggatttaggaatccataaaagggaatctgcaattctacacaattctataaatattattatcatcgttttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaggtcacatgatcgcaaaatggcaaatggcacgtgaagctgtcgatattggggaactgtggtggttggcaaatgactaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccatacaatgccatctcatttcgatactgttcaactacacgccggccaagagaaccctggtgacaatgctcacagatccagagctgtaccaatttacgccaccacttcttatgttttcgaaaactctaagcatggttcgcaattgtttggtctagaagttccaggttacgtctattcccgtttccaaaacccaaccagtaatgttttggaagaaagaattgctgctttagaaggtggtgctgctgctttggctgtttcctccggtcaagccgctcaaacccttgccatccaaggtttggcacacactggtgacaacatcgtttccacttcttacttatacggtggtacttataaccagttcaaaatctcgttcaaaagatttggtatcgaggctagatttgttgaaggtgacaatccagaagaattcgaaaaggtctttgatgaaagaaccaaggctgtttatttggaaaccattggtaatccaaagtacaatgttccggattttgaaaaaattgttgcaattgctcacaaacacggtattccagttgtcgttgacaacacatttggtgccggtggttacttctgtcagccaattaaatacggtgctgatattgtaacacattctgctaccaaatggattggtggtcatggtactactatcggtggtattattgttgactctggtaagttcccatggaaggactacccagaaaagttccctcaattctctcaacctgccgaaggatatcacggtactatctacaatgaagcctacggtaacttggcatacatcgttcatgttagaactgaactattaagagatttgggtccattgatgaacccatttgcctctttcttgctactacaaggtgttgaaacattatctttgagagctgaaagacacggtgaaaatgcattgaagttagccaaatggttagaacaatccccatacgtatcttgggtttcataccctggtttagcatctcattctcatcatgaaaatgctaagaagtatctatctaacggtttcggtggtgtcttatctttcggtgtaaaagacttaccaaatgccgacaaggaaactgacccattcaaactttctggtgctcaagttgttgacaatttaaagcttgcctctaacttggccaatgttggtgatgccaagaccttagtcattgctccatacttcactacccacaaacaattaaatgacaaagaaaagttggcatctggtgttaccaaggacttaattcgtgtctctgttggtatcgaatttattgatgacattattgcagacttccagcaatcttttgaaactgttttcgctggccaaaaaccatgagtgtgcgtaatgagttgtaaaattatgtataaacctactttctctcacaagtactatacttttataaaacgaactttattgaaatgaatatcctttttttcccttgttacatgtcgtgactcgtactttgaacctaaattgttctaacatcaaagaacagtgttaattcgcagtcgagaagaaaaatatggtgaacaagactcatctacttcatgagactactttacgcctcctataaagctgtcacactggataaatttattgtaggaccaagttacaaaagaggatgatggaggtttctttacaataaagaagcacatgtgtgttaacgtttttagtatttgcttgttatgtaaatcaggaaaacttcgcgggatttggttggatgctactttccatacaataaatattatagatctaaaaagccaaattacaagtaaagattagtaaagctgttggaattccatcgttgataaaaatgttagttattaaatataaaagtcagaataggtgaacttggatttaattgttggcatttcgttgctgctagaggccataatattagatagccaggacatactagttctcctcgtggtataggaatccataaaatggaattggtgattctatgtgatatattcacattcttactacattatcaatccttgcacttcagcttcctctaacctcgatgacatcttctcataacttatgtcatcatctaacgccgtctattataatatattgatagtataagtattagttgatagacaatagtggatttttattccaacagtgtctttgttcgtctcagatatagtcggattgcccttttaagcaatcaatagtgttttatttgcaacaatgtcgtcatagtttaatatgtcctataagatgttaacttgctcaacattcaacaaagtttggtctcttggcccagttggttaaggcaccgtgctaataacgcggggatcagcggttcgatcccgctagagaccatttatttttaaattcgaccgtctgacagacggtgcacttattacttaatttttttttttttttaatcctcgttaaactgagtacataatcagcaacaatataatataaaagttttgcttttttatgtacgtacaataggggtacttaaataaataaataaacaataaaacaatcaataaataaataatatacgatcataaattacgagatatatttcatagtcttgacttctccagccgaacgtcattaaatttaaggcagaaaagataaacaagggtacggtgtacagaagacaaaataaataataacctttaaaagattataacaatgttttcattatttcttctcatcggccttaattttatttaaggcagaaccatatttgaaccattcaatttgctcatcgttgaaagtatgggtcaacacagcatcccatggcttaccattctttggatgaactctcattgttacaggcttacctggagccaattcagctagacccagaatatcgattctgtcatcagggttgatcttgtcatagtcagctgggttcttgaagttcaatggcaatagaccttgttttttcaagttagtttcatggatacgagcgaaagactttgtgatgatagcgaaaccgcccaagaatcttggttccaaagcagcgtgttcacgagaggaaccttcaccaaagttttcatcaccaataacaacccacttgataccttggtctctgtaatctctagcagtgtctggaacacctttgtattcaccagtatatacatttttaacacagttagccttcttgttttcagcattaatagcaccaatcatatagttattagaaatgttttctaaatgacctctgtatttcaaccatggaccagccatagaaatatgatcagtagttgtcttaccgacggccttaatcaagattggcatgtctttagcatccttaccatcccaaggtttgaatggtttcaacagttgtagacggtctgaagttggagaaactttaacttcaacggtgctacggtctgcaggtggagcttggtaagtgttctcaccagcatcataacctctttgaggcaaaccatcaccatgtggtggtttcaacatgaactcattaccatccttgtcctttaatttgtctgttagagggttgaatctcaaatcacccgcaatggcgaacgcagttactaattctggagatgcaacaaaagcatgagtttgtgggttaccatcatttctagaagtgaaatttctgttgtaagaggaaacgatagtattcttgtcacctttcttgatatctctacgatcccattgaccaatacatgggccacaggcgtttgccaaaacgataccaccaaattctttgaaggtttctaattggccatcacgttcaatagtggctctgatttgttcagaacctggagtaacagtgaaaatggtcttggatttcaaaccatgagcagcagcatccttgacaatggatgctgaacgagacatatcttcataagaggaattggtacaagaaccgatcaaaccgactctgacatccaatggccagttattagcaacagcaacttccttcatcttagaaactggagtagccaaatcgggggtaaatggcccattgatgtatggttccagagtgttcaagtcaatttcgacgacctcatcgtattcagcatccttatcagcagataataggtccttgtggtataatttagcaaagtcagcgatcttaccacgaccagttgcttccaaatattcaatcatagatttgttgaatgggaaaacagatgtggtagcaccgatttcagcacccatattacaaatggtacccataccagtagcggagaaggtgtcaacaccatcaccgaaatattcaacaattttaccagtaccacctttgacagttgtgataccagccaatttcaaaataatatcctttggagaagtccaaccgttcatcttaccagtcaacttaacacctaagatctttggagccttcaattcccatggacgacctgccataacatcaacggcatcagcaccaccaacaccaatagccaattgacctaaaccaccagcatttggtgtatgggagtcagtaccaatgatcaaagcacctgggaaagcgtagttttccagaacaatttggtgaatgataccggaacctggcttccagaaacccatgttatatttcgcagtggcagaggccaagaaatcataaacttccttgtttagatctatagctctcttcaaatctttttcaccaccaacttgtgcttgaatcaaatggtcacagtggacagtgactggcttagcaacctgtggtaaaccagcggacataaattgtaaaatagccatttgagcagtagcatcttgacaggcaacacgatctggtcttaattttaggtatgaaacacctctctgaatatcttgaccatgagggtcatccaagtgaccgtacaaaatcttttccgcgtaggtaaatggcctgtttaatctttttcttacgatatccagcgtttccacattctgcttgtagttaataaaagaatgatcttctaataagttttggttgacttttgaatctctagtcaagttggagactgtcgcaagaccacgaacaatgggtctcttgatggcagaacgtgcagacagcattgtatatctatagtaataatggtagtatttattaccttcgttctactatgtaataactaagaaagagtgaacagaacaagggacaacggaattaagcaacatactcctcctaattaacctctaaaaccggaagattatatatataacaaaagattttccttgtcctccctttttgtgcttgcctttccgaaaaccggcagcgattggaggtttgatggttaaagtcgcctgcggagaacaactgaagggttcaaatttttctcgtatgcactaatttctctattgattggtcaggacctttgccgatttcggcgccgaaatgctcgaaaaacaaagggtattgcccggccccgcggacctcccttttgcggctctcggccattttttaggtaatttgacaccgtgcccaaatggcttggcacaatcgagaatcaggcacccgcgtgtgaccggcgtcattcattaaagccagataagacaaagtaaaatacaatggattatgattaatacaatgatatacaaaaagagagaaaataaacgaaggctacgtctgcgtaattgacgatgggaaactggtatttttatataagcatatgtaaagtgcgaagtatatcagtacggaatgccatttgtgagcctttggaattcatcataacctttagtgaatatactttcataacttttacggattagcgccttcatatatagtgcagcttcgtgatcggttttttgaggttgaaatcttgctcttagattcctaattgtcttgtgacccttaaagcaggggagaccgcttcctaacataggatttacacactcaattatggcctccacgtgcggacgggcggctagatatgccttgatacaaagttcttcaaagtccagatacgctggggtctggggcgaacctcccatcactttaaccatttctttcgtcagcttgaatggtactgcttcaaacttgataccacctgggacaatatcaaaaataaacccaaaatcgatatgtagacaatgtccttgatcatcgtacataatgttaccattatgtctatccttgaattgcaacaaatacgaaattacgctatatcccgctaaggatttaacaaagttgtttcgtgcgttttgaaattcgatagtagattcattaccaaatttactagtgaaatattcatataatccattaacagcttcacgtcctaacatatcacgggataccgaattgggtagcacatcgatgacaccacaacccggtgccgtcgcagtaactctgtagggaaaaacgtagacatccaagccaatactagaccaaatggttctaaatagcgagatcaattgtaacgctagaacatcttgcctacagtcatcaccgactttgaagatagcagcttgccatttttcaacttccttgtttttacctgtcaaaggatcttttacgtctttctttattttaaaggtcgccataaaaggcgcctttgcgtgagattgaagtggcttaccactcttccgatcaatatcaataactacaccgtcaggattagaaggtaaataaacatcaggtttcacctcaattttgctcatttcttcatcgatcttatgtttcttttcagccttacttttttttatgtatggtttcaacttaccagatatgccagttacttcgtcgaagaattcaaattcacgttcgtaaaaatcgcgatgagattggctgaaacttgaaaccatacgctccctaatacgatctagagttggtttgatttcatcttcttgtataccttcatcatccttgtagcagtttgcaagcatattccagattatttgatgagaaaataacacactaattttcgcagtatccaaaatcaatctttcgacatatccggttttatcgtatctcaaacattgtacgatttgaggaacatagaagaatgccaagttcacatcttgtgattccaacgaatatatgctgaattgtaagataaaagaattaccttgccattcgggaaggaaaaggttgatagattttaacgggctcactggcgcccagtataaggttgcgtgtaggtctttcttactgctcaggtggcttccttttatgaacaggtcaagagcacttggggaccccacacacattaaagcatgttttgcaactaagcccactaaaacatcctcagctttcttgctataacatcgttgtaagagatttattgctaatgttggatctttagcaaaggtagcttcaacgatatcgcttgtaagctcgttgctgtcggctccttcaatcttctcagtcggagtaagccaggtttgaatctgctggatttcgcttgccaagaaatagttcaggatcttgtaatctttcccgcaatgacgtgacattagcgagcttaatttgttgagctgaaggaaaaggtccctagtaacagataaatctgctttgattttcagctcatttgagccgaatggccacgctactggtcttttaaaccaacttagggcaccgtttgtgatttcttgcgacaaacggcccatatacttggatccctgcttataacttgcgtttagtacgagagtcgcgaataacaataattcgtggcgaatcattctagcgaacgggtgtagtgaagccttatacagattcttgataccataaagcgcacatttcgtgaaaattttcaataaaaagtcactttgaaatagtgtgccctcgaaatgggaagcaaaaaatttaataacatgaagatgtggttgcatagcttgggatgcattttttgcatctctgttgatacctgctttgtcgtaaggggaatattccattttttggtattcttcgccctttaagtcatgatcgcgagaatagagaccaatattgtcatcaatggagcgcatccagcaatagcatacttcaactaaaagcaaatgtgcaacttcgggcttctcagttatgattgttaaccatacgtttgtagcaatctttaaagatgcagaggtgaagacttcgaacgggatgtgcacaatatcatatatcaatgacgctggtgcaccattgccaagaattaacaacgcggtagccatatcaagaaaatcagttacgtctttagttataatcttatttcctaaggtcaaattttttcttatgttttgagtggaaatacctatttgccttttgatatcctctggtgatgatgtaatagcggtatcgaaaagatattttgacctccaagaatgtaaagatataaatccagaaatcgtgttaggtttctctggaccataataagtaagccttgataattccttatctgcaggtaaaatcaaaccagccatatccatggcaaatgagacaccaaattcaacagaatttagcctgctgtactcaccgagatctgatatgtatgattgcaacaaaatcttagtatcctggttgcttctattcaatagaattcttacccattctttagctgacttgtgcaatcttgatagtgtcgtagcgcgccaggacgatgagcttggaaccaatattgttgtcttagaatgttttaatttaaattcataccgtggttcaaatttatgcgcctctgagtccaagatactatcaaatagggctgttaacatatctaataaggtgtagagagacaaatgatgacataacgatgatggaatagatctgataaatatttcacaggcatgaaaagcggcatcctgcaaagttggttccctatgagaaaggcaaagtagcaagttattaagttgttgagcaatcattttggagttgaatatggcatcgttacccttttgaatcaacctagcatattttctaatcatggaaaccgacaaaactgcaatacacttctcaattgaaccggaaagaatggaggggtctgagaagtacagtagagtcttcgaacaatcacctgcctcgcatcttatcgtttctagaagaacggcagccgctaaaaacatgattttagacgatgaagttgttctgtactgaacaatattggtattgaaatattcggttatctgctgtttttgttgtttgatattttcgttagatgaaccgcggcgcaaaattgtattcatttccaatgaaagctccttgttattagcaggaaattcagaagccagcggtggtgaattataggcaatagttaataagaaagaaaaatttcgtttgacaataggcccgcccaagtggtacccatggatgacaaaattaaaccaggcgttcctaaacttgtttgtagtgacttcatccttattgatgtccaatggcgtatcgcctggaacaggtagtagagcggcgaggggctctaagtaggtagcgatttgatcagcaacacgggaaatctccgtttgaggtctgtgatgttccaatcgttctacttccccactggcaatgattgagtccaatagatcatgaagatacatgaaatataagtcacttgaaaaatgcctggccaacaattcttttgatatcacacatttcgctttaataatatttttcaatagtgcgctatcatcaatttttgttgcaataacagttctcgatttgaagaactttagtaaaagcgaaaattctgtcagtgaagtattcggagccagtcttgccaaagaattcaaaataacaccgtctaattcctttgacatagaattaactttttgcgtaagaatagagatagtcaaagctgttatgctttgggtgttatagtatgaggcgattgtagtcgttgcagccacacaattagatatcaaagaggcatggtatgtcatagtagctccactattgacatcatgggaggaaagttggcccacagttgtatttccgagcagagcaccagtgccatccaaactggcagatgaatttcgcaagggaaagtagtctttctcaatattttttccagatgttattgttaattggcgctcacggagcaccgggacgggcgatccgtcctcggaaacagctaataagttgttcatggaataaattgtactcacaattgcatcttcatttagagggtataaccctgtggtgaatatttttgcaacatcattaactgtttcagtcgtgatatgtggagacgctaccaataaaggaaacatacgaatcagagttaatgacaatttttccgtgaaaaaattcagtaatgaggcagaagctacaattgcttttatcaaagatggtgtaacgacatcagataagaaaaatttatcaatagattcagaaacaacgtttgtaaaactttcaaaaagctcgctttctgtatcttctataaacggaattaaacatagcgtttgtaggtagtgggctcgagtatcaaaagaaaatcttgcacggttgtctgtagataggtcgagaatatgtgactcagaacaaaattgcagggaaattttacacatgtctgtaaaaaactgtttattgcttcttacgttgaaaaaaaagtcatcaatacacttcgtatcatcgttttcatcggctacttcttgatcaaatttgtaaaattggtattgttgatttagtaagaactcactcaagttggcgccgacatgtgaagtgtttaacagatgagatattagcgaaacttgcaagcgagatattaattccaataagtaggcactggatagctcatttccagcatcgtaatactggacgattgaatcattggtaaacgttgctgaggaattcaaaatcttatcaacttcgtttagaaatgatccacgaagcacaagtttcgctaactttttccaggtgaatttagtaagctctgtagagttgggaaactggataaatgcattaataaagcccactaatgatagtagaccagattgtttaatagtaaaaatctttaatacacgctcaaaataagttgaaatgatgccgcctatattttcataaagaacgggatactgttcacaagcttgaatcataaacttagtcagctggaaagttagcaattcaatcggatttctcatctgttccaacttgaatttcgaggacagaacatctgaaattctttgtcttggagtttccagaaaataaggcgcaattatttctttaagcattgtctctaccagatcgagcgtggtagggattgcaacacaaagcgaagttagtacttcccattcactcaatgtaagtggtatagtatatatctttgacgtatttgtggaataaaaaataggcaatgtatgagttatcaaatctaatgttgtaccattactgttttgatcatttggtgcacccgtcgaaagtttagttagtcttccaatagctttcgctcttaaagatgaagaggctttcaatcctctggtaaatctcatctgccttaaacgagtggcgttttcgattgctgtagttatctttttgtgatctaatttttttcttgatttacaatagttattaatgttgaatatgttttttcccacaactcaaacatcttcgcagtattcttgaaaaaaaaaaatactattaacgtaccttcatccctgcgcgtgccgtttgatgatatcagccaaaaggtaaaatgagatgaaaaaggccaatcattcataaatgtacttagagacattaaagaatcagttagagaatataaaacaagataataaaaatggtacgtagatgcaactatatctttccgtttctcattggcggtttttagcgatcgaaaatactaacataatctttttggggggtgagaatgtatatgtgtactggatatgtatattcttggctttattcaaatagttgaaattacgccaattacaaaagaaaaagcaaaaagaaaatgaaaacagcagttctattcagcctaatttatcggcagcaagaattcgtttgaaaagggaccttgattcgctggacctcccaccaacagtgactttgaatgtaataacatcaccagatagtgcggatagatcacaatcgccgaaattggaggtaattgttaggcctgatgaaggatattataattatggatctattaatttcaatttggattttaacgaagtttatccgattgaaccaccaaaagttgtatgtttgaagaagatctttcatccaaatatcgatttaaaggggaacgtttgcctaaatattcttcgagaagactggtcgccagctctagatttgcagagtattataaccgggcttcttttcttgttcttggagcctaatcccaatgacccgttaaacaaggatgcagcaaagttactgtgtgagggtgagaaagaatttgctgaagctgtgagattgaccatgtctggaggttcaattgaacatgtcaaatatgataacatagtttctccttgagtcaagttcagagtaattttcggttgatttgattatatataaacaataaaattatagataattgtgacatactaggcgagttgtcgccttggtaacatcttgctaccgccatcttctgttagtttacgccttatgaccaacattccttatattctcgttcaaacttttgtctcgatattttgcaggtacctgtagaacttaatgtgttctattcaaaataagtataaaatttctggccagtaaaggcaaacaaaacataaagatattaatacgaaaaatttcttgaagaaaacaaaaaatacttcttataataaagaaacagcgaagccatggctattgacaagataatcaggaaggtgagataccctggatagaagactaagagagagcaggaagttgaagaacgcaatctcagctatcgctaattcttacaaaaaataaagatattacaactatggaagaaaaaaatgaatgactatactagttagtaatatttaacaagataacgctttctattttctgtaaaaaaaattctgtctcatgcacttggaagcagcttcaacatttctcttttccagatgtcacattttccggaccggccgtcattcaatcgcaattaaaagagaaaaataccaacaagtgggttgatttacttttgtgttttcaaaaagaccaatagttctaacaaagtagatgcttagaagtaagcaaagtggaatatagagaaacaaaattaagtgatagatttacttttacacaagaaaagagatgaaaattttcaatacaatacaatctgtgctgttcgcagcattttttctaaaacagggaaattgccttgcgtcaaatgggagtaccgcattgatgggggaagtagatatgcaaacgccctttccagagtggttaacagaatttactaatcttacacaatggcctggaattgacccaccttatattccgctagattacataaatcttactgaagtgccagaattagataggtactatcctggccagtgtcccaaaatttctagagagcagtgctcatttgactgctataactgcatcgatgttgatgatgtaacttcgtgtttcaaactttcccaaacatttgacgacggtccggccccggcgacagaggcattgctcaagaaattgagacaaagaaccactttttttgttctggggataaacactgttaattatcctgatatatatgagcatattttagagaggggtcatttgattggtacacacacgtggtcacatgaattcttgccaagtttatcaaacgaagaaattgtagcccaaattgaatggtcaatttgggctatgaatgccacaggcaaacatttccccaagtattttaggcctccatacggtgcaattgataatagggttagagctatagtaaaacagtttggcctaacggttgtcttgtgggatctcgatacttttgattggaaattaatcactaatgatgatttcagaacagaggaagaaatacttatggacataaatacttggaagggaaaacggaaaggtttgatcttagagcacgatggtgcacgaagaacagttgaggttgctattaaaatcaacgaacttattggtagtgaccaattgacaattgcagaatgtattggtgatacagactacatcgaacgctacgactagaagtaagatttccgagaaataaagtttctctctatatatctttgatctcttatttaattattcaactcgcaaaaataaaaagaatattttgttatttcaaaagtaaaaaagtatgtattagaatagaggacatatataaaaatcatatatatcgatgcttgaatgtataaggaaaagcgtcaaattatgaacggtaggtacttaggatgctgatgtcacataaagtcagagggtataactttaaaaagtaattttttagaatcttttagcgtcaaaacgttacacgtacatttgaacagtgttaagagtagattaattcaaattatacttttacgtgctccgatacagtctctacctcttcgttgtcagtgcaaataacaattggcttatcatgaactgttcttggagatggagaatatcctttcagactcgtaatattgatgacggtagttattctgcgacattgagtagtactagcatcccttataaccggaatagttgttgatgtaggtgaactttttgggacataacacttggcagttgtttgcaaattttttgtgatcattgatatgtttcttagtgacatttttgatgctattgtttttatagtgtaattgctatgagtttattttgttgacaagtatacttggctgtcttttttatataataacgaaaatgtgtagtggaaaagcaggtgtgttttgtcttatatcttacaaactatataggcttatatagttttttttcaaagattcttattactgcacaaaaaaaaataagatcccaaattgaacattaacattagtcatattcagggatggctcatcacgaacagcaaactgaataattttcttgtctgcgttcctttttttgtgcaccaatggatgtagtatgcgcacctgatgcgcataatagattgcaattacactgactacaacttacgtatatgcgtttttattacttttctattgcaacggcctaaaggaattcgataaaagaaagagtaggcaagataagcctgaatttggctttcggctgttatttttacttccgctaaattttctttgttcttccattgtttttttgcctttgtgttctccattaatccatccaattttaatgtcggattaatggaactttctattaacccataaatgccacatagtacggctgtagcagtgaaggttacaaaaggacgggtaacacatgagaaacatgcgtcagggaacaaactagatatttgattttgtgacgcaacgcaaaaattactggctattcttttgtagtattatcaaaatccatttaaaatattctctctccttcagtaatcctctattatttatcaaaaacccacagtgggtaaacaaactgcaaaagagttgttattatttctacggatcggcaattgaaaatgagaatacaactaaatacaattgatttgcaatgtattattgcactttcctgtctggggcaatttgttcacgcggaagctaatagggaagatttaaagcagatagactttcaatttcctgtattggaaagggcagctacaaaaacgccttttccggattggcttagtgcatttaccgggttaaaagaatggcctgggttagatccaccttatatacctttagatttcattgatttcagtcaaattccagattataaggaatatgatcaaaaccattgcgacagtgttccaagggactcgtgctctttcgattgccatcactgcaccgaacacgatgatgtgtacacatgttccaaactttcccagacatttgacgatggtccttctgcttccactactaaattattggaccggttgaagcataattccaccttcttcaatttaggtgtcaatatagttcaacatccagatatctatcaaagaatgcaaaaggagggacacttaatcggctcacatacctggtctcacgtatatttgccaaatgtatcgaatgaaaaaattatagctcaaattgaatggtccatctgggcgatgaatgctactggcaaccatacccccaaatggttcagacctccatatggcggaatagataatagagtaagagcaataacaaggcaatttggcttacaagccgtcttatgggatcacgatacttttgattggagcctccttctcaatgattctgtcataactgaacaagaaattcttcaaaatgtaataaactggaacaagtcaggaaccggattaatattagaacacgattcaacggaaaaaactgtcgatcttgccattaaaataaataagttgataggtgatgatcaatcaacagtttctcattgtgtcggcggaattgattacataaaagaattcttgtcctaattttcagggaattgaagaaaataaggaagaattaaattacaatttaaaaagaaattgctttagtattttatatatagacatgcagcaacttcttgatatatttcaggaagaaaaaaactgtttcaatatatacgtatcttctgctttcagctacatttttacttcagagacataaccagtcttttttcatcagtactgtccagttgtaacaacatagaaattacaggaagtaattggttccgttgttccttgtgctccaaaaatcccaacaaaacattttttatatatgcaattttttcatttttctcagagtctaactccaatgaacttgatgatcgtatcttctctaatttagttggattagagttattcgctggtgaggaatcaatattcgcgttagctagagtaccgatagaaccagacctactaactcttcctgacttgtcactgtattgtctttcctttaaagcattcaattgagaggacaatgaacgataattttttagtaatcgatcaaatttcttgttaagttcgttatttaaattcagaagtttctcattggcagactgtagctcaaaattcttttcatcagccttagacaatgagagttttaaattagatgtgatctgttccaactgatcggaatcatctgaagtggcttgagtcttccttttgatgtcattgttaacatgtttcaatgcgtcaacctctgattttagtccctcttcacgaagctttaaagcgtgtatttccgatttcagctcagttactgtatgcttccactcttgtaattcagtggcctttctggatgtttgtaagtctaattctgcttccaatttattcttttcatccgttaaataggccaatttattctccaactctttttgtttgctcgaatcatctgtctgactgtccgaaactaaccttctcaatgtgttagcttctctggttttgtcttgaacaatattagcatattcatttagttcatcttctaaagataaaattttttttgtagattccttcaacttgacatttagttcctcacattgtcttttgatagaatctatgtgttcattcgaattactttttacattttgcaaggtattgtatttttcttgcaaaatattcaatctttccgataatttaccattttctttcaaatactcctcgtaggaattagaattctttgcgatatcattatgcagtgtctcattttccttttttaataagtctaatctgttagaaattttagcatgatcttttctcagctgttctgtggatttttcagccacgtccttttgctcactaaattgtttaacttgttcctccaagtaactcacagttttctccttttgtttataagaggttcttaaagaagtaagctcctttgttatgtttgatttttcgtaggtaagttgagatatctcctcatttaatttggctaccttgttctgcgatgtagtctgctctttctccttttctgtacataaattcttcagatgctctactttcttgctcaataactctatcttacttctcaactcagtatttttagcttcgtaggcctcgatcatcgttgcatttttatggcgtaaatcatcgagctccagcttaacggttttcacttcttcattttgtttactcgaagactctttaatctcatcttttgcgtccacaagctcattgcctacagtcctcagcatatctctcacctcctctagctccgaatttttttctttcaatgacttcttggtatcgatcaactcggtgttaagggtttccagctcctttgctgatttttcgagctgtgagttttccaattctttagcatcttttagttctgcttctatatcttcatacttttgcttccaatcttcacaatctttatatttttcttgtaattcttgcaaattttctttaagcttatcatattcttcagtattgattgagttatcgaccgtttcctcttcactgatatcacccgtagttatgcctcccttatttttctttcccttgtttctattctttttccttctgttattgtttcctacattttgatgagatatcgccttcggtaactccttcatttttttttccaattcactcagcttgcgctctttctcttttaaagtaatatttagttctgccaactctgaggacttttcctccattatagtacttttcgaagacaaattttgctccaattcggttatcttcattcgactgtcctcgagagaatggttctttatagccaattcttccttcagttcggatatagatacttcttctttctgttttttggcctccctttcttcctttagtatattttccagtgcaactattttttctctcaaacctgaaacagtatcatttttttctttttgtacagtatccaattctatgtttaaagcttccatttttttttttagatcgtctatgtcatttttataattttgctcttttttcaaaaattcctcttctttatccttcagagtttcactagaggcgctttctggaatttccgagttctgcttagttaatctcttgatctcatcattcaataggttatttttgttgtttaaatcctggaaaaaagctggcaacgtatccactgcgtcgtcaatattagatatgggtgtattttccgctaaaatcttttcaacagcctctaacttctctgactttaatttttcatttttgtatgcggagagtagcaaagggtatttttgttcatatttctcaaattttcttaatttagcttgtatttcttttggcaagccactcttatcatcttcgatttgttgttctgacggggtagggctcatatcatcggctaagcccttcgctaattcatcggtaagattcttaccaatttgtgacagctgtttgaacattgaatcagcaaatgtttccctaagttaaaatcacctcaaatgtaactcctgttgcttactatttgacgtttctgctacatttggttctcttatattgctggatctgaaaatccgaactatgagaatgcgggtaatagcttttcatagaatcactaattgatattttttcaggtaataagtttcctctaatcgggcatttaaaatcttggatcgataacttaactgggtgtaataaaatatataaagatataaaatagatatatatatataaaacgaactttatcaagaagaactgcaaatgaagcgtactctcaaatcctcgaaaacgaaaaacactccaccagtacagtattatcacgaagaatattaagtaaaagcagccatcttaaataatagagtgtagcaatcaaacataaagctaaggttcttcttgattagcaaattgtataaacttttatcgaaataacctagaaggaggttttttcttacctagcttcaaaaaattgccatttttatcatctgtaaattcacttaggaattttgcagtttttgtaccgctagcagaagaagcatgcgtactgcctttggtgtttcctgatctcggttccacttgcagtgataattgatactgcttttcaatgtgggggacattttccaaagacgcttctataacggtctgaatatcatccaatcgtttcagcttgtaatggaatcttttaaagcttataatttcctccactatatttgcgattttagtcctcttgctgaagtttattatgttggttgaattgtgaagaaaatctgggtttccgacaaacgtaaatgttaaatcagataggtatacaccaaaaaagggaacacatgcaacgtccgtcacggatcgcaacagctctctatacttcacaaaatttctcttggaatccataaggttgtttaggttcttcagaaggtccttcgactcagtggaaactaaatcccatgtctttttcagtcggtagattggggaggaatacaaagcggacactatggcagtcattgaagaaaaattattcaactctttacaatgctgggcaacggtaacaaaatattgcgttaattttgaacgtgtcttgacatctgcctgttttacaatggtatgagaaacaaaattagttagcgtattagcattagctataaatttcgtaatgttcggagaaccacccatattacaatacttggtaccccatgccctatccaagcattcaaacatagtgatcctgaggtataagtcatgttcaagtacagtcaattgtgtggcatatgtgtatgggtcaatatccaagagcttcaatttcttcaatctaaaaaacgctgaagaagcagaagatggtaaagaagacgaagacatgtgtatcggtgatttattgtcacgtttagttgtctgtacgactgccgataccgaatcttgttgcttaggatccactggttctttctcattctcatttatcagtttttcatttatcttttgcaaaagatcctctgcccccggtattttctccgatacaaccatcttggcaaaatttagaatcagtggtatgccaggttcataataatttcttgtccaatactgcgtcaaaaatgttctcataatgttgaccacacggcatttaatcgggtttgactttttttctatccaaatattgtaatcatcgtaactcagcccttcaggaggatacaagttgtacctgtaaatcagggcataaaaaaactctcttgtggttaatatacttctgaaagttattaacattgtaacattgaaagccgcatcaacaagttcatgactggttaaatgttcaatcagtgcctcttttgtcccgccacgaatttttcctcttgagtcatagacaagactagtttcataatctgaagttaaaaaccatggaaggtttttctctatgttcgcagctttgcgttcaatatagtcctcagatcctaattcgtcatcgatgatagcttcatcattttctgaatcgtcatcactatagtcctcggaataaatatcaaaccatttttcttgctcacctttcaatagttctgcagtcaaattattcttcatcattcttgctgcgtagttcagcaaattttctctttcttcaatcaattgatcaacaataatacacgcaagattagaaatctcgacatacttttcacaagcatctttaaaatcgtcggagttgtttaaaaattcaaggttattgaactccacatcttgactcaccaatacgtgaaataaggagagtgccaattgttcattttttttatggaaggggcccttgaccaaaggtgtattagagatattcttgaaaggttcatgatgtccgacagggaaattggacctcattgaggaaaacaaatacgggtcgtctaaggtcgtttgttgcgttgtcattattaatctgatgacgatgtcatgaaaagcctgctttatatcaaaaaactctgttagtactgaggagaccgaagacatggcgtgaactaaaaattcctcgctttccaaatccaacaaaatactgggtgtcttaatcaggtttttcaaattgatgaaaattgacagatctaaattctccagtatctccaatagtaaaacattctgatttatttgttcgtatgtgcttgaatttatttccaaattcctaattctgcttttgggtttacttataatttttaagtgttcacctgtagcattatttaatttttcaaaaatttgcgaggatttcttcttcattgtattcaaagtgtctacagttaatggatattttttcttcctttttgaaactcttgctcttgaaaaggttctgttatgagaaggacggttgaaaggtgtaaaaactgaaccagacgcggcactgcttgcttttaaatcaatttgggaatttgtttctgaattagcgctatatcctgacgcagaggcaatagcatctgccatctttggtggaatccttgatattgaggaatttttggacgacgaagcggtcacttcattagatgtgacagctttgttctttgtcgcattaccaaattcatccgtaataaaagtcgaaaatggatttgtccaagaaccaccgctaaatgaacctttaaaaaatcttgggagcaactgtggtaaagtattatcatctgagaagactgagctctgtaacacaaaataaagtaactgaacatgccttaaaaatttcgagaattccacatcaaccatttcgtaaatcgatttagctgacttaaaatttttgttggacggtgaaaaatcttccaaagtagaattttgtattgaagtccttggtgttacgacagaattaacactatttcttggacctaagactgagaaattttccatatcgttctcattgactgtactgaatgatgatctcattggagtcaatgtatccgttgtactggtacttacattacgtttaccggacaatggaactgaaactagatcatgtacactatctacttcaattttaccatcatccccttccgtcctagaacaattattttcctgattatcgttatccttgtcattcatagtatccattttttttctgtgaaaagctgaatcgaaatataaatgagaattgatacttatccttgacaatgaagagattagacctttgaaaatcttcttaatctccttgctgcaacttttggctttaatttcatgttgcattagcctgcagcctaactgtgtgaagactattgaatctgatatcaaatcaaagtatttcgtgaaattgagacgattctctttaaggaacatcttgtgagccgttttagtataataaactgttaggtcttgtaattctgtccacaattttatatctcttgaatagtgataaaagatgtcactcttggccagtatagaagagcgacttggggcaactacccttgattgaatattctgcgttaaatctggagcagataaagaatttaatgatgaaggaccagcctcattgaattcgtttttgttattttcgttattattatcatcatcattaatactgttattatttccatcagtttcttttgaatcctgtttttccattagaaggcttgatctattttgttcactttccgattgcttcgatctcgtagaactgtcctcaatattcgcatttttcctcagatctctagtatataggttaacaagatgatcattgggcgggaattttggttcgctgtcacaaatgtcatcggattccataattgagttagaaatcaagggtaattctgaacagtatatatcaaggtctttgttatagtataccaacttgtaatcggatgttttcgttatcagtggtatgggggaccaagtcgaagcaatgttcgaacgtataccattaataatcatttctatctcttccaacggtaatatcttaattgtttcttctgctactagtgggggacctgctttctcaccagaagtttgtaaatttgtttcattgttattcataattgcgtttgtattcatctcagatgagccatctgcactctttgtcatatcctgggatagactagcattggaattaaagttcgaagattgaggggttatgtgggaagcatcgtttggcgctgaaaagggagaattattcatcgatacggtgttattgtggccggaacttgtttctgcattgtgggcatttgataaagacgctgataaagtagaactccccctcctgctcttgctcggatttctaggcacatgtaaatatgcactattgcccaagctatttaagctgctgcgccttgagctcttactggaactatattttttcatcggatgactgtgctttctgagatgactgtctcttaaaggtctaccgaagttttgaggaaaccagcctctgttaactttcccattactgtcgtcaataactaatccatcccaccacccagatgagtttttgttaagtatataaatggtttccccttgttgtacagacaaaagttgcgaagaactgtcttttttaatgggataattaaagtcataagcagcgactactattccaattggacgaatgctggtcaactcacttgtcgagggggaagaagaaagagaagctgaggatgattctgtgttagtggtagtggaagtgttagatgaagagctgatcgatggagtttgtgaagcattgcctgcctcccttgcagaacttgtattgggaatagacgtgttagtatcggacatgatacaactatccaatatccaccttgctttttcgttttattttttagtatttattcgaagaaaaatgtggctctttttattcaatttctttccgaaaaagaaacagtctatctaactaaaggaattgcttcacggtgatcaagtcactataactgtctccgccgtgttggtgatgcagttttctctgtaacttttgagcttatttttctattttattttttcctccaggtctctgtcaaagatccgtctcccgcgatgtttaaaagtcgttttagcgaattacataataacctggaggtgactgacgtcgactattttctgccccataaagcaacaaaatatttaactcataaaagcttcgaagaatatgtaaatatagtagtatgaatctaactgagtaaaaaaagggaataacaaaacaaaaaaaaaggaaaagagatggatagcatacgttatgaaagtaataaaaccttagagatagagatagagagagagagagagagagatgcaccttttctattctcaataaaaaaaggaaagtaagtgtaaaaaaatttaaaggagggatatatgacactcctactaagcagtcgttttttttttcttttgttaatttcattcttcatgctgggttttggatgatctagtgtttgcacttaaaataattttttttcctgcattctgacatcgctttatacatcctcgaatgctgtaatttcaatccgaaccgtttcagctgctttacaaaccagttggtatctttgcgaaccttaaactgaaaaactcggaatggtttcattgacttgaaacgaagcttgcgcaactgcaatctggatcccgaccaacattgttttgctttttggcaagaatgatcgaaataccttttaatatgtggagaaaattgcctgtatttattatgaagtagcacaaagagccttttccagcggcgtttctgttctttatgcaatacccttaaactttcttgagcggatttaaaagaattcttgagaaataggtgtaactttattcttcctccgtttattttgttaattctcttgtgccaaccgtctttcattcgagcttttgttgtataccataaaataactaagtctgttttgtatcgtctccagcccattaggtcatcatcctttaatgggtatgcaatatgattgtcgaagtcgacgtagtattttcctgaaggagcccactgacttaaagagtcacttgatgaatcgtaagattttttatcaacaaaatcgatattgccgtacaacagcttcctttcattattacgtaatgactgttgtgatttaaaacctgccaacacatcaccagtcagggaatattcgagggcgaggtatgaaaaggtcatggaaagcaatgaagatagcatgataacatgccacatcttcaatttagcagatttaccctcacttttatctatgatatgatccgatagtgtgctagaattccttatcgtactatccttcagtttcgacccctccatacttggcaataccgttccgccaacatttgagccggacaaagtatcaaatgactctgaaatagtgggaactccagtttgatcaatattaactccagcattactaaattcattagatgttctaaaatcgtaaatacgattcatctgtgcagactcttcactgctagtgttcgataggacatctgcatcgaagtcctcgtcgtcctctcctgcaaaggagctttcatgcaaactatccaaagatatttctgacttcgatgactgttcttccccttctctccctttacgtaatctacgtaatctaactaaattccaatgatcgtcttcttctgacattttaggtccgacaactcgactgttttactagtctctattatcgtcactgcgtattactctgctactgtgcttgttactttataccggaacagtagctcctaaacgattattccaaatgaagaaaaacgtttggccagtaacctgcataaaactgaataactataatgatactccgactaataatatatcccaatgccccatctcatctgtgtagatcaatttttatggctcgatccaggtaccttgataagcagctgtcgcgcaaaggggttaccgcaaaatggatagatggaccgggggcacaccggggtagggggtccggagggttaactgtcaactccacccatacaagaccgcgcagaaatcgtcgcaggaccccgccgaacggcgaaagcaaatatgcagccgtaaagacctaacaataaacctaatgtagtcatagggctaattgattttaaatatatgacctagctgactattcaagtttgccctaattgatgagtttttgaaaaaaaaaacaacttaggtttcgctatccaagcttatgctatgggaagcgttggaaaacttgcatatagtatgaacaagagcgagatataaaactataacggtagatggaaagtaaagagtagacaagctcggaaacatggaaaatagcatgatgtttatatcgcgttcttgcggagacccgttactgctttgaactgcaatttacaaagcgttagaacagtcatataccttcataagggtccgagaattaatggtttgagacgagatccagagtcgtacttgagaaatcctagcggggtactctttactgaagttaacgcaaaagagtgtcaagacaaagttagatccatactacaattgcccaagtacggaataaatttatcaaacgaactgattttgcagtgtttaacacataagtcgttcgcacacgggtcaaagccatacaacgaaaaactgaatctgctaggagcacagtttttgaaactacagacgtgcattcattcgttaaagaatggttcgccggccgagagttgcgagaacgggcaactttctttgcagttcagcaatctgggaacaaaattcgctaaggaattaacgtccaaaaacacagcatgcacattcgttaaattacataatctagaccctttcatattttggaagatgagagacccaataaaagatggccacataaatggtgaaaccacgatttttgctagtgtcttgaacgcatttattggtgcaattctgtcaacgaatggatctgaaaaagcagctaaatttatccaaggaagtttgctggataaagaagatcttcattccttggttaacattgctaatgaaaatgtagcatctgcaaaggcaaaaatatccgacaaggaaaataaagcatttctgtgaagatacaaaaaatatagttgatggttcactggccaaaaatgtataaaagaaaaatttatctgtaaatagtgatcgaaataaaataagataataactaaagaatatatatgactttactgtacagatctataattgaaaaatgacgagaggtcctgtgaaagagtctgcctgttcgccatcttcacacattcaaccaattccctggtgcgcttggttacttccatcaggatatctgctaatttttgatagaatcgtttcttcccaagctttgtggaatcgcatccataagtacacaattccgataacttttgcgagcaatctgtgagcctttcaataatttctttacagtgctcgcctaaatccagtttaaaacttttttggaccattgctttggtagtcatatcaatcaccgattccaaaataggaataatctcgatggaattttgacataatctcgaaactgatcttgcggacttgaacaattttgatttagaggcttgaacatcattcaaaatgccctgcctgccataggaagaacaaccattgatttactctcaacaaattcgacgaggttatttatgttagcgttgtgcgtggttgagttgacatcagaattattcaagttttcttctgaagtagatattcttaatccaagaccagagttgggagcaaatttctgcactttctctctgaatttcctcattttggtcacggttggcgagtaaagtacgtctgcagctggcggaatatttgcatacggcttcgccgtttctgccactggtttagtgataactttcttcggaggtgatgcctgataatcctgccgaaatttaccaattagcggcaatgtgttaccttgaggacttggacttctcgagttcgagacaactttcagaggcaaaccttctcgcggagatggctcactcgtaattcttgaagaattcttagtgttttttaacggcgacacagacgctaagtttgtttctccagatgtattatttcgtaccttcccactctctcgaatagaagattcagatttttctatgatggaaattgatggcgatgctacaaccactggcatgtccgatttttttgtaatgggcttaccagaggatggaaaactaacagcagtactaccgctatcacccagagatgatatatccttaccgtttttctcatttttcactttttcaataatcttcaacggtttcatacctgcctcgatatcactgagttctccttcattgcgtgatatatcatcacgtgaggtggatttgatcttcacaatctgagcaatattgcagaacgcaaaaatcacttccgaaatagatgattgagctacaattcgtggtattaggtccccatatgtgagaaaatatcttgttgaagtgatagcatgagataaagcactctttaagtatactatttcgttttctaaagaactttgcagtgaaactgatgataggacaggtaagagatcgcctatcaactttgctatcttaattatagtctcaagcagaatcggcaggcgtgtggtggtggtatccacaggatcaattcgatggagcgtgttttgaaaataaagtgtaaattgagtttttaattctcggaagacttcaatggatataataccattcacgctcataaaatcatcgtttattttgaaggattcaaataatgtgtcatttaaatagaaatttagatcaccctcgtctaacccattgttatgcgtccccatatccaaatgatgtaagtttctcctttcaatttccgtgaaaatatcaagaatcaatttatggaacttcgcgtccttcaatcgagacagtttagattgtgctttacctcttttcagatcaagatcatttagtgatgcatccgcacccgaatctgtcaatcttttcatcaattcatcgttgacatcagtcgtcagttgccaaaattgtacattcgacaattttgtcaggtctttatttctattttggcggttttggttccttcttctatcatcttctggtacagaggcctctataattcttttgaaattcttataatccgatataaggtctatgatttgatcattcgttaattctgagctaatcattctttttatttcgttatggccacattatgatattcttttactttactgttttaattttatattctgcgattcaaatcataacagatatttagttgaataactctgtttttcttcatttccatttttttctatttacccttcttctttttattttacgcgtctcgcgttttatatattaatagtaataatatttaatagtgtatgtttgaaatttttatatgtctttatttcgctaacgtaaaaatcccttcttctttgtagggacgggggagtggttaacattgggagaagcactatttattgaaagttctagctgttttttcttgtcctccaaagcttttaattgtttagttaatttttccttcatttctttatgtctagcaaacaattcagtttctgatttttgtagttttttctccttttcggaaactttttgttggaaaactgttttcatttcaatttctagtttggctagttttgcctcatgtaaagttttttcttctagttgtttagatattggatcgaactctttgaaaactgaattatcttgcttaataccaagttttgccaatttagaagacctgtagttttcgtatagtatcttgcttgtcctttcctttaattcctccatgaattgcttgatcaataaatttttcaaaaggttgaaatcagagtggttgtcattgtccacttcgatcaccccccatggataggaacggcctctcacttgattaccactgtagttctctacaatatcgttggaaccaataacagcataaggtaaactactaaatagtctttcggataaatggctattttctgcatcatcgttggaataaattggaggcttgaacagctcgatattagattggattaactggttcataatggtcttcttgaaacttaagatctcttcatcagttaagatgtcagatttagcaatgacaggaatcaagttacatttttcatatacagattgcataaacttcaggtccaggggctttaagtaatgtcctgtaggttcaatgaaataaagacatgcatggattcttttatcgtttattgaatgtctgttgattttgttctccgcatccaagtattgatcaaaacgagagtcaatctccttaatgatcgggtcccatgatttttgatcattatttaaaaaatcaccaaatccttcagtatcgatcacgttcaaattcagtttaacaccattttcttcaataaccgactcatatgacttaattttgaccttgtgcctttgttcttgtgattggttctcgtgaccctcgccctgaccctcctcttcttcctgatcatttgcaagttcctcctcgtaatctttcactaaattggcctcaatatcatcattattaaataaagttttcattaaagttgtcttaccaataccatcagggccgacacataggagattgaaactgaatccgttctttatggaccttctgtgccattgcttgggcaaattagcaaaccctacataaccattgatttgacgacgaatgaacttaatctccggttggtcaggcagaacttgacccttttcgctctgagaggaggtgatgcccataccgaggccgggttccacctttacatcggattcagctgcctcaaatctctcgctgtcgtcattttgcgtaccgttcgtgtactgcgagtccactccatcatgatcctgcgactcttgtttgatctgaacatcattgaattgatcatgctgacgctcttcttgttccgggtcctgcttaatggacacttgttcctcctttaaactcatggcaacgtattataggccgatgtaatcgttcagttgtcgtgtgatcctggatttgatattttcttgatctgctttcctcgagagattttaacttaatacacaaaacaacacaaaacgcaattcctaaaaccgagacaaaaaatggcaaaaaatgggaagcgaaaacacgcccccaccatatcattacacacgtagatcataaaagacgaaaatactaaattagccgcccaggtggttcctttttacgaaaggaaggaaggagaaatctagaggtgctgctatatatgtttgcaaggtgcgagaatattctgtcacaattatcaagcagcaagttatataaagttgtttctcacagcttcttgcactcccttgcggtgcctttcctgcaccactagtgtaactgctgatgtcttccatttgatgtcagaatcgatttcttgttacgccacgaacagttaatatatagaattaaaggaatgatcttgtacaactacaagataacaatagattaacagccaatattaccgtcgccgctgcccgcttcgcggagaaacagcgaaaaacaacgaagatcgttctcgaaaaagcccaaaagctgggtataacgcaacaaaataatcatagatttgacaattgtgctcccaatcttgctttgaaattaccattataaatgaactctgaacagctgctgcataactatgtttcggattcgctactcactactctgataagttttcaagagttcaagcagcaactacagtcgtacacgagcgacgagcaacaactgcaacattggtacgaattgcttcaggccagggatgcgcgagtgacctctgagttagaagcacgaatcaagcagtttttcataacgttgcgctctagattactgcgatttctggaaagcgagcaactatcacactcccttagcctcgagacactgatcgacgcgctgtacaagattaatgacctgttgcaacagcgtttgcagattctggatgatgctattcaggaaaagacctcggaactagcagaatttgaaaatatggttcgctcaccgagtgcaggagacaatgccattcctggcctattacaaattatacaatcttatattaatctattagaggaaaactagcagcagacatcccggtcaacctgccccacaggatattcctcgccgatccattgaaaggcttcgtatgttgagtttagctgtttgttatcgttcatgcagtacccgtcaccactcgttaattttaagctcccggtgcgctgcatctctgtaaggaagaccactcgtctcacacgagaatggatcagggccatggagcacattgagcacggctcatgggtcaaatagacgtcgtaatcaagacacagataagagtttgcgtcttcgtctacaccctccctgagtctttcgcctaccgcacggatgcccaccattacactgtggtcgatgggtagcgagttttcgcagtttctgccatcttctgccaccactttgtccttctttcttgatgggtcaacaaagacgctcaccattggaaactgttttcctgccgttgccatcttcacagacaacgtcgacgcacgcgatagctcatttcgtacttcctgcatgtctattttatagtcgttcaatatttgatcattggggttgccgttccaaatcaacggccagtacttcacagaccaggcattgttcagttcctttgtgctgggcgcaaactcaggcacttcgatatcatcactcagttcatactttttcgttccaacccaaatactcttcaatttattgtttatttcaccttcgtcgcaaatatactctttcgaacacaacaccacttccaaggtggaggtctcgatgtccttgcggatccttttcaaatgtctcaatgaaacagggtcatttttctgaaaatcgtttcgaattagcctactttactagttagtttacttccatgaatacaaaagcaaaaatcatatacatactctattactttcttcgagtctcttggatctattcttatactccatacattgactgcacttatatatgtttgaaagttagttaattgatcctgatttctgttagatctcatagatacatacttagtttgggcgtatttacatctttgaaatttctaatttgcagaagccgattttctattatcccgttctgataatcgatttttagcggattattaactttcttaaccataactaacacgccctcatgaatattatccttctgaggtttgaataatatatacctttagatgagctattggtgattcgcatttaggaatgaaaaaaagtaaagcatggcaatgaatgacacaagtgaaatagaaaagtgaaaaattaaaaaaaaaaaaaaaaaaaaaaaaactgatttatactcatgaaaatcttattcgagttcattcaagacaagcttgacattgatctacagaccaacagtacttacaaagaaaatttaaaatgtggtcacttcaatggcctcgatgaaattctaactacgtgtttcgcactaccaaattcaagaaaaatagcattaccatgccttcctggtgacttaagccacaaagcagtcattgatcactgcatcatttacctgttgacgggcgaattatacaacaacgtactaacatttggctataaaatagctagaaatgaagatgtcaacaatagtcttttttgccattctgcaaatgttaacgttacgttactgaaaggcgctgcttggaaaatgttccacagtttggtcggtacatacgcattcgttgatttattgatcaattatacagtaattcaatttaatgggcagtttttcactcaaatcgtgggtaacagatgtaacgaacctcatctgccgcccaaatgggtccaacgatcatcctcatcatccgcaactgctgcgcaaatcaaacaacttacagaaccagtgacaaataaacaattcttacacaagctcaatataaattcctcttctttttttccttatagcaagatccttccttcatcatcatctatcaaaaagctaactgacttgagagaagctatttttcccacaaatttggttaaaattcctcagagactaaaggtacgaattaatttgacgctgcaaaagctattaaagagacataagcgtttgaattacgtttctattttgaatagtatttgcccaccattggaagggaccgtattggacttgtcgcatttgagtaggcaatcaccaaaggaacgagtcttgaaatttatcattgttattttacagaagttattaccccaagaaatgtttggctcaaagaaaaataaaggaaaaattatcaagaatctaaatcttttattaagtttacccttaaatggctatttaccatttgatagtttgttgaaaaagttaagattaaaggattttcggtggttgttcatttctgatatttggttcaccaagcacaattttgaaaacttgaatcaattggcgatttgtttcatttcctggctatttagacaactaattcccaaaattatacagacttttttttactgcaccgaaatatcttctacagtgacaattgtttactttagacatgatacttggaataaacttatcaccccttttatcgtagaatattttaagacgtacttagtcgaaaacaacgtatgtagaaaccataatagttacacgttgtccaatttcaatcatagcaaaatgaggattataccaaaaaaaagtaataatgagttcaggattattgccatcccatgcagaggggcagacgaagaagaattcacaatttataaggagaatcacaaaaatgctatccagcccactcaaaaaattttagaatacctaagaaacaaaaggccgactagttttactaaaatatattctccaacgcaaatagctgaccgtatcaaagaatttaagcagagacttttaaagaaatttaataatgtcttaccagagctttatttcatgaaatttgatgtcaaatcttgctatgattccataccaaggatggaatgtatgaggatactcaaggatgcgctaaaaaatgaaaatgggtttttcgttagatctcaatatttcttcaataccaatacaggtgtattgaagttatttaatgttgttaacgctagcagagtaccaaaaccttatgagctatacatagataatgtgaggacggttcatttatcaaatcaggatgttataaacgttgtagagatggaaatatttaaaacagctttgtgggttgaagataagtgctacattagagaagatggtctttttcagggctctagtttatctgctccgatcgttgatttggtgtatgacgatcttctggagttttatagcgagtttaaagccagtcctagccaggacacattaattttaaaactggctgacgatttccttataatatcaacagaccaacagcaagtgatcaatatcaaaaagcttgccatgggcggatttcaaaaatataatgcgaaagccaatagagacaaaattttagccgtaagctcccaatcagatgatgatacggttattcaattttgtgcaatgcacatatttgttaaagaattggaagtttggaaacattcaagcacaatgaataatttccatatccgttcgaaatctagtaaagggatatttcgaagtttaatagcgctgtttaacactagaatctcttataaaacaattgacacaaatttaaattcaacaaacaccgttctcatgcaaattgatcatgttgtaaagaacatttcggaatgttataaatctgcttttaaggatctatcaattaatgttacgcaaaatatgcaatttcattcgttcttacaacgcatcattgaaatgacagtcagcggttgtccaattacgaaatgtgatcctttaatcgagtatgaggtacgattcaccatattgaatggatttttggaaagcctatcttcaaacacatcaaaatttaaagataatatcattcttttgagaaaggaaattcaacacttgcaagcatatatatatatatatatacatatagttaattagtactaataatacatgaaatactgacagcttatgatgctgataaggaaaatattgccgcaaactttgtaataagccaaaagcactaatctcttttccgttagctttcataaaattagtgtatttaagtaaaccccggcccaaaatatgctctcaaatttgcttcatccttctgctttcttatcctttctacttcttcaaagcctcccgattttttcaggtttgaattacccacaaaattttccagttcatcatcaaattcattactagctttaagttttctttccatctcccacatcttctcagccttgtcaatagcttcgaccctactatcgtggtcagggtttaaagattggacggccaccataacttgctcccttacctgattaaatgtgcccggtctcataataggcaaaataggattactttttgatctcgaagggtttttttcttgttcttcacaacataacttaataagatcgaaagtttctaatgccttacccaagtcttccttcaaatctaaaatcaactcttcctgcaacgtgagaaactgttgttcttcacagaccttatcgagctcagcttcccaagtttttttccaatgtggtttttcagtatcaataaactcctgtagtttaagtacatctgcttgggcattttctaaatccttggatacggtttctagcttctttttagcgggctgagacctacgctcagcaacgtctttcctcataatttcgattacatcttgcaaatcatctactttacttagcagagtatcggataaatcaccgagttcggtctgtgatttttccatgtacattctgttggaagagtttttggcagaaaatgataaagacttaaagttatcgacctttcgtaaaatgttgaaaatagtctcattaatatttgacctattaatattatgcacttgttttattttccccaattcgtactgaatatctttgatcgttttatcatcatcttttttgttttgccccacaagatcgtgtttgttagcttcaaggccaggttgtggtaaaacttccgtttgcttgccgctaattgcagaaccaaaactcatttcttttaaatgtcttattatatcattctgactattcgatatctccatcttaactgtgtcaatgaattccttgatcgtattatttggattctcttcgagctttagctcgataacaaacccttctttaatatcgagaagatttagttcctctaattcatagaatactccatattgaggatccataatatatatgtctgggaaggaatttgctccaggagaatacgcaaagcgctcaataaataggagccttaatgcgttttttgtagtaggcagttgcacatgacacttctttgttttgtctcctatccttaaaaatactggacaagttccattcatggctttatctggcgaagttgtaacaacgcttgataatcttcgtggagatgcacgaacattctcaataggcaatggcgttttcgccaatggactcgcctttgatacatcgtcaatgcttttacccttattttcagctgaattaatgtttctatcatcatcattgttgttatttccgtataactttgactttcttacggtttcctctagatgcaacatcgagggtgaaggagttgtcatgaggccggcagccgcagcagcttctgttgtagactgatttgtcaatttagccatatggtaggcagagtatctctttgaggctctcctttgtaaattagttcccttcttcaattgtgaaagtgcatcatcatcatcagatgcgtttggagcattgttagatttaaggttttgtttaatattagttcttggttttgtcaatgttgcctctgctgactgagcagagggtgttcccgtagaagtagaattcactttttccccatagctgttttcgactgaatcgctttgcctctgatcacgtacaatactgctttttctgctacttaatggagtcccctcacgggtcccttcactacccaatgaaaggttactagtaaaggaagggttttgttgatgatgtgattttacacttatccgatgctcttgctgcatattcttcaaaattgcttgtttaacctttagtttgtctaaaagtgtcactataatctctctgatttttggcagatgtttatttaaagtttcatcagatggtggttccctcaatgtcacttccaatacacgtcttaaagccattggcacatcaccaacatctgacatgtcaactttcgcatgcatgaagaatttcgatacgactttgaagtcattgcccaactgaacgtatgcatcagatactaatcttccagaggttgtccccttagaccattgtgttaagacctggaggaggtgcttggtggacatcagcaactttgttactgtcgtttcaatactactactgctagaagcagttcttttaatctttggggtgccatacgtagggtcatccacggccatcttcatctaattttaaaataatacgaggattactacaccaatttggcagccagcttctactctttttcccttttcttgggtttgttttgatgccattatctcaagaatgcataatagtaggataaaattcgttcagctcggctagcgagatatcttcaaagagtaaagcgcatctgcgtgtaaaattaaattcaagaagtgaaagaataaaagataggattgtagatttgaagtttagtggtagcgtcagcagataagcttatggatgttgatgaaccgaatcctattgtgatatcagattctgaggccactgatgaggaaattagtatcatatacgaacccgaattcaatgaaaattatttatgggcagaggaaaacgtccaagaagcaagcagatcacagaaaattgtcactgagaggttgagcctggattccactgctggagaatcttgtactccttccgtagtaactgatacacaagttactacggggcttcggtggtctttgaggaagaggaaggctattcaaaagatgccatacagtttagaacgcataaagcataggcagttgctagagggctatgatatctctagttttgacagcatttcgaatcagttgaccttaccgaagaacgcttctacagtgattcactcaaatgatattttacttacaaagagaactggtaaacccttagatgagcagaaagatgttacaatcgactccattaaacccgaaaacagctcggttcaatctcaaagatatgatagtgatgaagaaataccaaagaaaaggcatcgtacttttaaagacctcgaccaggatatagtatttcaatcaggtgattctacggaagatgaacaagacttggctagtacaaatttacagaatactcaaaatgacgaagtaatatttagaggaagagtattgaatgtaagaactggttaccgtggggtcctgccaagagttgcttgggaaaagtcgttgcaaaagcagcagtcttcaaaagtcacgaaaagaaaaactcaattattgaaccataagggtgtggctaagaggaaaatgaacagaagcgcccatattgaagatgaagaacagaacttattgaacgatcttattgcacctgatgacgaactggatatcgaggaaaacgcccctccagatatatacttaggaaatcttccagaggatcgtgaggctaacgaaaaggaattaaaggaattgcaagaatattatgagagcaagtatagtgaagacgcacaatcggctggaacttctggttttaatttaaatgaggaataccgcaatgaaccagtgtatgagctggaatatgacggaccggggagctgcatatcacatgtgtcttataaagaccagcctattatttatttgaattcacggcattcagatagcggatttagtgagcaatacaatatatctgccgaagataatcaaagtgtaatttccctagatgctgctgaagagcataacgatggtataattgacaagatgttggttaaacctaaaagaattaaagcaaccaatgatgccaactttttgaatacaaaaagtaagagagtgagaagatataagtacaaatatcgaaattcttgtctggccccaagtacaaaagctatcaaagtcggaaaacggtcagcgcataaatctcatttggcagctaataatccagtttcatttgtttctaagaagaatcatgtaattgatgattatttttttgaagaattagaatctcaatccctagaacaggatgacagctcttctctcaagccacagaaaaaaagaaggaagaagaaagcacctatatactcaagtttctccgctgatcttgaatcgagacgaaaaccagttttcaatactgttgtagaggttcccacgaaccgatacgctttcacaaagccaaatgtacgtaatagggacagcattaatcatgacatggaatttgaggaagaagactccaatcaagagcttggaccaataatggtcgtacttgactcaattttactaaaaaaaccttttgagccacctaatttcttcaagatccagttgtcagacaagagtttcttgctatcaaaattgaatcctgcagatatagctacatcattacagaaaatattcagagtaatcattgataaaggtatcactgatactgaactagttcactttaacgaaagccttattgcttttttggtgcaccttgacatgcctgaactattcgacttaataggtgaatttcatcgtgaatttagatcgaaggtcaatagcttgaggaaaaaagctaaaccaatccatttttttcaaattgcggcatgccaattaatgtttctagaaatatcaagatataacaaaatttcagccgctgcaaaattcgacatggatgtcaaactcttagatcatattgtgtctttcttcaaattactttctgtctgttatgattctgttatgaaaaatccaatgcaatatctgtacacaagttattatattctctctgctgtcgttgatgtcatacataaaaaggaagctttgtgggatttatttcaaaagcaccccttttcgcctcatatttcactgttgctggtcaacatatttcctacgaaagtctgccgctggcaggttttgagattagattctgaattccaacccttgagttcggcatttcggttcatcaattattgcattgagacttgtaattggaatgttacaaattctttgattctttctctcgatcgcatattcaaacggagaagattttcggactttgaagaagagtctgatttgtcacaaaacaataagataatttatcctccaacgaatcagcttacgagtcgattaatgtttaacagatatttgcatctactgacgttgtgtgaattgtctagttctgatacacaacgtgtgataccgatgggtgatatttctatgaatgattctctatctgttttgaagaaccgcctcaacctactaattgttctagctacacgttttgatttaaacttagagaagcgcttccaagagctaacacgaccgttatatagtaaggaatatttaaacttgcatacacagaacacagtcaggacgataacaacattgatcatgcaggccagcctttcattcctggaaatcagtcgaatcaaaaatcatccattcagtggaaaatttattgcgtcattatttgataaactagtacttcaacaaccttccatatcgggagtaacagaaaattttttgaaagaattcacaaatttagtctccaaaatgaaaagaaaaagcgtgagtatgctcaaatttctgtatccttcactggtggccatgtctcaagaaaatatattcgagtcgtctttttttttattattacaggtatatttgaagagcttagatgtgctgggtccaacttgggtgcaaaattatctttttcagtttataaagagcaaggctcaagaaaatgaaagatggatagaatgctattgtcagatcggaaaattcctcgtagattctggtatatttacctggtggactttctttacctataacggcttagatgctgcattacactttcagcttgcatttcactcccttattatcgatttctgtgatacagactcttttgaattactgaaaaaaccgctttattccattgcttctgatttgctgctcatttccaaagatgacgctttctatcactttctttccaatctgttgaagagggcacatatcatagtagcagatttgaaacctgtttccgatgagaatgaactcctgcgattggcttatattttttctaaagcattgaaaaaaaatgcatatcaagatctattagctgttttcttatccctggcgaaaaaacattacgatgaaggggacatcagtagaaatttcttggcaaaatatctcgaatttcttaacaaaaattgcttgactgagctaagaaataatcaactcttcatcagtctaagaagggaacttggtatttcaagtgatgaagacgaaaaatgtgcgttctgggactcattcaatgaagcaggtgatatactttccaaagctgcatttgttgaaaccggtattgttcaagcctgttgcactgggaatgaaattgatggatatcttgacaatttaagcactttattcacctccaccatgttagagagcccttttgcatttttttctgacctggtgatagcacacatatttgagaacagaccttttttcgacgtgaatatcaagaattttcttctatctcacttcatagaccttttcaacaaggttttaaaaatgaaattcgagcaggtatctcctgatgaatttgctgaactttgcaaagtatacagggcgttatgtattgagtgcgcaacagacgacacctttaatagtaatagtgatttgatcgccgcaaaagatgcgtttttggtatctgtgttgagaatcgcagatgggttttgggagcatgacaaacttttgcagctaaggatgcttgatagtaatatgaacatacctaatcagattcctcatactactttgcaaagttcgctatctgcgattgtaataaagataatagaaagtaatataggaaaaattgaggcgtctgaacctttcaaaaccttcaagaatacgtaaattatacacatgtaatataagcatatttaaaaattctccgtaatatatgtcatatatgtcaaattgcgaattagtccaaatagaaacaagatctatcagtgttggtgataaacattttgtattcttttggtaacgtgtatctcaaagaagtgcatgactttttttacgttctctttagtcttgatttagttgcttctgcgtttgttaaattttttgtccttcccgtttgattaataatacttataataatacaattctgtaacaagaaaagcaaagttactacattctcattgtggtttctaagtcatctaatcttctcctgccccttctagataatctatcagtttctcttttcaatcttcttaagtttctttctttttcaatttctctcttttgtatttcttcttttgttaatatttccacccttgggcaccaattggagcccagttcatcaatatccagccttataccagataagtacccaaatgcggcatcgtttgggacatggtcctgaatcaagtggccatctacccagtccttctttatcttcaagatagtttcatgaagcgattgagatattaaggggatgaactctcttgttaagccaaggtcctgtacaatggatgtagcaaatctttctggagtaagtgatttgtcgttcaagttccactggaagttatcttcaaaaaatctgtcttgtaagttgcaggttaggttgattatcacgtggaggtcagacattatctcagtggctgcaatattttcgaggtctttcaactgctcttttattatattcgcaatttgagtttgtaaggtagcggaagtcatatcaagatctttacagtatatagaggcaaattcctccggagatatggagtcgtcattgtagttccagagaaactggtcttttatggtatgacccatatgttctatatccaaagtaattggtatcatgattgcctctccagaattggcgtttgccttcgtttcttgatcagtgttgagtctatatggagacaccacttttccgttaatgaaagtatctcttattttagggtatctcaatatgttgaaggggttgtggtgttggtcttgcagatccggtagaacggcgtttccaatatcctgtgcctgcgctttgttgctcggaccattgctggcgttgttattgctattcaaaccggataaagattccacaaccatgtttgaacccgcatcgtatttgttgttagagataatactatcagctccattcatgttctctaggacattgtattcggaaccgtccatggtaacaccatttgtaagtgccggagtattttcatgagacactgcattatctttatagtgtgtatcagcattgttgaaattagaaccgttcatattgaattcatcaaagagatcgttgtcatattccgcatagttgaccactttagcccttttatgctgccttgtttgttgagccattgtaaagatggggataccatcatcttcgtttgtcaatctgttatgaaagttagaaatataagcttgtggaataagctggttttggtgcgacattgtgtgctgctatgtgcctttcttctttcttttttcaatgtacttcattcaataatctctatttgtcgtattttctaagttttttttttttgtcaaagtagtcgcggcgactttaaatgagcagatcatcatttagtagacaaaaagacacgggacatcttctatctatatagtttacatactttattatgtgaaagagtctttcgaaattgcaacaatgctcgataaatctatgggtcatgtgctctataattcctgtacattagcatcgggtgcgtgtaatttttggggtgatatggcattctccatcaacttttccttttatttagcatcttctgtaagtcagatgctacttttgcactgccgtgggtctccttgtggcatataaagcatttggtgccctttttcatatctttggcaaaacacgatccacaaaaataatggccacagtttgtgaccactggagacttgtaatcttccttacaaagagtgcacttgaacggtatcttttccaagtctagagtaaccgctttggagtcctctttatccgcattccattcttggttcagcttccagccagtcttgaaatcatccctcgagtgtaagaacttgcagctatctccgtaaccacagtatcccgtctgtttgtaatctttgcaaacgtcgggctgaaaatccatcagcaccgtggtccggatattcgttggttggttaatctgtttagtgaggcgtttatttttaccgctcatgttcagtaccagctcattgtcatcactaggtcgcctcttctttgccttctcagccagctcttttctctcaaagtttagaagatcttctttagtgctgtcgtcgttgaccgttaaagtgtatttatctaaatcctcaccctttttctgtagtttaccttcattctcatgtgaaagttgaagtgtcctgctatttccactcttggctaagctcatgaggtcactggaacccttttcttcatcgctggccactagtttctcttcgctaaaattaattttctgcctctttttctggttcttttcatcagaagagcttttgttcactaatctctttctgaacatgaatacctggagctttgattaagtgatggagctttcgatggctttagcttgagtccacttcagatagagatgcgcatggctttttcttattattctccggttgcacggaaagaagcgggaagaggactaaagggtttttggatcagcttcacaaaatatatacttggatacgttcgctactgaggtaaagtgggcatgcaaggttgcaatttaggattcgagctgtctagttgatcctccggagtgtaaaaactgattttcaatgagtggtaacacaactaacgtgcatgagactagagccaagtttgcagagacgctgcaaccgaggattggtggcaatactacaaaagtgatacgagctgctttggaaaagaacgaagctgaaagcggggtgtctgaggataatgataacgggtcattggagaaagttaacgtagctacttcgccgcttttgacatcaacaccgcccacaatctcaaaggcgttggtgaaattgtacccttatttaattctcattgacgaattcctaaacgttgttacatggacaggaaagaatatttggagcagtgttttgatgctgtgtctctttattactaccgttgagtattttgaaacgctggtgaagtactttggacatcttgccatcattgctattttgtggggttattccctattggacaattatattgagggtacgttgagctcctcaccaacattagaagatattgctctcttaatgaacagagtatccttgaagtcagatattttgctctcccccatggttaaccttggaacgcaagatattcaacggcttctatatactacggtcatattatctccaatatacgtgatgataacctggctacttttaccaccgagaagcttgatgctgatggtgggcatgttccttttaacgtatcactcaccatggtctaaagtagcaagaaggcttttatggaagtttaagattgtcaggctgcttgttttctacgtcacgggtttagaccttggtggaataaataaggaccagggtatttttgctacagtgcagaagcaagtgaaaaagttggcatcaacagaaaacagtaatggcgtattatccgattccaagcctatccgttttacttatgttttgtacgagaaccagcgtcgttggttaggtattggatggaagcctagtatgttgagttatgagaggactccatggaccgatgaatttttgaatgaggctccctctcctgaaaacttccatctacctgaagagactaacactatggtttggagatgggtcgacaagacatggaggctagacatgactaatgacggtgccattcaagtgcccaattcaaaggcaagaacttccgcagatccctcccctgacgagggatttatatattacgacaatacctggaaaaaaccaagtaaagaagattccttttctaaatatacaagaagaagaagatgggtaagaaccgcagaattggtcaaaacttctgactttgatgaaagcgtgataaattcgaatagaaattctgccattgaacaaaaggttgaagaaaacagcacgaatggtttaaccgctgagcaagagcttgggagcaacaagcaagagaaagataatgcgaaaaaagtaggagagcctacaacagaagagacaaaagaatttgccgaagcatcaaacatcaacgaaggcgagtttgaaagaatttcctcgaccgatgaagaagttttaaaatctagggcaagagatcgactggcaaaagtattagatgatactgaagagaaagagcaatcaaatccaaccattggtcgcgatagcaagaaggccgtatgatgctcgctcccgtttttacctttacataatataatctctaatttactttattacacaaatggtaactccctttaaataaacttaaaaaagaacgtatagaactctcttcttcaatgaatagtaatccaattttttttattaactatacaacgttatgactttaaaaattaaaaaatatgtttatgagtagtaagaaaaacaaaaggaaacaaaaacaaaaaaagttataaagcctatttctacttcctgtataacgaacacaaatggatattattctttatgcggatgggaaagtattcttagttttttttgttccagtctcgttatgataacactccgatcattccttatttttcttataatctgttaaccttcaaagttggtggcaaagattggatcaatttcttagccttaccagcatcgttgataaccaaagtgtacaaagaagaagagcctctaaccttgaacttggtttgtctgaatggcttaccggccttgttcaattttttgttaatcttaacagtggcggtcttaacgtcagctcttctggtcaattccaaaaattgtttgatgtcggtgatttctctagccatttttccttgatattttgtcgtactatattcaacctgaaataaaaaactaacagttgaaatatttctacattgaaattagaaaatttaattctttagattgaagattcaatattgtgcaaaagcgtacagcagcaatcacgactctacatgccatagagcttggaaaactctccataattttccactcgaacgtatgatgctccgtctatttttttcaacagttgcacggacgagtcctccttttcgcaaggcattttaattgtgtgggtttatgaaaatgcacggatgcattttctctagatgaaaattccgtcttggaataatatcggaatgagctaaaagaacaccagtacgcgaatatgtgagatgccctgttttgtcacataacagcggcagttaatttggcgtcttttctgggaagcgagtttatttggcaaggctatgatgttttataatactaatcacgcattgcaacttcacaaagtagttgtgacatgtggatgtaatagcgttacttttctttttgtttattgctatttgtttctattttctttttttaaatcgcgctaatacgtggaaaaatgcgtagaagccgggaatgggacgtgattatgagatcataacatgactgcgagctagagagcattggaagaatttgcttttttgttcagttccctactcatatatttgtttcatagaagtcgtagtatacgtgagacaagagcacttgaaaataaatcttggatctgctgggagcaatatcatcaagtaaaataagggggaaaccatatcaaatgtcagggttcattaagagcacgttgcttggtctaggccaagattacttagaagatcaatatcaagagttcgcagaacagcatttccagccaaccagggatccgttttatgaaacgaataaagatggtaaaaagcaccgccgcagactgccatattattgcactaaggatgaaagtaaagcgtggaaaaaggtccaaaacaaagcctggctgcatgacaaatcactgtgcggatgctgttgctggacaaacactataggatgggcaccattacttgcacttctaccggttataggacccttattgatgtattgggtgcatgataagttgattgaattggcagatgacaggtataaattgcctgcggaaatcaaggtgaagatgcatggtaatatcgttatcgatttacttattagtttagttcctattctgggaagtgtttttgcatggttgcacgcatgttccacgagaaacgcagctatagtttacaattttgttggaaaaagggcattggaaagaaagcaagcggagctcatgcatcaaaaagaagaaaatgagaaacattccaatgccaatactgcacctccagtagttggtggcaacaaaaatgtgaatggaaacagaaataatagtaaaatgtataacagaccgcctgtgacagctccacctgcaccagcatacacgcgcagtactaacggtcgcccccaaagaggttacaggtgaacaaaccggccacggtaaggctacattcttatcaacaaatatgggcaatcaaaaacttataatgtaaattttattttttatcgtaaacatgtatttaagaagtaatataaaggatgtttgacatgatcattttatatatgcatacacgttattgaagttatatggtcgttaaatcattaaaaggcccgtttctttgaaatatgctaacggaatcaaaccggtcgggtcggttagatgtggtattgttgcaaatcagaaagccttctttcattgttttgggagttagagccccttctggtcttgttgaagactgtcttaatttcgccagaatcgattaagtcattaatctcatcgccaggcttgccccaattgcctttcccatagcctcctctcttgacgtggttgggagactccccaaagttgccgttatgggtgaaatactttgggttagactttgcttcgtggactgtccatttgctagttctggtcatgtttgaattgtgtttgtgttagaaatttgtgtgctttaatgttatgttataatgaaatcttattagatttatttaacgtttttgctgtgcttataataaacattacataataaaaggagtagaagaaagtggtagagaggagtacaaatctacctgccagaactctctccttatatatatttccagtggtgtctggattacctacctcaagccataccatatccataccatatccataaacgcctacaaaatttctaccccaatccagcagcttctatcactatctcgtataccaccataggcaccaccactgtttgtgtaaatttactcctgaggggggggtggctcaacacggtgtaggccttcttcccgcacaatccgatgaaaccccacaatcgcctccgtctcttccactgtgcacggcgctagctcaacatcttccccgccacatttactgtggcaaagaaggtgcataatctaaaaaaacatacgtatgagaatggaaagggcaagataatatcggaccgtagtgagtcacttgcttttggtattgcaaccaactgccgcccctcttcccgctcttgcaccaaaacgctaaatgcccattgtgatggctcatccaccctcacgacgaagtaagacccggggcacaagaaaatacgagatcataacagttcgagtccgtttattgtgtgcggttttggtacgctttttcgtgaggtgtactaccattcatgagagtcgttttaggagctgtcatgaaagatatgtatcttgttgatgaactgtaaaaatttgcagaaattgcgctattccgtttatttcattgtcgattcggtgttaatattaggggtacaaaatatactagaagttctccctcgaggatataggaatgcgcaaatgggcatttgatgtgacacaaaatttggacaatataacgattcatttttagatcgttgttcaaccgtcccagtggccgagtggttaaggcgatgcctgctatttcctcagaaaagcaattaggcattgggttttacctgcgcaggttcgaatcctgtctgtgacgctttttttaatttctttactccatgacaaaagcggataaaaattcccgcattcggcgtaaaaaaatccggttttttttttagcactcgctgtttttgcctctaccgggtgaaaaatgacgatgaagacggctggaattgcgctgcatccgcttacgtaggatagaacacctacaaagatttacgaactttattgctcgaagattcgctatccatatctttttagtttccccccatttcacaatgggataccgttgttttttctgtaggtacgctttctcatagttaatagagtcagtaattcatttcattttttgcagaaaggaatttcttcacctaatttagaatttcatcaacatttattgtatctgcatggtataacaaattagaaaaatttggaagggaaaaaaaaactgttgcgtcaattacttataccagggatagaaaaaaaaaaaggaaacatggatcccacaagagctccggatttcaaaccgccatctgcagacgaggaattgattcctccacccgacccggaatctaaaattcccaaatctattccaattattccatacgtcttagccgatgcgaattcctctatagatgcaccttttaatattaagaggaagaaaaagcatcctaagcatcatcatcaccatcatcacagtcgtaaagaaggcaatgataaaaaacatcagcatattccattgaaccaagacgactttcaaccactttccgcagaagtgtcttccgaagatgatgacgcggattttagatccaaggagagatacggttcagattcaaccacagaatcagaaactagaggtgttcagaaatatcagattgctgatttagaagaagttccacatggaatcgttcgtcaagcaagaaccttggaagactacgaattcccctcacacagattatcgaaaaaattactggatccaaataaactgccgttagtaatagtagcatgtgggtctttttcaccaatcacctacttgcatctaagaatgtttgaaatggctttagatgcaatctctgaacaaacaaggtttgaagtcataggtggatattactcccctgttagtgataactatcaaaagcaaggcttggccccatcctaccatagagtacgtatgtgtgaattggcctgcgaaagaacctcatcttggttgatggtggatgcatgggagtcattgcaaccttcatacacaagaactgccaaggtcttggatcatttcaatcacgaaatcaatattaagagaggtggtgtagctactgttactggagaaaaaattggtgtgaaaataatgttgctggctggtggtgacctaatagagtcaatgggtgaaccaaacgtttgggcggacgccgatttacatcacattctcggtaattacggttgtttgattgtcgaacgtactggttctgatgtaaggtcttttttgttatcccatgatattatgtatgaacatagaaggaatattcttatcatcaagcaactcatctataatgatatttcttccacgaaagttcgtctatttatcagacgcgccatgtctgtacaatatttgttacctaattcggtcatcaggtatatccaagaacatagactatatgtggaccaaaccgaacctgttaagcaagttcttggaaacaaagaatgatttgccgtccggaattgcttcgttctttctttcatctttctctttacaatttccaattttcccctacaggaattaattggagggtacaagcgagtagaaatgtgacatatgacttacctatctgtgttttagtatagtttttttttctgtagtataattcacttttacactaattttttcgcctttttctcttaaagagctaatttctataaccttcagcggttataccaaatataaaaaatggaaggaaaacaaacagtaagaaataagcgcaacagcacgttagttcaccattggattccaacatttcaaaatttaatctaatggcaagagatatcacatttttgaccgtatttttagaaagttgtggcgctgtaaataatgatgaggcaggaaaattgttatctgcttggacttcaaccgtacgcattgagggaccggaatcaaccgactctaattcattatatattccactgctaccacctggaatgttgaaagtatgtttctcctagcaaaattaaaacccatccgtgaatgaagcgttactaactataataactggtagctttgtcactcgtaccaggaaaagtgaagattaaactgaattttaaaatgaacgatcgattagttacggaagagcaagagttgtttacaaaattgcgcgagattgtaggttcaagtattcgcttttgggaggaacaactgttttatcaagttcaagatgtaagcaccatagaaaaccacgtcattctcagtttaaaatgtacaattttaacggatgctcagataagtacgttcataagcaaacccagagagcttcatacgcatgccaaaggatatcctgaaatctattacctttccgagttatcaacaactgtcaattttttttctaaagagggaaactatgtcgaaataagccaggttattcctcattttaatgaatatttttcctctttaatagtgtctcaattggaatttgaatacccgatggtcttctccatgatttcaaggctccgattgaagtggcaacaaagttcgctcgctccgatatcctacgccctaacgagcaattcagtacttcttccaataatgcttaacatgattgcccaagacaaatcttcaacaaccgcgtatcaaattctgtgtcgaagaagaggtcctccaattcagaattttcaaattttttccttaccggctgtaacgtacaataagtagcatgcataaaatataatttaatcaaatacttttgggcaattaaaattttagttaacaatagttatgcaatgcgctttatgttcatatgataccgtttataagctattgccatatccttatcttattgcttccagtagcctcgagtcgaccactaaaaagatgtcacttaagacggaaattatgtagctgcacttcttttttaacaagttcggtcggcccttcaagttctcctttctaaagcctcattatttattgcgtagatgctaaatgttatcgcggtttagcttgcatgttacgtttccgttttagaacctggtcgagtagcgaataatgtcttcagttgatgtactgttaacagtaggtaagttggatgcctcattggcgttactgactactcaggatcatcatgttattgagtttcctacagtattattaccagaaaatgttaaagctggatctatcataaaaatgcaagtttcacaaaatttagaggaggaaaaaaaacaaaggaatcattttaagagtatacaagccaaaattttggagaagtatggtacccataaaccggagagcccagttttgaaaattgttaacgttacgcaaacgagctgtgttctagcatgggatccattgaaacttggctcagcaaaattgaaatcactgatcctttataggaagggaatacgttcaatggtaattccaaatccattcaaagtgactaccacgaaaatatccggtctttccgttgatacgccatacgaatttcaattgaaactgataaccacgtcaggaacattatggtctgaaaaggttatattgcgtacacataagatgactgacatgtctggtatcactgtatgtttgggtccattggatccattgaaagaaatttcagacttacagatatcccaatgtttgtctcacatcggggcgagacctttacaacgtcatgttgcgatagatactacgcattttgtctgtaacgatctagacaatgaagaaagcaatgaagagcttataagggcaaaacataacaacataccaattgtcagaccggaatgggtgagagcttgtgaggttgagaaaagaatcgttggtgttagaggattttacttagatgcagatcaaagtatactgaaaaactacacattcccaccagttaatgaggaagaactttcgtactcaaaggagaatgagccggtagccgaagtagcggatgaaaataagatgcccgaggacacaacagatgtcgaacaggttgcatcacctaatgacaatgagagtaatccttcagaagctaaggaacaaggagaaaagagtggacatgaaactgccccagtaagtcctgtagaagatccattgcatgcttcgacggctttggagaatgaaaccaccatcgaaaccgtcaacccctccgtaagaagtttgaaaagcgaacctgttggtactcccaatatagaggaaaacaaagcggactcttccgcagaagccgtggtagaagaaccgaatgaagctgtggctgaaagttctccaaatgaagaagcaacgggacagaaaagtgaggataccgatacacattctaacgaacaagctgataatggatttgtacagactgaagaagtagctgaaaacaacataaccacagaaagtgcaggggaaaataacgaacctgcagatgatgcagcaatggaatttggacgtccagaagctgaaattgaaactccagaagtaaatgagtctatagaagatgccaatgaacctgcggaggattccaatgaacctgtggaggattccaacaaacctgtgaaggattccaacaaacctgtggaggattccaacaaacctgtggaggattccaacaaacctgtggaggattccaacaaacctgtggaggatgccaatgaacctgtggaagataccagtgaacctgtggaggatgccggtgaacccgtacaagaaaccaacgagtttactaccgacattgcctctccaagacatcaagaagaagatatagaacttgaagccgaacctaaagatgctaccgaaagtgttgcagtcgagccatccaatgaagatgtaaaaccagaagaaaaaggttcagaggcagaagacgatatcaacaacgtttccaaggaggctgcctctggtgagagtactacccaccaaaaaactgaggcctctgcttctcttgaaagcagtgccgtcacggaagaacaagagacaacggaagccgaagtaaatacagatgacgttttgtccactaaagaagctaaaaaaaatactggcaacagcaacagtaataagaagaagaataagaagaataagaagaaagggaaaaagaaatgattaatggatgccttcaatgagttccacgacgcacgtttattttttcgactgagaatccctcagcaaatataatctattttttatatatctgtgtatatgtaagcatgtataactagttacaaatatgataactgctttggcgatcacttcattttcttgagaggggtactcagtagccgccaagcacgaaatgtccgttattaaaaattggggagtgaatcttaaaagcccgaaaaggaaattcaaaatctgtctatttataggccgtcgcgctctacgaaaacgcgaaattattcaaacggaaaacggaaaaaaatctaaaaaaagaaattaattgagagatctcacggaaatgccgcgaggaatgtttctcgaggctgagcggcgtggtctgtgcaaaaaaatggcaatttttttgtaggagtttgcattgggccattcagaaggagcaccgttagatgggatggtaaatgaatttgctgtttcagatttgaatcaatctttacccgttatttttgccgttttgctttcataatctgcaaattaacaaagtcataaagaacataaagacatcaccccagtttttacactcttttttcctgtgtttggtttagcacaactttccaataaccaagttggtttcagatcatccccatattattttctagtttcatttacttaccaaactcaccattcaaggctttcaaattaagttacgagtacagtggaccatttttttctgattcttcatattttccgttataagtcttataaggaaggtatacatttatattgcgaatttgaaaaataatttaaagctgactttgcgttttaggtaggctagaaaagaatacaactatccctaaacacattctagattcacgaagacgcctctgcctcaaagacatactatatttttactctcgttgaacaaatagtaccattatttcgctactttcgttgaagattggacatataaaatacgcaaatcatagtatgttgtctttcacaaccaagaatagtttccgcttattacttttaatactgtcatgcatatcgacgatacgcgcacaatttttcgtgcaatcatcatcttcgaattcttcagcagtatctactgcacgttcttccgtaagtagagttagttcttcaagttccattttgtcatccagtatggtttcttcctcaagtgctgactcatcttcccttacttcatcgacatcaagtaggtccctcgtgtcacatacgagttcgtctaccagcattgcctccatatcgttcacatcattcagtttctcatcagattcaagcaccagcagctcttcctctgcttcttcagattcttcatcctcctcatccttttccatctcttcgacatccgcaacttctgaatcatcgacgtcttctacgcaaacgtcaacatcatcttcatcctcactgtcgtcaacgccgtcctcttcatcatccccatcaacaatcacttctgcaccttcaacctcctccacaccatccactactgcctataatcaaggaagcactatcaccagtattattaacggtaagacgattctctcaaatcattatactaccgttacgtacacaccatcagcaaccgctgattcaagcaataaatccaaaagttcgggtctttctaaaaaaaatagaaacatcgtcattggttgtgtggttggtattggtgtaccactgattctggtgatactggctttaatttacatgttttgtatccaatcatcaaggacggactttattgactcagatggtaaggtcgttacggcatatagagctaacaaatttacgaaatggtggtatatgcttttgggtaagaaagttagtgatgaataccactccgattcaccattaggtggtagtgcatcgtccgcaggtggtttagacctagatgaagcagatgatgtgatggagcaaagctcccttttcgacgtcagaataagagatagcgatagcgtattaccaaacgccaacaccgccgaccataataataccaatagcggtggagagcctataaatagtagcgttgcgtcaaatgacataatagaagaaaaattctatgatgaacaaggtaacgaattatcaccacgaaattattaatcatatccattcatatcatttagtgcttatggctacttttcattcctcaattattgtaaattgaccatcttaattatatttctgatattgagtaggtggacttcattagtatttttacaaatattatcaccttcttatgtaggattagcattacataccctctaattaaaaaaagttaacattaattacattttaaaaaaaattgtaatagtatgatagtaggacctgacagccatttgaataaggtttcgagtgctttaacgttccactgattttatgtagttcatatgggggttagtctggtttgaggaggagaatttcagggaagcagtggccgttgaatctccctgtagggcgctgattatttttatcctaataatccaaaaatgacaatgtcaataaagaaaacttaccgagttctgtgaatttctccctaaaaaattactaattatacctgggcgagttttgaactctttggcaaataaacttggggtaaacctttcgattataaagacgttactgctcaaaaatgtgtagaagcataaggagatattctctcgtatgtttaattggagttggcttttttggactctgaagtttgagtatgggaggggaagtaatcgagattagattccctgatgttcacatatggggataaagaatgctttttgggatatgattgtttctttccgtcgttacggttgtaggtgcaacgaattgcgtaagggtggctagccgagatttaatgacgacgcaaaagggaataactgtgacaggaagatgaattcacaaagtttataaaaagaaagggcgatgcactgctacatggttgaacaaggcactacataattcacagcttgtagcttgtaaataaaaagagcattcacgcgatatacgattttcaatgatcactctaagaggaacggcgaaaaatagaattcaatatgaactggaatggcaattatgatcagttaaatatacaatattgttgttgcaattgtattacatttaaataagagcatgtatgtgataaattactgggaatttatggtataggttccaaaacgccaccgcccaaaacattgttattaatgaaataagaatcaacgatcttctcaatcatttttatttaatgggtattgaaatgaaaggattgataatgtaataggaagatgattgacccagaaattatctcaaaattcgcctatttctcagttatattaacctgcttattttaactttaaaaaaaattggaaagtttgcattctacgttttagcttttccgtataaaaattagataatttgacgttcagtataaaaaacgtatcgtaataggtttgcttattggaacgttaaggaaaaaaataataaagaattcatttttttcctttttaacccacctctttcaatccacctatacaactcattattagtagagtattattctaccgttttatacagatcatatcgtgtcttttgctatgctaggttgaaacaaggtaagatacgttaaacgacaacggctatgttgcaggcgaatcgctagcgattatttaaaagatcgtaaactataactgagaaaataaagagacgtaatccaaagtactagcaacactcaacatatataattgtcaatactttaggaagctactatttaagatcaggtacgtagaagcagacgaacagattcgagtttcgatctcctttctgtattgtattggttaggttacatctcggtggaaggctgtcgtatctcagaatgagatacgtcagtatgacaatacatcatcctaaaagttcataaaacacacatgaaacaaccttataagaaaacgaacagagtgagtaacatgagataaaactccgccttccttggctgacccacccaaacatataaatgcctgaacaattaatttggatccgaggttccgcgcttccaccatttagtatgaatcatatttatgtagtatataggataagtaacatttcgtaaatcaagctgataatccattttgacaactggtcacttcctcaagactgcttatattaggattgtcaaaccaccttactatgaattgcgttttgacacaggaaacgctaatgtaatataatccgtgatagtttaatggtcagaatgggcgcttgtcgcgtgccagatcggggttcaattccccgtcgcggagatttttcatttttttttttttgagccacaagaggtatagttcgacagaagagttctattaaagttttcctgttatttcatttggaatataacccaagttgcttttctttgatcataattatttccacctctttaatggtttgtttattggttgattatttcagcctttcttttaggttccttcgcattacattaaaccccgtaactaaacttaaactttaaaaaaaaaatatggacaacttcaggagatagatacaataaagcatctttaaaatttgagcaatgctttgcttattaaccagcaaatgaagactatgaattctaattgctaaacatgttaatgatgctagaaagcaagacaatgttaataaataatacaattcatgcatttagtaagatgtaactgtccaacaaactggtggtacaaggatccttcactgcaattagagtagcgtacgaatgcaagaaaattaataattacaaggaatgttgaacaaaatcagatttgagctttggtaaaattggttatcttcctattattttggttcagaagcagaactgaatagtaaattttatcatcattgtagacaacattccacacttgatttaggtataactttatataatatcactttgaccgatcactaattttcttcaatattgataaacaatggaaataatgaaaatccaggtaatataatgggttaaaatcagatggtgatgcatgatgtaatccatggcacatattccaaaggaatcatcgccggataaaaaaaagacgattgtggtgtctattcatcaaataaaaagttccaaacatataccatttatcaatactatattatgaactcataataatgagaagaaaattattgaaccggatattttaatcagtgtcaaattcgtagcactttttgatgtagtctaagttggaaaataaagaggccagatcataaacgaagaattcctaattcacaatatgtcctgcatatacttcctcagaaaaatatttaaatcattttttataatcacgcttaacctcgatatctcccaaactaaaatcggtatcaaaggtgctcgtaaaggaccatcaaaaaatacctaaataacatcgacgataattggcaatgcttcctagcatacaaaagacaattatcacaacactttttaggcgtggctgaaaatagcagctatttctgccacttcaaaatttgtttggctggcattgttcttagcaaaaaaaaggatagcttttcatccaactcaattaagaaagttagaagatccttatatatgatgaagaaaaattttcttcggatgttggaagagaatgttcgataataatcgttacatacgattgtcactgtagcatttgttagggttcaatcatatatgataagcccaatttgagaccaaaatcgtacattggacaggaccgcatcacgtcagaatagtttttgtgcatctatgtaatataatacggttgaattatccttttataatgatgactatttaattattatatgattaaacaaaaaaaagaagaagacaaacaacttattaccttatttcttgattttatatttattcggaagcagcagctctggtatagatagcttgcttggaatgcttcgagattggcttgatgataccttccttttccaagtgcctcaaagcaattctggcaagagaaccaccaatctttaatctatcaaccaaaacggaaacagagacgtatctgtaagttggaacctccttcaagattctgtcgtatttttcttgatccaaaataacagcgtgttgagctctgtccttcatggactttttggaccacttcttcttggacttcttaccaccagcaagagcggcagcggctttggcagctttagacaattgttgctttggaggcatgttatattatgttctgagacgtaagaaagggtgaaaattgatgttagtgtcaaaaattatattacaaaatacgcagagatattctagttcctttgatgaatgaatctttcagaaaaaaaagtcaaagcaaaagcaaaatggcctgcagactaaactgtatggtggtcttggaatgataaagatctgtttaatagatttagtagatacaatagcacatctcattacccagttatgattgacgtcattctgagttacaatgatcttagcgacctgtgctcattatttgctccactaattctaattttcctcgcctttcatatttcgtatctttattctatatcctaaaatttttttggcaaatcccagatttggctttgattttggcatcggttcggttctttcaaatatcttcttcccgtgaatcaactgcacataccttaataactagttcagtttagtgctctgtctgagtgactgtaataataaattttacaagccacttctcatgacatatattggtaagtaacttcatcaatactaattagtctttgccggttacccatctggcccctgacttgcgatgcttaggaagttccatactcgcggctcttcccaacagtagcacatccgtgaaacttctggcgctattcattatgcagtaccaggacaagaagttaaaaaaaaagctctgttacaagttcaatggtggtgcaaggattgaagttattatccaggaggcacggatgcaaaagatagaagacaaattaatttccttaaaattcaaaatgctcattattgtcacgctgtatgagcatttggtgaagatttcactgggaaatgttgcaataatttgataatcgttcgtattggatgaaactgtaacatcatctgtttattaagtatccgtgttattagtatatcatcacatacggtgtaagaagataacataaagattgagaaacagtcatcaaatataatggaagctgaaatgcgaggattgatgatgtaataggacaataaaaaatataagacggaagaagaaataatcgtaatagcattatgtaaaaatagggatttgaggattcctatatcctcgaggagaacttctagtatattaactatacagaatatcatagccttgatcaacaataaaatcccagcaattatcaaattatccatccatttctcagtgacattctcactagatgagcgtttttgagaataatgctaacatttggtaaggtatgaaataaaatgcgatatcctccgtagttgtcgtccgatatagtgtaacggctatcacatcacgctttcaccgtggagaccggggttcgactccccgtatcggagatatatttaatattttttttgatttgacttcaaatgagaactatttttttaaagcatcgtgtggtaaacaagcttccaccgaatgagcttaagaaagcgcaaacaattttcaacctgacaaagcatacatcatttttcatacaagtccttgttaagtaactcaaaaaaatcattaacgagatggccaaaagagttgccgatgcgcaaatacagagagaaacgtacgattctaacgagtctgacgatgacgtgactccctccactaaggttgcgtcatctgctgtgatgaatagaagaaaaattgccatgccaaagcgcaggatggcgttcaaaccttttggttctgcaaaatcggatgaaaccaagcaggctagttcctttagcttcctgaaccgggcggacggcactggagaagctcaggttgataatagccctaccacagaaagcaattccagactaaaagcattgaacctccagttcaaggctaaggttgatgacttagttctaggcaagccgttagcggacttgaggccccttttcaccaggtacgaattatacataaagaatatcttagaagctcccgtgaaatctatcgagaatccaacgcagacaaagggaaatgatgctaaacctgccaaagtagaagatgtccaaaaaagttccgattcttcatctgaagatgaggttaaggtggagggacccaagttcacaatagatgctaaaccgcctatttcagattccgttttctcatttggcccaaaaaaagaaaatcgcaagaaagatgaaagtgatagcgaaaacgatatagaaatcaagggccctgaatttaaattttctggaactgtatcaagtgatgtatttaagctgaatccaagcaccgataaaaatgaaaagaaaaccgagactaatgctaaaccattttcattttcttcggccacttcaactactgaacaaacgaagagtaaaaatcccctttcattgacagaagctaccaagaccaatgtggacaacaacagtaaagccgaggcttccttcacttttggaacaaaacatgctgcggattctcaaaataataaaccatcttttgtatttggtcaagcagctgcaaaaccatcgctagaaaagagctcattcacgtttggttcaacaacaattgaaaaaaaaaatgacgaaaactcaacctctaactcaaaacctgaaaagtctagtgatagcaatgattcaaacccatctttttccttttccatacccagtaagaatacacctgatgcatctaagccatcttttagttttggggtcccaaactcttccaaaaacgaaacttcaaaaccggtattttcgtttggtgcagcaacaccatcggccaaagaagctagtcaggaagatgacaacaacaacgttgaaaaaccttcctctaagcctgccttcaatttaatatctaacgctggtaccgagaaagagaaggaaagtaaaaaggactcaaagccagctttttcatttggcatatcaaacggaagtgaaagcaaagactctgacaaaccctctttaccctctgcggttgatggtgaaaatgacaagaaagaagcaacaaaacctgctttttcgtttggaataaatacaaatactactaaaaccgcggatactaaagctccaacttttacatttggctcctctgcactcgctgacaataaagaggatgttaagaaacctttttcattcggtacctcccagcctaataatactccatccttctcattcggaaaaacaacagcaaacttgcctgctaattcttcaacatctcctgctccctctataccatcgacggggttcaaattttctttgccatttgaacaaaaaggtagtcaaacaactacaaatgatagcaaggaagaatcaacaacagaagcaactggaaatgagtcgcaagatgcaaccaaagtagatgctaccccagaagaatcaaagccaataaacttgcaaaacggtgaggaagacgaagtggctttattttcgcaaaaagcaaaattaatgacattcaatgctgaaaccaaatcgtacgattcaagaggcgtaggcgaaatgaagcttttgaagaaaaaggacgatccttctaaagtgcgcctactttgtaggtctgacggtatgggtaatgtattactaaatgcaactgttgtagactccttcaaatatgagcctttagctcccggaaatgataatctcattaaagctcctactgttgcggctgatgggaaacttgtaacttatatcgtcaagtttaagcagaaggaagaaggccgctcatttacgaaagctattgaagatgctaaaaaagaaatgaaataagagtaaatacagttaacaattttaaatagaatagaaccctcatattttgtagctcaaggttatagttgagcaaataaagaatacaaaatttattccaaaaaacactacgaatctatattttccagttctttgtctataatagatttggcagcttttgaagcccaagccaatcttctttcatccctatcaaaagctttatctcctttctttcctgcaaggaaattatggtatctaaatttcttgttaataaaccacttcaaacctttgagaatgaatagcatattttccgatttaacgttcttcgttaaaacatcgcgcaaataatcatcggagtagattatacgcttatttccactttcatccatcttgagtttcttctcactttttttagctacagttaaaaataactgaaatagcaatatctccataaataacatcccttctgtgtttaatccacccataaatggaacatgcttgaaaacatctaatttcaaaatgtcattagcaagcaacgatccaaaaaatctcccctgatttgagatgcgaagcagtttttctttatcatctaaatcatcttcttcgtcagtatcgctttcagaatcgaattctttgtcttcaaatttttttatcacatcccagaataggaattgaaacgacttcgataaatggctatacctttcacatattttgttcgcgaccaatgcgtagtaatgattataaccattggatccactatcagccaaaagacaatgtaaaacaattcttggaatttcaagaacttgcttatttttcaagcttaacttttcaagtttactaaatgcatccaggtaatcttgtgcagacataatacttataaatatagcccttcgaatgtcagtattcatacgctgttgtctggcgataatattccaatctggaatatcatcaagaagatcatcctcgattgaaattttagatttcttggacttgctggcatcattttcattattgatcgaaacttcaaaagcattttccatgtttcctcgccaagaagcaccaaccagccaccatttccccttggaatcaatgtttttaatgtcttccagagaaacctgtaaaggctcccaagaagaagaagaattcaaaatgctttgcaagtttttctttaatggatgatgatcagtcgccaaaatagaaggctttaacctgttgtttttcaagtcagacatggtatccattaaaaatctcaatcttgggctctgctcttttaaattcttggcgttcttcaacagttctgatcgtatatctctcagggcggatggatcatcaccccggatcagttgtcctgaaatcgatataattcgtaaaagtaactcagtagtgaattcattaggatctgctacaaatattcgaataatgtcatagattaagcgacacgaaacaaatccaaaattataacaatacgatagtaaggttgcaatattgatgcatattttagaggaaattttgctctgctgatcctttaatatattttccatttcctcttcgtaatgatgcagaaatgcctctaccgttttttgaatgaaaaaagcacccacctcaatacctcttagttttgataatgtatacgcaagagcagcataattcattataaatccgtccaacaacttctgattttggcttataatattcaatatccctttcgttaacgattctgtaacgtactgcctaggcagggaatcatacaatctgtttaaatcagtgataataatagtaatattggagtctgaaagcttattcaaagaggagttgaccttcttgctaatttcagacaaagtactattgttttcactatcatccaatttctttctcagtgatgggggaacatagctctctacagattgtgtgggagctacatagggattttccttttctcttctataattatcatccgagtccgcaacgctgtcgttatcagattcactaagcccatctgagtcttcaaaatcagaagctgaaagatcatcatccgaggaaaatgctttctcgcttgcttcatcatcttttctcatagaattagtttctgtggcaaaatctccatactcttcgtcacttttgccataattttcaaagtattccaaaccttcaagaagtccaccaatagcatcaaattcatcttttgcatgtatagccttcctttctcctttcaagcccaacttttttgcgtaatattgcatgtccatctcgtccctttcaaacgctgatctgtctgaaggggccagcggataactcacaaaattctcatttgtatctctgttacgaatatgtttcttttcatatgagttaccttttatttctcccgagttttcagctccttgtataccctttgctttccgtttcaatgattctagttttttcattgtttcttccgcagacattgcctgctcaccgctttcttctgctacttcatcagtaagcacttcgtcactatcccagttttcattactttctgattcatctgaagaaatcggatttttaccgttagcctgcttgcctacgtttttcacacctgcattagcactcctcttttcggacgttggtgctgattttagccggctggaattgatttctctagttgatataattttacgtttcttgtcggcccgttccatctttctcttttctttacggcttaaatgtttgccatttcctcgtcttctcttttttccttctgaaatagaaaacctttcatcttgactgtagtcaagagtcttcaactcgtccaaaataacgcctggaattctaataccatctgttttttgcattgcctcaatattctgcagctgtggactggctatctttagttaagatgaggcttcgtaagtaagttcagtagtcttgtaagctcatcgcatttttttttttttgctggattttatatttttcacagcgaaaaggacgggaagctaaaagattaaaaaataaatattgcagataccatatgtaatttagtaaaatatttttataaaatattattattttcttgttcttcagtgatttattgtaaccatggagaaatgctcacgtaaataatgttaagtccaatggcacactactaccctttccacttggatacagttttgttttattttgaaagggacgtggcttaggcatttgtgacacattagtccatttaaatcttgaatcatctataacaattctttcatttccagatttggccccaacgatagaattcgatccccctatcgtatacctacctacatcaacatctggttgatttgtatgcgtattatgcttgtgttgcagcgtcgatccacctgtagaaaataaccgttgtttaaggtttttactggggctattagaggtaccggtatccatcgtagatggacttggtggtgggggtggcgacttagtggggttcttcgaaattgattcagtttcggtacgaacggaaagtgtaggcgcaacaggaggaggtgatggtattgatgtagacacggattgctgaggcagacttggtgcactaaatgttggcaatggcggagcagctgcaacaggaggagaaggaggtttttcgagattcgaggagggaagaacatcgtgtaataaagaagcggcggggacattattcttgctatcatctgataaaactggtggaactggtggaggtggaacgtgtccaggcagtgcaggggcctttgcttttttcatccctaacacagtctcactcttatcattggtgtggtcatcacctgatgcagttggagtcggtagcgatgttataggaggaggaggtgcactaggaggcaaaggaggcgccatagcatccgtatgggggggtggtgcgttaaaagcattcgatgatgtttgcttatgtaatttggattcaatttcatccagaaacgacataccattttggctactctgtttaggcgggtttatagatggagaaataggagaaggtcttacgttatcatccttagatgaacctattacatcctcttgtttatcttgggtagtgtatccagtatcaccaccaaccacgaatctatcatctctcttcttttggatctcagcaagaaatggtaagggtcccccaggtgttacggccgaggaagaactggatgaagatattttggattgcttactggacgctgagggtttgtttgtcgtgagtgttggaggaggaggaggagccgatggtactgacgttgcaaccgaaggaggaggaggaggtggtagtggtgctaaaggaatagatgatgctgacaaggcagaggatgttgaaaaagcaccaggtggtgggggaggaggaggtggtggcgcgggcattgacgatgctttgttaggaggaactgatgtagtatttggtaacggtggtgctaaagttgggggaaccggggttgcttttacgctgttagtcgacgcagagctcatggctgctggtagtggtggtggaggcggagctggagctgaagttgcttttttaggtgcagaggtcacatttggtaacgatggtggaggtggtgcagtaggcggtaatggcggagcatgtgatgtaggaatgggcggagcagatgatggaagtggtggttgtgaaggagatttatgattttcggtttgaatctttgtggaagaaacgccctcgacggctcctcgttcagacctcctggcattaatttctgccaaaaatggcaacccgcctgcaggaacttcagaagatggtggtgagactgcgttatctgtaggtttaatgttttttgagtccaggccaattgttggagttgggggagggggtggagcttgtggagggttgctaacatgtgttggcagagacgctgaaggcaaagggggtgctgacacactaggaagagaaatattagagctttttctttggtggcttctgtgtgctggccttactgaaggcatatgcggtctattttgcggtacctttggagcagaggcacctgataatggaagcggtggtgctggagatgatggtacaatgggaataggaggggccgcagaagatggaatatcaggaattggaggtgcagaagacgagggaatactaggaacagcgggtgctggtgataatggtgcattaggaatggggggagccgcaacagatggcaccgcgcccggaattggcggtgcgctcgccgatggagagggtttagtgcttgcattgttattgatatgttttaacttcggtatacctccagctaaaatatcgcccaactgcggagcgcccatcccagggattggaggagctgacatagagggtcctttactactgacggtaccagaacttcctgaggccgatgaaacgacaccacctcccacgattggggcacttctatcattggtctcagctttctttagtttcattccctttctaatgtcacctaacagggcgtcacggccctgcatcacagattttgccggtttaggagcactaccacctaatgctggtggaggcggtggaggaggaggagctggagcacctgccatttcaacaattcgttatatatatggtaggcttcttcaacaaacggttgtgcgctttttagtcgtatgctttgtctcatatcaaaaactttcttcataagtttataattttagattttgttcaagtatttactgactgtgcggattattcttaaggcccctatttgaggacggcggccgcacccgtaagcagtgactaggttatgaacatttcattctttctaaagacgcttttagcaagcttcatacaggatagtaggatttgaaggctaacattgtgattccatcctctgtcaatgtttcgtaacttgaatatttgcgactttttccatcttttgtgagctaaaatttttatcttgcccttgtaatttgaacttaaaagagaatacagcaatgtagcggacaaaccgaacattgaaattaccattttaattgtaacttatcttgaaggagttccataccgtatgttatcaagatacttctcagggcaatatctacatttacatatttgcctgcttaacatccgaacatttcacattttgattatttcgagaaaaaagtcaaaaaatttctcaaagaaaaaagaagtaatgccgaactgagagtgaatgcatcacatcgttgcgaaaaactggtaaaaaatgacttcaagttataagtaaatgaaagattaacaatatctaattctcgattcttttttcaagtttcagccataagatacataagcggaatacctttaaacatcctgcaaacagtctaataaatacgtataataagtttgaaatgggaggcattcgtgaaaagaaagctgaatactttgctaaattaagagaatacttggaagaatacaagtctttgttcgttgttggtgttgacaatgtttcttcccaacaaatgcacgaagtcagaaaggaattgagaggcagagctgtcgtcttgatgggtaagaacaccatggttagaagagccatcagaggtttcttatccgacttgccagacttcgaaaagttgttgccttttgtcaaaggtaacgttggtttcgttttcactaacgaaccattgactgaaatcaagaacgttattgtctctaacagagttgctgctccagccagagctggtgccgttgctccagaagacatctgggttagagccgtcaacactggtatggaaccaggtaagacttctttcttccaagctttgggtgtcccaaccaagattgccagaggtaccattgaaattgtttctgatgtcaaggtcgttgacgccggtaacaaggtcggtcaatctgaagcttccttgttgaacttgttgaacatctctccattcactttcggtttgactgttgttcaagtttacgacaacggtcaagtgttcccatcttctatcttggatatcaccgatgaagaattggtttctcacttcgtttccgctgtcagcaccattgcttctatctctttggctattggttacccaaccttgccatctgtcggtcacactttgatcaacaactacaaggacttgttagctgttgccattgctgcttcctaccactaccctgaaattgaagatttggttgacagaattgaaaacccagaaaagtacgctgctgctgctccagctgctacctccgctgcttccggtgacgctgctccagctgaagaagctgctgctgaagaagaagaagaatctgatgacgacatgggtttcggtttattcgattaagaagtgcaacatgaattattaagttaatttcatatatactattttataattaaataacattaatcctcattgattcattttattcatgataatgtactgtccggttccttgcgctagcctgagttagtctccgaatacctggcgattttcatatattctgagcggctctggacacctaactggataaaaatacttccacttaatgtagtttggttttctagttcatacggactatttcaaagttcatgatttgatgagagaaagtagctatactatcttcccaatttacgcttgtctctgaacaaaggtttttatcctttatatgcttattgaaatactgagaataccaaaagttgtctttttctctactatcgcttgattctttcaagacgtcggatataagaaatgtcacaaaatcaaaaatagctgcgaggaaataatgaagaaaagtaaaagacgaaactactgcttcgatgagaggtgagcagaagctcccataaaaaaaaaaacctatcttgcagtatttctatgttccttaagagatcaatagaagtagaatatgtttcgaaggggagataattcaaattttaacgtacaaaatagcttctttcttcctttggaatacgaatataccgtaaaagataatgtaccttcaaaaaaaaagagtagtataggtttttttccattagatgattctttattcacatcaaaaaacaattcagggcaccataaaagcgaacagctccatcgcggtaatgcagaaactatcagaagccagtttggaactgacgcagttccgataaggatcgatgagaaagaaggaaagtgggatagaattcaagatgataattcttctaatttaaactaccaaattaacaacagtaatgacccagcttcgagtggtaaatatacccagagtattgactgtaaccatatagcggagtcaaaattttcaaaaaaaaatggaaacattgatagtcttcgttcaaactcagcaacttttatgctaaatactgcagatgaagacgtgatagaatttagttttgacgataatgtcccttatgctgagttattatctggtgccacccttgaaaaatgttcgttgactctaaatgaaataaacaaaaaactattcaatacgctctatgactttcgagtaagcaaagataatcccgaagaaaatttggtagaactaatacttccgaactgcgtggtgttattaaacttttttgaagacattgaactcttggccgactcttctgatgaggctttcgaaaaatctactttcattaacacaattgagttcattgtgcacgatatttgggtcgaaacgttgataaagaacataaacttattacaaatgtttgatgcagatttgaaatgctacaatgacaagtacataatttgcaagctaaagggtcagtatccctccacaaatatagtggacataatgtgccgtttgaagcatttttccaattctattttggaaactttcaaattcggaatcgagctaaaagaacaagatcaatgccacaatagaaacactattatcaactacgttcttttcagtagagtattttcaacgattgttttagagattcaaaaatgctttatcttgatcgttaagttcatgtattctgtcaattttttagaaaaattttccgatgaagtatttttgtcatttattgaaattctcataaaaattgtctttgagcaccagattccgcagttatttttgggaattgatgaaattattcaactctggttaaagaacaatgaaggaaaacggcaacaactcttgagcgcttggtgcaacggaactgttcaagatatgaagcaaagccaacaaagagagtcctcaaacgcagaatctgaatcaatcacttcaagtacagaagaggacgaagaaggcctccaattcaataaatgggatgtgattgaaccatttattgataatatcaaggctttgaatcaatcaaaatcccatatgtgacgcagcgataaaaccgcggcatgcaaacatctacacaattagcaagggcaatccatattttgtcttttcgcgccctggaaaggcctaagtaatgtcgtaaacgcattctatctgtacttcaactctcctctgtgcattggtttgtgcaaatcacattttacgatactgccagatttatgcaaaaagagaaaaccaagggaccagaacaaagcaaaattacgataaacttcgaattccttcgtgcttgactaagacaaagggatggacgtagcgatttttagcgggccaagaactggttccgaaaaagcacaggtacaccgaaccctcagctaaggagggacagcaccgatgcggaaggacaaactttctttttgcctatcacagtatcttatcgagctaactattttcgacacacatgaaaaagcagaaatattaacgaaaaagaaaagaaagaccatgtcatgtacgggcaatcagaatctgtaacaagcgccatttttttttctgtatcgggccctccttactgctctccttccgtgtaacgcgttatgaaactctaatcctactatcggcgactctctcgaaatttttcttaacgcgtccttgtactgcgtctaacgcttttgccacttggatttctattataggaaatagtctcacttactgggcgacgaattttcgcgttttgatgaagcacaggaagaatttcttttttttttggcttcttctggttccgttttttacgcgcacaaatctaaaaaaagaaataattataacctagtctcgaaaattttcatcgatccattcgttcctttttttcgattttttcagatcaaaattcttgtttctttctttgtcttagtttatattaaaagatattttgattttactcctgaactatttattctttctaagaaggccagaacactacagctgttttaaccgactacgaagttctccattctcgaacactagccttcatttaccaaacaggaactagcgtatatcattagtccttattcgaaaagagattggtagatatttattgtagtttgtgagaaggagaaaatactgtcattggactgatagttagaggacattaacctctcttacgttcgctcaaaaaaattaaaataagcaagtagctgaaatcaagtctttcatacaacggtcagaccatgaacactgatcaacaaccttatcagggccaaacggactatacccagggaccaggtaacgggcaaagtcaggaacaagactatgaccaatatggccagcctttgtatccttcacaagctgatggttactacgatccaaatgtcgctgctggtactgaagctgatatgtatggtcaacaaccaccaaacgagtcttacgaccaagactacacaaacggtgaatactatggtcaaccgccaaatatggctgctcaagacggtgaaaacttctcggattttagcagttacggccctcctggaacacctggatatgatagctatggtggtcagtataccgcttctcaaatgagttatggagaaccaaattcgtcgggtacctcgactccaatttacggtaattatgacccaaatgctatcgctatggctttgccaaatgaaccttatcccgcttggactgctgactctcaatctcccgtttcgatcgagcaaatcgaagatatctttattgatttgaccaacagactcgggttccaaagagactccatgagaaatatgtttgatcattttatggttctcttggactctaggtcctcgagaatgtctcctgatcaagctttactatctttacatgccgactacattggtggcgatactgctaactataaaaaatggtattttgctgctcagttagatatggatgatgaaattggttttagaaatatgagtcttggaaaactctcaaggaaggcaagaaaagctaagaagaaaaacaagaaagcaatggaagaggccaatcccgaagacactgaagaaactttaaacaaaattgaaggcgacaactccctagaggctgctgattttagatggaaggccaagatgaaccagttgtctcccctggaaagagttcgtcatatcgccttatatctgttatgttggggtgaagctaatcaagtcagattcactgctgaatgtttatgttttatctacaagtgtgctcttgactacttggattcccctctttgccaacaacgccaagaacctatgccagaaggtgatttcttgaatagagtcattacgccaatttatcatttcatcagaaatcaagtttatgaaattgttgatggtcgttttgtcaagcgtgaaagagatcataacaaaattgtcggttatgatgatttaaaccaattgttctggtatccagaaggtattgcaaagattgttcttgaagatggaacaaaattgatagaactcccattggaagaacgttatttaagattaggcgatgtcgtctgggatgatgtattcttcaaaacatataaagagacccgtacttggttacatttggtcaccaacttcaaccgtatttgggttatgcatatctccattttttggatgtactttgcatataattcaccaacattttacactcataactatcaacaattggtcgacaaccaacctttggctgcttacaagtgggcatcttgcgcattaggtggtactgtcgcaagtttgattcaaattgtcgctactttgtgtgaatggtcattcgttccaagaaaatgggctggtgctcaacatctatctcgtagattctggtttttatgcatcatctttggtattaatttgggtcctattatttttgtttttgcttacgacaaagatacagtctactccactgctgcacacgttgttgctgctgttatgttctttgttgcggttgctaccatcatattcttctccattatgccattgggggggttgtttacgtcatatatgaaaaaatctacaaggcgttatgttgcatctcaaacattcactgctgcatttgcccctctacatgggttagatagatggatgtcctatttagtttgggttactgtttttgctgccaaatattcagaatcgtactactttttagttttatctttgagagatccaattagaattttgtccaccactgcaatgaggtgtacaggtgaatactggtggggtgcggtactttgtaaagtgcaacccaagattgtcttaggtttggttatcgctaccgacttcattcttttcttcttggatacctacttatggtacattattgtgaataccattttctctgttgggaaatctttctatttaggtatttctatcttaacaccatggagaaatatcttcacaagattgccaaaaagaatatactccaagattttggctactactgatatggaaattaaatacaaaccaaaggttttgatttctcaagtatggaatgccatcattatttcaatgtacagagaacatctcttagccatcgaccatgtacaaaaattactatatcatcaagttccatctgaaatcgaaggtaaaagaactttgagagctcctaccttctttgtttctcaagatgacaataattttgagactgaatttttccctagggattcagaggctgagcgtcgtatttctttctttgctcaatctttgtctactccaattcccgaaccacttccagttgataacatgccaacgttcacagtattgactcctcactacgcggaaagaattctgctgtcattaagagaaattattcgtgaagatgaccaattttctagagttactcttttagaatatctaaaacaattacatcccgttgaatgggaatgttttgttaaggatactaagattttggctgaagaaaccgctgcctatgaaggaaatgaaaatgaagctgaaaaggaagatgctttgaaatctcaaatcgatgatttgccattttattgtattggttttaaatctgctgctccagaatatacacttcgtacgagaatttgggcttctttgaggtcgcagactctatatcgtaccatttcagggttcatgaattattcaagagctatcaaattactgtatcgtgtggaaaatcctgaaattgttcaaatgtttggtggtaatgctgaaggcttagaaagagagctagaaaagatggcaagaagaaagtttaaatttttggtctctatgcagagattggctaaattcaaaccacatgaactggaaaatgctgagtttttgttgagagcttacccagacttacaaattgcctacttggatgaagagccacctttgactgaaggtgaggagccaagaatctattccgctttgattgatggacattgtgaaattctagataatggtcgtagacgtcccaagtttagagttcaattatctggtaacccaattcttggtgacggtaaatctgataaccaaaaccatgctttgattttttacagaggtgaatacattcaattaattgatgccaaccaagataactacttggaagaatgtctgaagattagatctgtattggctgaatttgaggaattgaacgttgaacaagttaatccatatgctcccggtttaaggtatgaggagcaaacaactaatcatcctgttgctattgttggtgccagagaatacattttctctgaaaactctggtgtgctgggtgatgtggccgctggtaaagaacaaacttttggtacattatttgcgcgtactttatctcaaattggtggtaaattgcattatggtcatccggatttcattaatgctacgtttatgaccactagaggtggtgtttccaaagcacaaaagggtttgcatttaaacgaagatatttatgctggtatgaatgctatgcttcgtggtggtcgtatcaagcattgtgagtattatcaatgtggtaaaggtagagatttgggtttcggtacaattctaaatttcactactaagattggtgctggtatgggtgaacaaatgttatctcgtgaatattattatctgggtacccaattaccagtggaccgtttcctaacattctattatgcccatcctggtttccatttgaacaacttgttcattcaattatctttgcaaatgtttatgttgactttggtgaatttatcttccttggcccatgaatctattatgtgtatttacgataggaacaaaccaaaaacagatgttttggttccaattgggtgttacaacttccaacctgcggttgattgggtgagacgttatacattgtctattttcattgttttctggattgccttcgttcctattgttgttcaagaactaattgaacgtggtctatggaaagccacccaaagatttttctgccacctattatcattatcccctatgttcgaagtgtttgcgggccaaatctactcttctgcgttattaagtgatttagcaattggtggtgctcgttatatatccaccggtcgtggttttgcaacttctcgtataccattttcaattttgtattcaagatttgcaggatctgctatctacatgggtgcaagatcaatgttaatgttgctgttcggtactgtcgcacattggcaagctccactactgtggttttgggcctctctatcttcattaatttttgcgcctttcgttttcaatccacatcagtttgcttgggaagatttctttttggattacagggattatatcagatggttatcaagaggtaataatcaatatcatagaaactcgtggattggttacgtgaggatgtctagggcacgtattactgggtttaaacgtaaactggttggcgatgaatctgagaaagctgctggtgacgcaagcagggctcatagaaccaatttgatcatggctgaaatcataccctgtgcaatttatgcagctggttgttttattgccttcacgtttattaatgctcaaaccggtgtcaagactactgatgatgatagggtgaattctgttttacgtatcatcatttgtaccttggcgccaatcgccgttaacctcggtgttctattcttctgtatgggtatgtcatgctgctctggtcccttatttggtatgtgttgtaagaagacaggttctgtaatggctggaattgcccacggtgttgctgttattgtccacattgcctttttcattgtcatgtgggttttggagagcttcaactttgttagaatgttaatcggagtcgttacttgtatccaatgtcaaagactcatttttcattgcatgacagcgttaatgttgactcgtgaatttaaaaacgatcatgccaatacagccttctggactggtaagtggtatggtaaaggtatgggttacatggcttggacccagccaagtagagaattaaccgccaaggtaattgagctttcagaatttgcagctgattttgttctaggtcatgtgattttaatctgtcaactgccactcattataatcccaaaaatagataaattccactcgattatgctattctggctaaagccctctcgtcaaattcgtcccccaatttactctctgaagcaaactcgtttgcgtaagcgtatggtcaagaagtactgctctttgtactttttagtattggctatttttgcaggatgcattattggtcctgctgtagcctctgctaagatccacaaacacattggagattcattggatggcgttgttcacaatctattccaaccaataaatacaaccaataatgacactggttcccaaatgtcaacttatcaaagtcactactatactcatacgccatcattaaagacctggtcaactataaaataatacaatcaatacttgcttgaacgcttgattttactgatattctatccaaaagcaagtagaccagaaactctcaagatgttgcaaataccgttcgatgtttttggtttagattgttttaatgttgatgcttttttacttatttttggaagcgtctttttaatttagttttatattataggtatatgaatgtgtttatgccaataagggtttttttgtacagttatgtgattataaacagtcttttgtctagtttttttcaccagtatcggcctctatttataaaaaacggagcagctttcggtgtcagtaattctgaaaaaatttgtgtcactctgattgtaaatgaattaatttagctagatagttgcgagccccaacgagaagattgtcagacaaagacaacattcaacaacctacatccgttactattcgttaactcgaggtacttgaaacttttcagttaagtatgaacaagaaacaaaatttttacgcagccattattgtggctatttttctttgtttgcaattgtctcatggctcttcaggtgtcagctttgaaaaaacccctgctattaaaattgtaggaaacaaattctttgactctgagagtggggaacagttcttcatcaagggcattgcttaccaattgcagagaagtgaagaggagcttagcaatgcaaatggggcttttgagacaagttatattgatgccttagcggacccaaaaatatgcttaagagatattccatttttgaaaatgctaggagtgaacacactgcgtgtttatgcaatagatccgacaaaatcacatgatatatgtatggaagctctatctgccgaaggaatgtacgtcctattagatctttcagagcctgatatttcaataaatagagaaaatccatcttgggatgtacatatttttgaaaggtacaaatctgtaattgatgcaatgtcatcctttccaaatttgttggggtattttgcagggaatgaagtgacaaatgaccatacaaatacctttgcatcacccttcgtgaaggccgcaatccgagatgccaaggagtatatttcgcattctaatcatagaaaaatccctgtcggctattcaactaatgacgatgctatgacaagagacaatttagcaaggtacttcgtttgcggagacgttaaagctgatttctatgggataaatatgtacgaatggtgtgggtattccacgtatggtactagtggatatagggaaagaacgaaagaatttgaaggttatccaattcccgtgtttttttcggaattcggctgcaatcttgtaagaccaaggccattcactgaagttagtgccctttatggcaataaaatgtcctctgtttggtctggtggccttgcatacatgtattttgaagaagaaaatgaatacggagttgttaagataaatgataatgatggagtggatattcttcctgatttcaagaatttgaagaaagaatttgcaaaggcagatcctaaaggcattacagaggaagaatacttaacggcaaaagaaccaactgaagtagaaagtgttgaatgtccacatattgctgtcggagtttgggaggcaaacgaaaaactacctgaaacacctgatagaagcaagtgcgcctgtttggatgagattttgccctgtgaaatagtcccttttggtgctgaatctggaaaatatgaagaatattttagttatttgtgctctaaggttgactgttccgatattcttgcaaatggcaaaaccggtgagtacggtgaattctcagattgttctgtcgaacaaaaactttcccttcagctgagtaaattgtattgcaaaatcggcgcaaatgatcgccattgtcctctaaatgataagaacgtttacttcaacttagaaagcctgcagccccttacaagcgagtcgatctgtaagaatgtttttgattctataaggaacatcacatacaatcatggcgattattcaaaatcaaatccatcgcgtagcaaggaaagtttgaacgtaaagtacccatcgagtgaagagagagaaaatgacggcaccatcgcatttaaaacttcagggtttgttatacttctaatttctatgatagctgctggaattcttctataaaaaattcatttaatattcaatgaagttataaattgatagtttaaataaagtcagtctttttcctcatgtttagaattgtattaatgtacgccgtttacgttggagtgtaaatgtgtctattccagaacgaaatctaaatgagcagtacaggcagttcagatggtactgaagcggtactaaagatgcatgaattgaacagatgtggtagttatgtatatgaggaatatgagttgtcacattaaaaatataatagctatgatcccattattatattcgtgacagttcgtaacgttttaattggcttatgtttttgagaaatgggtgaattttaagataattgttgggattccattattgataaaggctataatattaggtatacagaatatactggaagttctcctcgaggatataggaatcctcaaaatggaatctatatttctatttactaatatcacgattattcttcattccgttttatatgtttcattatcctattacattatcaatccttgcatttcagcttcctctaacttcgatgacagcttctcataactcatgtcatcatctaacaccgtatatgataatatattgatagcataaccattagttgataggtgatggtggaattttatttcaacagttttatacctctcttatataagcacaggaaggtccatatccacatttaaacttgattaatacttttttttatacctttaactatcatcatcaataatttcttttctgaaagtacgacatcaaagtcgccgagttttgtcttcggaataaatactaggtcagatgaataaagagcaggaatttactatctctgataatttattatgctcctctagtgcaatggttagcatgcattcttccggtggctgtgatccgggttcgagtcccgggaggagcttttaattttttagcgcactattctaatttttaaggaaaaagcatatttccgagtcagtgcatagaaagaacggaggctacgatgccagcacagtgtctataaagtcaagaaatacattcaaactcttcgcgtaagggctgtcaatttttcatttccctcaaagttaatgcgcaagagttaggatgatcttgattattagttatttgtttgttccatcaattatgccgacgtccatgaatgctattgaagtatcgattacttatgctattctattgtatttgagccggcggctagtaaacaagacagcatacctttccaacatccgtacatattgattattgtatctatgattttcatgtaatgtatgggttaactaatcctttctcttcttttttttttttctgaaaatcagtagctagaggaacctgttcgtgaaagatatggaatattccgtctagggaagagccgagagctgagagcagtatccatcggatggaatcttgcctggatgcgtaacgacgacagcttgtctagaaggcgaagtacaagatactaagaagactataacaacagaagacaattttgtagtgcgattctatattattgacgtaaccaacaaaaaagtatcagaatggctaaacaatcattaggtatgtgcacaaatgctaaatcactgaaaccctgtagagctggaattgaaaatatagtttgtaccttttgcctgagggcagaatgactcaatgttatcttaattcgattagaaaaagaaggtgcgttatccaaggttgaaacttgtaaactatttaggtgatgtctcataactgcaaccactggaaaatgacgcaaatatcaaaataatagggagataaagtctcacgacatgaaaaaatcatagaattattgttcaatttatctagccgtatcttaccttatggaaaaagtgtgaatatgtttttctaaatcgagcttcccggaaattacactatattatgcatccgtgatacatctgaaattcaatactttctccaaggtcctgcttactaagagggtaagatttgttgaaactcgaaatactaacattattttcattattttagacgtttcctccgacagaagaaaggctagaaaggcttatttcaccgccccatcctcccaacgtcgtgttttgctatctgctccattatctaaggagttgagagctcaatacggtatcaaggccttgccaatcagaagagatgatgaagttttggttgttcgtggttccaagaagggtcaagaaggtaagatttcatctgtttacagattgaaatttgccgttcaagttgacaaggttaccaaggaaaaggtcaacggtgcttccgttccaattaacttgcacccatccaagcttgtcattactaaattacatttggacaaggacagaaaagctttgatccaaagaaagggcggtaagttggaataaattatgtaattccctgaaaacttcctcgaaatttattgcactttttttactcaaaccatttaataatcatatgtaaaacgtataaaatagtatccattccactgtactcagtgtcttacgtaaagggctgtatactggcactaccttttactatggatatgtgctagctttttcggagaagaaatgttcgccttacgctagaaaccggggttaagggggcgtgagaatgaatattggcagacaagaaccgagatagaatcttaacacaaaaacagttcatcctacttctacgcctttatacagttatactgaaagatctttgcataggggcatagtttaaaataaaatatagggttgtcatagcaaacatgccaaatgtgctttctgatgatgaagagctccttaatggactaggaagtgagattatgaaaccctctagacaaggtaaccatatggcaaggaccgtcaaaaggtgggtaaataaagaacgtgctaccacagccgatctgaaaaatgttaatattgatggagttcatggaccggtaaataccgaaagttatatatcaccaggacagctttactccactgactcgggcaatttatttcatgctggaagaatccttgtcgttctagtcggtcttccagcaacatcaaagacactattgtcagtagcgattacaagatatacaagatggttaggagttaggacgaaatcgttccatttttcagaatataaagaatcagctaaaaatataccctcagactatttttgcgtagtgccaacgtcaaaagaaggtgtagcgtttgttgaaaagcttcgcatgcagatgttgaatgatatactggcatttttcaacgacttgtcaggtcagctggccatttatgatgccctaaacatccgtaaaattgacagaaagaatttggagacaacgttttctgaaattggagttaaagtactcttcatagaatcaatcgtgtctgatcaagaaatcatgaatagaaacatagctcttgcactggagtcgaacgattacaagggactttcaactgatgaagccattgacgaatatatgagacgtttatcagtgaacgaaccatactatgaaatgatgacacatgacgaagaattatcgtacattaaatatataaatttgggaaagcagataattgtgaaagataacatacatggttatttggtcaacaaaatagtatttttcttaatgaatttgaggcagaaaaaggggtgtgtatattttgctcgctgtggcaccagcgataaagacaactacatacatgatgaggaactaaacgaggagggaatccattactctcaagttctcaaggattttgtcctccaacgaattaaacagaagagacaggccaaaaaaaattcggattccttagtcgaagtaatagatggaagtcatgatgaagatttgaagacttccttgatagtttggacaggtcccaggaaaagaacccacgatactgcactctttttttcaaaagaaggtattaaagttcagcaacggtcagagttgagacagttgaacccaggaagtattgctgatcttactgatcaacagataatggacaaatttccatcagaatataaagaatcattaaaagacccatatcattttcgattccctagggcggaatcttaccatgacttagccgttcgtatggaacctttactattagaaatggagcatacgagcaaggacattctcatcattgcacatgagtcaacattaagagtattatatggctatttaatggcttgcacctgcgtagagttaccaaatctaaatttcacaagagacaaattagttgaaatttcattcagccctttctgtaatactgtagagttactgaacattcctttaactagctaatatactggagttgcatcgttgatgtgtattatctatattcaaaatagttatttttatgtttaagaaaggattaagaacaattgaaaaaaaattaccattagcaacgaatattaaattgtaaattatttagagatatttttctataatatgctcgcctaccattctcttttatacaatatttaggttttacctggaggctaaaatgatatgaggggacgatagcttaacatgattgtgacacaaactttaaaaaaggctttcagttgaagagttttcttccgctatagtctccaatgctatcttacttttcttattacgtttatgtctacctttcatatcatttcttgtaagcaactcctgcatttccgcttcctgggcagccttgagtaaatcatatctggtaattttatcaggtttattgctcacatatctgcctgaaccaacaacgttgatatatttccatggacatgctacccactctgcaatagtggaagctgaattgattgtgttttttgaaactaacccgatgggacaattactgatcgattgcattattaaaggtgataaataatcctttgttatttgtgccccttaaaattcatatacactttatgtttaattcgacaggtataacagaaagaaacaaggaaaacaatgcaattaatcattaactgcaccaacttttatatgaatatattgtgctacatgtcttaattagtcctctgtgaatgagcatcacaaagaatcacgaggaaaagattgattacttaatattgataggaatcagccgcggaaatggaaatcttggtaatataattttaatgcggcacgctgaaaattgatggcggcctgctaggagccctattgattccgcggaaataggcggattattacaaacgttgagcattcagcaggtgcgctgtgccttttcactttcagctaagatgtttgcaagcaagaattaacagataagccgcttcgctagtaacgcaactcattgtgtttttaatggaagctaaggatggttgaaattatgggtaccctgagataagattattaactatgatgtaagtattaatcattataataaggggtacctgctcattcgcattaccatacattgactattaacgagcagaaagtttttggaagttttgcagatgaagtgcatgtttgataatttgaatatgcggatttccttattcaaaactttctttatgcatagagctaattaggtttgagttaaggaaaaaaatctatcataagtgtcttgaggtatttactataatgtatacgggaaatattaggtgtgataggctctaggaacgaatattaatattgggggggggaaactggaatgaaattaaacaaaagcaaaaaaatctaaaagaagaaaaaaaggagagagagagagagagagagagagagagagagagagagagagagagagagagagagagagagatgagggttattgataatataatataataataaaagagaagatagtagaaaaggaagaaagaaaaaaaaaaattaagatgtactttaataaaaagagggaaattctaaaaagtgcgactggaattagaagaatgcaggtattttgttttctctcctatgacggagaaggtaacaaaatcataaaggtaaaataacaaattaattatgatcaaagagaaatgccctttgtaaaccgtggtttgtaaatgcgttggtaactgcagcagatgttaagaaacaaagatggaaaagaaccaaaatcagcttgtaagttctatcgtaattataaggataattgacgcttctgttgctctctagcccatcttgctgtatcttttgtggcttgactgaacaattggccactcctagttcttttaatgtaatcaataacccagtcttgtccataaaattgtttgattgagccgtctggaaacatcgctgctatatcaccaatcaatccgactgctgctcttgaggtagcatcctcactgtacagctgaggatcttctgcaacttgtgcaatgaactggaatatagtaccaacataagggaacagagcttcaggtttatcatgaagacccgctactatacccacataagcatctagtactgcttctagtacttttatttgataatcaagggcttctaatgtgccgttttccggcttcgtgttttgggcagcaacacacaacgccatgatgtcattcaagtagggaataaaatcagcacctatattggaagcaatatcaccgaacacgctcaagacggctggtttcaactctctccttgcatttggattagagatcatttgagccaagacattcatcatagcatcggaatatcttctgaaatcttcttctaacgaatttgaaatatcagcgatgaagcccactgcggtgattgaaactggcgaatctacttgatttaaagcctttaataaatagggagaaaatgtttccaggtatttctcaaatcctttacccaaagaagcagctagagctgaaatagcataaaacacatcgtcttcaataaacgcagagtcctttttttccaacaacctgaagaacagtcccataagcatatctgcaaccggttctacactacttggactttttctaataacggctgctagaacagtcaatatatttgactgcaattcttgcaaactttgcgcatcttctaacgttaattgattttcatcaacactcattgtctgccctaatttgtccataacaaacgtagaaatggaggcggaagtttcagctaccgtgtccgtggcgtattcaaccattgttgtcaaggctgaaaaggcggatgcacgggcattgaactcattatcaattctatttgcagcaccgatcaaaccatctacaagagcgggatagaagttatagattggagatggtgtggcttctgctaattgttcgactaagttgataatggtccaagaacagtttgtggccacttttgggtgatcttgcaacccaattaaacaagcttgaacgacacctggaagatgctgttgtgggtcgatagattcagcaacagaatcagcaattctaccaatacaccaagcagtggtttccttaacttgtagggattgatcgttcattaaattcaaaatagatggtaaggcttggtgaacgtaataggttctttggaccttatcagggccatccataatggaaccaaaggccattacagcagcttcacgattcctccagttgtcagcggtaatattttgttcaacaaattccaatacaggttctaagatatgattgccacagttttgggcaaacaactgcaagcatgcacctgcggacatggaaacattccaatcgtcatcttctggatcttcattttgtctcgttagaaggttcaacaaattggggacaacatctttaatagaagagagagcgaaattataactctgtaaaggagattgaggaaattgagcgagctcataggcaatatcgatttcttcttcacaaatagtggaccagaattccacagtcatggaagctactttatcatttggagatttcattgtagctatggtcaatgcatatagggcttgctccatgtaaggtttcataaatgtatagtatagtgacatgattttacacaaacaaccaaaggcagctgcttgaacttctatatcttcagcttgagtggcttcacagacgacttgcataaggtagtttctttcaccttcgcgttccatgttatttttgatgaaaattaaagagtctgcaagagcattcagagctgccagtctgactgctttggaagtttccgtagattgcgcaccctggacaatagcgattaagatattgtttgatgaagaaactaaggcttgactttgagggtctgcactttcacacatataacccaaggccaataaagaggctctcttgacattttctggttgttccgcacctgtattgtcaaccataattttcatcaactctggccatgcgccatggggcaactcaatatctgctatagccgcaatcaattgagctgctgcatttgctatacgcggttctatggagaccaatgcggtcagcgcgttagttttaatttggtttttagcttctggactaacctgtgtaatccaacgttgtgcaaattgctgcgtcttgactgagtccttggacaccagctcgttcttcaaagttagcgccgctagaatacgcccttctagctttgtattttcatcgataagcacttgcgaagaaagacctgcaaattgtaagaagttgtcattagataatttctttaattgcgtttcactagtcaaccgaatgttttggtcgggacttaagatactgttctccaatagttgagcaaattcagcggtggacattgctccttgtgtgatatgatggattactgttaaatcagttttattctacccctaaaaaccttgcaaatataaagagaaaaaggacagataattctccagtaatattatcctttacttcttaatgatatctgttctttaagcgaaaaatacaagaaaagaaactggagagtttacgtatatttgcctctcttcgcagttatttttcttttttttttatttttttttccttggttctctcatccaagtttttccttattgcccttccagcaaaattcgaaaattttctttctcgccaaagaattctatactcgtttaacatgatacatttatcggaacatcggtaggaagtggcctgcgactgactatccatttgatcgctgcatgaggaatgctggttatctatgtatcgggacatggttgcaacgtttccaacaagaacaagaatagaaaaaaaaataccgaaagcgtcctttgcgttatacctaccaaccgtgtacaagctttactcttcttgctttctttatttgctatgtatctttatgtttatatgtatataaatctgcctacttgtcttcctttggcatgccaaccctatgttttttcaattgctcaattgcaaagaaaattaacattgtgaatggacccagtctagtgaaacttggcaaccacccccggaacatgaaagatgggccctctttgcggacagcgtcggcaaggatcttcaaagccggttgatggtctccgctgccgttcatgatacgtgtcttcatgacgtctgctggagagcacacagtggtggccaccaggccagccaacagggacgctgtcaagtgtgtatagttcttggatgcgtcgaaatctaattttgtgaccaagtagttcttaaacacgtcatacgtaacgacctgacttgccgtcatcagtatgcccctaaccatgttaggcttccaaccggtaaacaaggttttcagtccaccctcgtagcgatatatcttgtacacaccatcgatagcgtttttgtagtttctcctcttcgctgcctccaaagcagagtcgttttgcattctgatatttacaacatctgcaaaattccctgcaagccccccaatggcaccactgaacatggagcaaggtaaaagatacgccatgttagtcaattgctcgcgtgggatcacattctctttcaacaagtcgtatgcaccgaatctcaccgtcgtgtatgtacattgcctcaacacagcagcgctcaggccggaatataaccccaccacaccttcattcgccaagatactctccaacatcctgaagagtgtgggcttgggcataggagccgcctgcagtctgactttggccaagtcaagaggatgtgtcaccatggtagcaaagatacccgctgcacctccgtaccaccatggatacttgatattcttaccggcagactcttttgcgttggttgacatgccgtccagctgttgcgttatcttttcgacactttcagagcaagagaaacgaacctctacacataaatatgcatacgattatgtatatccatatatatatatacactacaagccgaccgcccgaccgtttcctgcccccaacattgcagcgtaatcgcttgccaaagaccacaccttgcagcccttttatacaaacatgtctacgacgtacagtggagagggccctttccttggcactcaactgagattgcgacgcgataccttctgcgaccgttcctactatcgcggccataactccaacaacgacagcggatgcgctgttctgcggatgcgtgaccgtatccgcaaagaacgaagattaaatttagggtccccggcattgaggatggttctgccaagaactcacgatataaaccagttggttgagcatcgcatggatgagtatggcgtattttgattgctcatatatagtgggggggaatactcatgctgtgaaaagcacaactcttttcactcaacgaggttaatgccttctttgtctccacgccgtttttttctggcgcccttttgagaaagatagcctgtcccgtaatcgtggctttggcagagacagagggtgagcgaaagagcgggcgaaaccgagaatggattccgagtaaaggattgcgatggcatgaaacaaaaccgagaggcactccttgtaaggacacacatacacagacgtaaacatatatatacatacgtatactcaaatatatcttcgtatcattaggtcagcttctctcttccgcacgtagaattagagaattaacgcaagactataccattataaaaacgcataagaaacagtttcatcatgattgaccgcactaaaaacgaatctccagcttttgaagagtctccgcttacccccaatgtgtctaacctgaaaccattcccttctcaaagcaacaaaatatccactccagtgaccgaccataggagaagacggtcatccagcgtaatatcacatgtggaacaggaaaccttcgaagacgaaaatgaccagcagatgcttcccaacatgaacgctacgtgggtcgaccagcgaggcgcgtggttgattcatatcgtcgtaatagtactcttgaggctcttctactccttgttcgggtcgacgcccaaatggacgtggactttaacaaacatgacctacatcatcggattctatatcatgttccaccttgtcaaaggtacgcccttcgactttaacggtggtgcgtacgacaacctgaccatgtgggagcagattaacgatgagactttgtacacacccactagaaaatttctgctgattgtacccattgtgttgttcctgattagcaaccagtactaccgcaacgacatgacactattcctctccaacctcgccgtgacggtgcttattggtgtcgttcctaagctgggaattacgcatagactaagaatatccatccctggtattacgggccgtgctcaaattagttagttggctctgcctatacgcatatatgtatatatatatatatatatatgtatgtatgtgtatatgtatatgtacgtataccttacatcatcatctttctttatattctctctaatgcgcatttacatcggagtacacgtcaaatcttctttgtttggttaagggtaccgcttgtctaaatgactcaatgacttcgggatctaattcagcataaataatctcttctccctcgccagcttcagctacaatcttgcctctagggtccaccactatagagtggccatatgcatggtaagaactctgtagattccttgcgggagaacataacatcacgtacacttggttgtcaactgccctgcttcttgccagtaaatgccaatgcaagggccctgtgacagtgttgaatgcactagggtagatcatggcaaacgcacccttgcgtgcacttagcattgcgagttccggaaacctcatgtcatagcatatacctacgccaaacttaccatatttcgtgtcaatggtagtagacttctctccagggctcaaggtttcactttcatggaacgatataccgttaggaatgtctacatcgaaaagatggaccttccgatgcttgtcaatcaacttgccatcctcgttgaaaattatagaggtgttgtagattttgtctgtctttggatccaattccggaattgttcctcctaccaagatgattttaaacttattggctaaattagacagaaattgaactgacgtcgaaggctctttcggattgataacttctgaatactttctaaactgatcagtggagtacggagaattgaagcattctggcaatacgaccaacttggtatccggctgttccttcatagccctttcaatgaacgttgcagccctttgaagattggccattttgtcaggactcgagcctgacagttggaccaacgcaactttaattttttgtgaaagaatcttcgaagcactcatactggcgatcttcacgccctcctgctactacaaaagctgtgtttttacaagaatcaaattaagttagcaagatatcatacaacattattgataattttaatatcgtgttcgtacctgatgacgtatctgtgcattgataaggcccgcatggtttcagaaagcagagcgggacgattccaaattagtggccttgtgctttgcatgtcaattgtgttaccttcagctcgtggatttgttttatcaatacacagtctacagtcaagaatttttttttatcaatttgtgcgttcgagcgtataaaatagccgctgtagctacttaagttcctgttcagcgatagtttttttccatcacacgtactatggcaccaactttgtactattccttccccgtttactcaattcttgaagccaatttgtacaattccccattagagtcaaataaaaggatgcctcacggaggtatgttacccgcgctatttcacatggctcattgaattagaggtggaatttggtgtaccctcccctcctcatctgatgaagtagtgatccgacaattcttaaaagttgtagacattactcttaccaccaactaagttgtatttatattgctacccttatccttttatatctaactagcgcttataaggttggggcaatactaaaactgtgatcttattcagctcattaaatacgtggcagtacgtaccctattagaaacaataggaaacaacagagtcggaagaagccaaatgccagatttgaagtccaagaccttgtcaagccaatctttgggagcggctattcctccagaaattgtgtaccaaatacttacataccagtttagggatttgttaagaaatgaccatccaggtacggcagaaaagtttaacgaaaacttaactacatttgtcaaaagtaatttaactgttaataagacattctcccatatttgtcaagttctcatttatagatattgtaatttaactaccgcaaagagatttcacggtcttttacagactttaaagggaaatagatgcctttgcaataagattgaagtagccgatttccaagaattaacgtctattggactggggaggtccagtgagatgaataaaatgattaaaaatctaactaacgaaactcttcttgagtttctaatgctcacaaaagcaaacttaagggaattcttagcatgtgaaaatattcaagacgatttagacgataatatcataaagtatattctatctccaggaaaagtcttgagtgtagtggatttctgtggctgttcaggcaccactttcacagaaagttttattaaggccctggataaatactaccctaataaatcgattgatcagtaccggctggaacctattcaacaaaattatcagattacctgcttaggcctaaatgattgtattgatctaccatcacacgtcctttggaagatcttaaaaatgttaccagaactacaaaaacttgatttatctcatacctccattgatgatagtaccttatatcacggcatacctcactggaaaaatttaactcatctttccctcgctacttgtcttcaagttactccaagagcggttctggagttttttagtcatcacccaacaattacagaccctgacaacacttctacattagaatggctgaatgttagtgtcattgcccattcctcatcttggaatgaggtgcacacaatgtttttactaaaaaaactttgtcaacatggccataacaaaactttgcaatatctaaatatcggcggtttaccgcttcatgttgcaccttctttcggcgaggaccctattagcgaatccacttattattaccaatgccgcgatagcttacagttcataaagtggaattttccgaagttaaaaagtttgagtataaaaggtaatagtatcccgatatctacgctcgtagaatttttgacaccaattgatcaagaccatcctaattgtgctcaaaaattgaagtttttgaatatttctggtaactcttatgtgaataaatggactattcaggactcattattgtacacttgttctccaagtttagtcgcgttagaagtttcctttgactcgtggcaacagattgaaaaactaaatgatagacatgaaattattgcatacagatataaaaacccaaattcggtaattaaagatatttcaacagcagaacaagtaaagtggaaatgttacattgattcttcttatggtaggagatattggttatataagactgatcctttcctgaatcgtgatgacttggattctaagtcaaatttaactaggtatgattttgagggtcacaaaatcatagaaattataaaccagccggatttcctaaagtttgcccaaagtaaaatcatgcttggatgtggtctagttcctcaaagtggtattagacgtaaactatgttacagagatttaaagccaccagtttctcaattcttaaatagaaaaggtgcgatcagccttggtgatactccactaccaataattaccccaacattacctcgtggtgggtggagaatcatccataatgaggacgacaacaacagtcatgtggaagatagccaaaatcacgtgaatgccatcccaagaaggaattctctgttgagcagacccactttaagaagcaacaatggttcttcctctgccaacccctttgctatcaatgtttctcctgcatctcaaatcagggatggtttgtactgggataggtcggtccatgatttacgtgagctatcattgcaagaacaaagaattcaggagttagctgatgagcagcaggaactaagaacaatcgcaaactttgaagagactgacgacgaatatttgcacgatcccgacttgcaacggagaaggtcccaacttcacttatttgaaagttcgcgctcacgttcaggaaataaaacaagaccaagtttaactggtgaacactcgtcctcggcatcgtttctatccttctcccacttcaaccaccttcacaagcgtaagaattattatttcacgcatcccgatgaatttgtctatgatccaaaggatcctctgacgactcaaagatatagattacattttgaaatagtcaacgaatatcaagtttttgggtgcattgagcgtggaatgtatagatactacagtttaaaagcatagatatttttctctttacttccttacccttcctccgctctcgtcttgtgtcttgtatatgatttctatatatggtaaaatattgcatacatcgtctaccatttagccagacttttcggaaacgaatttaatgattgcagcaaattcccttcccctatcaactgattgaagaatgcctcgaaacgcaatgtgatttttaagttttccatttttttttttttcataagggaagcctctctcctccgaaaaaggtaaacattgcgaaaaatgatccaaaagagagaataaaaaaacaattagaaaatgatttactcatccgcttactagagaggccaaaccggatagtcctgacgctaataagagtaggattaagttcattgtggtgtgtttttttattgcgcgtaagcgatacctgcaaaattcattataattttcaatcaccttccatcaattatcaataccccatactaagaacaggcaattggtttaggaaggaaaataataaagatatccaaaaacaactggaagctttccagtcgcgacctctgttttgttcgaacttctagttaacaaaagaaagaccattcaattgcttttttaatattcattattgacgatttttatttctaggcgattaccggtatacttttcattcttttgataagataataaatccaattacattcgcttattttaattcaatttagactataactttctcttaactctaggagtttctttcttgaatcgaagcatttttgacaatacccaatatcctctttctacttgagaattttttcgattctacatgaagtatgatacaatcagacgaagataatttggactcttctgaaacgacagcatcaacttcatatagtggtacttcctctgtatcatccagactacaactaagaacatccttgttttttgaaaatcttaatggagcacatgggaaccccgatgcggagacagagatggctactgttgcctatgaaaccacaagtagaggtcaaggatttgctgtatacatcaacaatgaaaggttttctcaaataatgggagcatccacaagctctagctctagtagcaactcgtcctctattacacaatttcacgatacccaagataataatataccaagcaacactactgtaaggccaacttcacttcgacgagacaacgaggataccgtaccgttaaggaacgtaactccttcacaaaacgcggcggtacggccagaaagagcagtgaattcaccatcttcgcagagattaagttgcgcactgacaatatcaacttcagttcttatgggagaagatgttgaaggaagccctatagagcaagagcatagtagggtcgtatcttcattatactcatctttggcgaatcgcgggaacgacgagtcaaagaatggaacacctccacgtcctacctcaattgaacctaatgaaacaacggaacactcatttttctcataccattacgatgacaccttagaaccagatgttgaagaggcagtgaggctaacgaagaataaaacttctaatgttaattttataagctcaactggcagtaaaggtgaaggcgagaccgaggatgaagtcatagatcaatacgaacctgtgaatgaatcaaaatttataccgcacaaactaaaaattccagagaaggctggatcaataaagtcgtcgacaagtgatgattcgcattcgccaggtgcgccaggtacgtcggcaaggaagattaaaattcctcagagtccatcgttaattggtaacatattgattccttcacacaatagtgacagtagtaacgaaagttctcctaaagaccatatagggcataataatgaagaaaaattcagttcaaaatctacgcgcaagccctccacatccctagaagaagaaggtccaccaattggactaccttcaattcccgtattaagaagtgtgtccggaccaagcaaatggacgaagacacctttacgcttagaatctggaaattcaactaagtctgatccattttcacgctatgaaggacacaagacgccctctccattgaccaagatgaacaagaagaaaaataaaacgttgccagaacatggacaacccctcgtgctagctccaattaaatctcaaagctcggagtcagacacgggacagaactccattatagaaaagccagctcgaagcatacgacgaaagcaacaagaaaaaactgataataggaaagaagacaggcacgatgctgaaaatatagacctggaggcgagaatgccaattcaacatatcgataccgcttccattcattcgtttgattcaggtcaaaatggattcagggacgtttacagcatcgaaaacatcattgtgatcctcctatgttgtagtatagtgccgccattattttttattattggctgcagctcaagaaggaaattagtttcagactatagattaatgaggttgcttatgaataaagaacaccgagcggctttgctgcaaggattcatatgggacgttgatttaaggtggttccggatgttttgtctgatcttaggggctgccgaaacagtgattgtgatggccggtattgctattggatttggtgtgggtataacacgtgaataagaaactgtatcattcatcaaataggataaaaaataaaaaactgttctgtctcgttaaagtcatatatataaataggggattttcattaatttatatatatagatatacttgtgtacatgtacccgtaagtatcaaaagaaacgtgcataaggacatggcctaaattaatatttccgagatacttccttaagcggtaactttcttttcaatcaagtcgaatagagtaacaatatcggcagagaattttctgataccttcggacaatttttcagtggccatagcgtcttcattcaagtcgaatctgaatttagattcgtcgctgatgtaagaaatcttgtcgccggcttccttcttagcggagacagggtccaaaactcttgggaaaggttcagtactgttcatcaacttgtccaataaagctggagaaattgttagatagtcaacaccagccaagtttttgatttcgtcagtgcttctgaaagaagcacccataacaatagtcttgtaaccgtacttcttgtagtagttgtagattttcttgacggaaataacacctgggtcggcttcacccttgtaatctttaccagtgctggatttgtaccagtctagaattctaccaacaaatggggaaatcaaagtaacttgggcctcggcacaggcaactgcttgaacgaaggagaataatagagtcaaattacagtggataccgtccttttcttccaattctttggcagcttgaataccttcccaagtggaagcaattttaataaggactctttccttggagacaccttcttgttcaaacaatttaatgatatgtctagccttttcaatggtagcttgagtgtcaaaagacaatctagcatcaacttcggtggagactctgcctggaacaatctttaagatctccttaccgaattcgactaacaatctgtccacagcattttcgacttgttcttcggtggtcttaccatgcttcttaccgtattccacggcaacatcgatcaacttggcgtaagttggttgcttggcagcagccaagatcaatgatgggttagttgtggagtcttgaggttgaaacttggcaatagagccgaaatcaccagtgtcggcaacaacgacagtgccggaggctttcaattgttctagagagttgttagcaaccttttgtttcttttgagctggttcagacattatgtacacgtatatgtgacgagttcgagaagtattttactatcgtactaaattttacctgaaaaattatatactcgagaaagaggaagccaagaattgagaaaaaagaaaaacccgcgagtaaggaaattaaatacaggtgtacacatacacgcacacatatatatatatatatatatgtatatgtgtatataggaagcgcgcgcatgttagtatatacgattcgttggaaaggggccgtccaccaaacgtgacttgacgagttgacaaattgacctcaatatggctcagtcagtaatttttagttccgctttattcccgccatctttcaggccacgagggtagctcataacgccgcgctaatgccgctgcgtcacagcaaccagtagctcagccaaaaccgaaagagaaatcgtagctgtcccgatgaggacttatacacttgtcaccatctaaataaattatttattcgcgtttcggttcttgttttcgatttaattagattgttcattgaatcataataaatatgtaaaaaatatatatatttgaagctgcttcagaaaaacagggcttcctagtgtacagatgtatgtcggatgaaaaaaaaaaaatcttaaatgtgaaattgggtcaattcaattgactatgacttgatgttgcaaaaattccaagagaaaaagtttccagcacttgatattattttcctctttattggttttctggtctcaactttctgacttccttaccaaccttccagatttccatgtttctgatggtgtctaattccttttctagcttttctctgtagtcaggttgagagttgaattccaaagatctcttggtttcggtaccgttcttggtagattcgtacaagtcttggaaaacaggcttcaaagcattcttgaagattgggtaccagtccaaagcacctcttctggcggtggtggaacaagcatcgtacatgtaatccataccgtacttaccgatcaatgggtatagagattgggtagcttcttcgacggtttcgttgaaagcttcagatggggagtgaccgttttctctcaagacgtcgtattgagccaagaacataccgtggataccacccattaaacaacctctttcaccgtacaagtcagagttgacttctctttcgaaagtggtttggtaaacgtaaccggaaccaatggcaacggccaaagcttgggccttttcgtgagccttaccggtgacatcgttccagacggcgtaagaagagttaataccacgaccttccttgaacaaagatctgacagttctaccggaaccctttggagcaaccaagataacatctaagtcctttggtggttcaacgtgagtcaagtccttgaagactggggagaaaccgtgggagaagtacaaagtcttacccttggtcaacaatggcttgatagcaggccaggtttctgattgagcggcatcggacaacaagttcataacgtaactacctctcttgatagcatcttcaacagtgaacaagttcttgcctggaacccaaccgtcttcgatggcagccttccaagaagcaccatctttacggacaccaatgataacgttcaaaccgttgtctctcaagttcaaaccttgaccgtaaccttgggaaccgtaaccgatcaaagcaaaagtgtcgttcttgaagtagtccaacaacttttctcttggccagtcagctctttcgtagacggtttcaacagtaccaccgaagttgatttgcttcaaaccacgggtagtgatcattggcttaacgaaacgggcagctggtctgctgtaagcagcagcacgggtggccaaagcaaaggttctcttagcagtgatgacacgggagttgcagatcaatctggcggcttgagttctcaacatgttttattttttacttatattgctggtagggtaaaaaaatataactcctaggaataggttgtctatatgtttttgtcttgcttctataattgtaacaaacaaggaaagggaaaatactgggtgtaaaagccattgagtcaagttaggtcatcccttttatacaaaatttttcaattttttttccaagattcttgtacgattaattattttttttttgcgtcctacagcgtgatgaaaatttcgcctgctgcaagatgagcgggaacgggcgaaatgtgcacgcgcacaacttacgaaacgcggatgagtcactgacagccaccgcagaggttctgactcctactgagctctattggaggtggcagaaccggtaccggaggagaccgctataaccggtttgaatttattgtcacagtgtcacatcagcggcaactcagaagtttgacagcaagcaagttcatcattcgaactagccttattgttttagttcagtgacagcgaactgccgtactcgatgctttatttctcacggtagagcggaagaacagataggggcagcgtgagaagagttagaaagtaaatttttatcacgtctgaagtattcttattcataggaaattttgcaaggttttttagctcaataacgggctaagttatataaggtgttcacgcgattttcttgttatgtatacctcttctctgaggaatggtactactgtcctgatgtaggctccttaaattggtgggcaagaataacttatcgatattttgtatattggtcttggagttcaccacgtaatgcctgtttaagaccatcagttaactctagtattatttggtcttggctactggccgtttgctattattcaagtcttttgtgccttcccgtcgggtaagggagttatttagggatacagaatctaacgaaaactaaatctcaatgattaactccatttaatccttttttgaaaggcaaaagaggtcccttgttcacttacaacgttcttagccaaattcgcttatcacttactacttcacgatatacagaagtaaaaacatataaaaagatgtctgtttgtttagccatcacaaaaggtatcgcagtttcttctataggcctctactctggtcttttggcttccgcttcattgattacatctactactccactagaggttttaacaggatcccttactcccactttaaccactttgaaaaatgcggccaccgccttgggagcgtttgcgtcaactttcttttgtgtgagctttttcggcgctcctccctcattgagacacccctacttactctatggtatgcttgtagctccattatcttcatttgttctaggatgtgcctccaactatcagtctagaaagtacagtaaagtctctaaggaatcttctttatttcccgaagacagcaaactcgctgcttccgaactgagcgattctattattgatttaggtgaagacaaccatgcttcagaaaatacacctcgagacgggaagcctgcagcaaccacagtatcaaagccggcagaggcattgcacaccggtcccccaatccatactaaaaatctaattgcagcaactgctattgctattgttggctttgtacaagccgttattggcgtttatggggaaggacaatttatctagtgtttctcgttcacgtatttatctctacaagaatttgtagctgcctgaactcggctcctctctctctccaaaaataaagtgtgtagtaatttgcagtttttttatatattcctacgagttttcaaacgttcaaaagacagtatgttcaaaaattgtgcatacacacacgtatgcacatatatacataataatacactgtaataagcacatttgtaggtgctcttgcacttggtttattactgtcactgacttttctcacccggccgagagtcgtgcgaaaattcgcatgttaaagtgagaaaatagagaaaacaacacagctgaaaaaagtattggtaacagttcaatacgtgatcaaatatacagcacgtcgcgcagaaccagacgaagcggagaatattctacattgacagtgcatgatgcctgatgacaattcaaactcgtccactcaaaactcaagcgcattatacaaggacctgaggaaagaatatgaatctcttttcactttaaaggaagattctgggttagagatttcaccaatattcaatgtccttccacctaaaaaggattatcctgactactacgcagtgatcaagaaccctgtatctttcaatactttaaaaaagcgtattccacattatacagatgctcaacagtttatgaacgatgttgtccagattccatggaatgccaagacttacaatacaagagattcaggaatttataaatacgccttagtccttgagaaatatttaaaggacacaatctatccaaatttaaaagaaaaatatcctcaattagtgtatcctgatttgggtcctctacccgatgaaccaggttatgaagagtttcaacagaaattaagagaaaaagctgaggaagtagcgagagctaatgcagccagagccgagtcgagctcttcaatgaattcaacagaagcagccagaagattaagaaagactcgtacttccgtcaaaagagaatcagaaccaggaaccgatacaaataatgatgaggactatgaggcgacggatatggatatcgataaccctaaggatgctgattttcctgatttgataagaaagccactaataaatattaatccatatactcggaaaccattaagagacaacaggtccactactccatctcactcaggcacccctcagccgttaggcccaaggcatagacaggtatccagaactcaggtaaagcgtgggagacccccaatcatcgacttaccgtatattcaaagaatgaaaaatgttatgaaagtactaaaaaaagaggtgctagatagtggaattggtctaactgatctttttgaaagattgcccgatagacacagagatgcaaattactacatcatgattgctaatccaattagtcttcaagacataaataaaaaggtaaagactcgtcgttataaaacgttccaggagttccagaatgattttaatcttatgttaaccaactttagaatttcgcacagaggtgatcctgaaagcataaaaatttcaaatatcttagaaaagacctttactagtctggcaagattcgaactatccaaacctgatagaagtttcattccagaaggcgagctaagataccctctagatgaagtcattgtaaataatatatcataccacgtgggagattgggcacttcttcgaaatcaaaatgatcctcaaaaacctatagtgggccaaatattcaggctatggaagacaccagatgggaaacaatggttaaacgcttgttggtattacagacccgaacaaactgtgcatagagtggatagattgttttacaaaaacgaagttatgaaaacaggtcagtaccgtgatcatttagtgtcaaacttagttgggaaatgctatgtgattcactttactagatatcaacgtggtaatcccgatatgaaattggagggtcccttgttcgtttgcgaattccgttataatgaatccgataaaatttttaacaagattagaacctggaaggcttgcttaccagaggaaattcgtgatttggacgaagctaccattccggtaaatggtagaaagttcttcaaatatccttcccccataagacatctactaccagctaatgcaacgccgcatgatcgcgttcctgaaccaacgatgggatccccggacgcgccaccattggtcggtgccgtttatatgagacctaaaatgcagcgtgacgatttgggggaatatgcaacctctgatgactgtcccaggtatattatcagacccaacgattctcccgaagagggacaagtggatatagaaacaggtacgatcaccacaaacacgccaacagcaaatgctcttcctaaaacaggatactcaagtagtaaactatccagtttaagatataacaggtcatctatgtctttagaaaaccaaaatgctattggccagcaacaaataccactgtcaagagttggttcccctggcgcgggaggcccgcttactgtacaaggtttaaagcaacaccaattgcaaaggttacaacagcagcaacatcaataccaacaacagaaaagatcccaagcatcacgttataatatcccaacaataatcgatgatttaacatcgcaggcatcaagaggtaatttgggtaatataatgatcgatgcagcctcctcgtttgtcttacctatctctataaccaaaaacgtagatgttttgcagcgtactgatctgcacagccaaaccaagagatctggaagagaagagatgtttccatggaaaaaaacaaagggtgaaatattatggttcagaggacctagtgtgatagtaaatgaacgaataataaattcaggtgacccacacctaagcctgccactgaataggtggtttaccactaacaagaaaagaaaactagaatacgaagaagttgaagaaaccatggaagatgtgactggaaaggacaaagatgatgatggcttagaaccggatgttgaaaatgagaaagagtccttgccaggcccatttgtccttggattaagaccctcggctaagttcacggcgcacagactctctatgctgcggcctccttcgtcgtcttcatgatcacctttattgtaaaagcaatggcagcataatatcttcccattgcgcattaccctccgcgagcagagtcaaacttcaaacaaagcaggaaaatgaaataaaacagaagttattatatagaagaaagtcatctatagatatattatcgttgtattaatagtagccatataaaacaattatacttcatcaccaacctctcaaaatttcttccccaaggaccaaagcttttccagtaagttgctacaactaaagtgaaataaactatccgaattatataaaagatgcctgactatgacaattacactacgccattgtcttctagatatgcctccaaggaaatgtcagcaacgttttctttgagaaacagattttccacatggagaaaactatggttaaatttggctattgctgagaaggaattgggcttaactgttgttacagatgaagcaattgagcaaatgcgcaaacacgtcgaaatcactgatgatgaaatcgcaaaagcttctgctcaagaagccattgtaagacatgatgttatggcacatgttcatacatttggtgaaacttgtccggctgctgcgggtatcattcacttaggtgctacttcctgtttcgttacagacaatgctgatctaatctttattagggacgcctacgatattattattccaaaacttgttaacgtcatcaacagattggctaagtttgctatggaatacaaggatttgcctgtattgggttggactcactttcaaccagcacaattaacgaccttgggtaagagagctactttatggatacaagagctattgtgggatttgagaaactttgaaagagctagaaacgatatcggtctacgtggtgttaagggtactactggtactcaggcatcattcttggccttattccatggtaatcatgataaagttgaagcccttgacgaaagagtaactgaattattaggtttcgataaggtatatccagtcactggtcaaacctactcaagaaaaattgacattgacgtgttggctcctttgtcttcttttgctgctactgcacacaaaatggctactgacataagattattagccaacctgaaggaagttgaggaaccttttgagaaatcacaaatcggatcctctgctatggcttacaagagaaacccaatgcgttgtgagagagtgtgctccttggctagacacttaggttccttgtttagtgacgccgttcaaactgcatccgttcaatggttcgaaagaactctggatgattctgctattagaagaatttctttaccaagtgcatttttaaccgcagatattctattatctactttgttgaacatctcatccggtttagttgtgtatccaaaggttatcgaaaggagaattaagggtgaactaccttttatggctactgaaaatatcatcatggctatggtagaaaagaatgcctccagacaagaagtacatgagcgtattagagtgctctctcatcaagccgcagcagtagtcaaggaagaaggtggggaaaatgatttaattgaacgagtaaagagggatgaatttttcaagcctatctgggaagaattagattctttactggaaccatccacttttgttggtagagctccacaacaagttgagaaatttgttcaaaaagacgttaacaatgctttacaacctttccaaaagtacctaaacgatgaacaagtcaagttaaatgtttagaagcctttacatgtacaaataatatgtttattaccctattatatgttactaatgaaaaaaataacaattctttatttatgtacaatgcaagtagaattccctaaatagaagttaactatttttattttactgggatatatttttcatcttcttccttcatactcctttcatttttcttgtttttttggcttacggattttggcaatgtttatactttagaaaaaaaggaaactcataatgctggcatacttgaaaaaccatacggaaagatcgtagtttatttttgtaataagacactgaagtcagctgtttgaaagagtatattgaattgatggttttacctattagggatagtaatcataatttaaaaatatgaaacggttcttactcagtcgaagacagagacaccttcgtatgatttgctttcacaatataagtctctttagagctaatggtgactccaaattgatcaaggaatatggtgatggatttataccatgtttctttatcttggaatccataagaggggagctgctttatgtgagcgaggtacaatcaggttctttgcgtaaactctcttttcaggaattaccaaaactaactggtgcatctactatgattgtcctaaaattggtaggactagttccgagtgatattttgtgtaccataagttcagataaaaatggtatcattgacgataaatggtgcgttttatgtacctacacgatagatcttaacaagttacaacccataaatgaagacacagttctaattacaggcaccaacgcaccagtacttgatttaatagatggatcctacacattggctgcagaaaaaattaagccactaaagggccttgttagttctcacaaaaggaatataagtcaagtcaagatcaaattttcattggcatatagctctttactaaaattaaacaaactattggagtattcttcccaagtccatgaggaaatcaatgaaatttccagcaaaatagaagatgactttttgtcactcaagaatcaaaatcattggtatatgagaacagtacagaagtccatagaaacgctagaaaaggaagtcctacaaaggaaaaaaagcaagaaaaatatagaaatggcgcaactcgagagtaatgatactatcaaccattctaaaacagaactgtctctgatgtcgcaggacgagtctataaatgatgactatggaagcatatattctagatttgtgcaaataaaagataggttggaccaactgaggtttaagaaactgtatcagctgatagggatcttccattcaacggatttatttaattcagatagaggctatatttactttgaaaaaccttctagcgtaaatgatgttattaataggctcaagctaaaacctttgaatatagagatattacttagacaagccggcgaatccacaaagcacagagaatatgtaaacagccagttgggttattaccttttatttctccatttgacagccatccaaattttcaaggctcctttaccctatagactaatgtattatggtagtacatcagtgatcgacagtcaatatccgttgtatttcactgatcaaatgatttctaagcatcaagcaaagctgattaaagccatacattattttaatgctgatatattgcaatttaaacagattctggagaattaccgtccaacatagactgaaaatcaaaaatctcttttggactgccatttaatcttttccatgtgtgtatattgttctcatttacattaatttcataaatacggatacgtctttctgtacctccatagccagcataaccaccttctccacctccaccgccatagcatagccagattttgttcggcgtagagtcatctcgaagacagtaatcgttacaatggtcatgtccgcaactgacgacatccacacttaacctatccaaagttgttatcccctcagaattatacttaggtgcagtaacaccttctttgtacattccaatgaggggatttttctctccgggatgtgtcttggattcaatattcaagtattctggcagtgggatgtgaaaaaatgccattgaaagacctgttttgaacttcaagttcacatcatgataatcttcaatgtatttccactgtgattccttaatccaatcatatccaggataaattttaccaaccgtagaatatttatgtgagtccagaaaataaagtgtacctactgggacttctgtatcattgttcgaaaaaatctgataaatataattaccaacgccaaacgtattatcgtgtgtatcatggggactaaacttgaaaagggaatatggtagtactgaagctatttcggataactgccagcgcgttaagcttccctcgtcgtcgtgatttccccataccattgcccacggaatttttcttgcaatgacgggtgctaccgcctttaataatacggtttcagagtcttgaatagatctatcacccatgatttggtcaccagtaaaaacaaccaactgcggtttttcaatgtcaagaacttgttgaacgaaagtttccgtttttggatctgccttgcaagcttcatgctttggatactcatcgatacattcagactcccccacacccaagtggagatccgccaactgaacaattttgaactttccttcatcagtttcttgcagccgttgagctcctgtgtctacaggacgagtaccaacgaatttgtaagtcaaataagcaggttcgctgtagcggtattttactaagggaaattctttttgaagagtccaatttgctatcggctggatgcaatcaacaccaaagagaatgttaatatcgcttatgtagctccttttctgcaatagttctatgctaataggctcgaatgtgatggatacatccataaagggtagcgatttgtctttaggatatttggaaattccagttactgcctcaacatttagcttttctaggttggatccaaagtagtccaccaaagcagggtataacacatcatagtaaaggtattctgactttccaaaccacctgcgtccaaaggaacctctcaagtctttatgaattcttttcctttgtaagtattggtgcccatcagttaaagttgatttaagttcatgccgattaaaacatccttcataaaaacgaccaatatgaaaacattcgtcatagcctatatttacaactagcttatcgtcatttgagaatccctctagacctttattttggaaccatagattatcaacgtgtgatatcgggagtgcaaggtcgaaaccaatgtgctcttcaactcttggcgcctgtaggaagtaaaatagggcaatcactacaaaaactaccaagtataataggtacctttgatacagcctcggtaaccggatcatgttaagatttttaaccacggtgctggtcttcgatacttaagtataaaacttgtatcagaggtatctgcgatctaaaaagattaatttttgaaaaagatcaacactaaaccatttgaaattcaaaaagcacctaaggcaaaatataaatctaaatatacgtaaaatggaaacactttctgcgcagctttatacaagttagccttctagcttatgaaatagaaatgaaatataactgagcaagtcctatatacaatactattaatgatcttcttgtccatgagactgttcatggtgccttttagagacttcttcatcacttatctgaggcctgtggccacccgttctcaataaaccaccggcagtatcttcaactggaaatcttgcactgggtcttacgcaatggggcttgcgtaactgttcaaaatccatgattttagttttccctcccccttttaaagtaatctttggattctcgcccaacttttcctccacttcttttatattttgggtgcgttctttactattattattattattattattactaactgccattatagtttctttatgctgtcctcaccatgcctttcgttatcaggctagcattaaaagccttttaaggtgtaaagctttcgccgcgatggctttaaacagtagaaaatattcatatttacacacatgcataaagagagaccacttaataaagctagtatgataagatcaccggtagacgaaatatacatggaacagacacaaacagcagagggcactgacttactaattggtgacgaaaagaccaacgatttaccttttgtgcagttatttctggaggaaataggatgcactcaatacctggatagctttattcagtgcaaccttgtcacagaagaagaaattaagtatctcgacaaggatatcctcattgctttgggtgtaaacaaaataggagacagactcaaaattttaaggaagtcaaaatcgttccagagagataaacggattgaacaggtgaatagattgaaaaacctgatggaaaaagtaagctctctatccactgctacgctatcgatgaattcagaattgattcctgaaaagcactgtgttatatttatcttaaacgatggttccgctaagaaagttaatgtaaatggttgctttaatgcagattctattaagaaaaggctaatcagaagattgccacatgaattattagccacaaactccaatggagaagtaactaaaatggtccaagattatgatgtgtttgtcttagattataccaagaacgtactgcatttgctatatgacgtggaattagtcactatttgccacgcaaatgatcgtgttgagaaaaataggctaatttttgtttccaaagaccaaacaccaagtgataaagctatatccacatccaaaaaactatatctaagaacgttgagtgcattgagccaggttgggccatcctcgtcaaatttgttggcacagaacaaggggatttcgcataacaatgctgaagggaaactccggatcgacaacacagaaaaggacagaattagacagatttttaatcagaggcctcctagcgaatttatttctaccaatttggccggatattttcctcatacagacatgaagcggttgcaaaagacgatgagagagtcatttcgccattcagcaaggctaagcattgctcaaagaagacctttaagtgcagaatcaaataatatcggtgacatactattgaaacactcaaacgctgttgatatggccctattacaaggattagatcagacaagattaagcagtaaacttgacacaactaaaattccgaagcttgcccataaaaggccagaagataatgatgccatatctaaccagttagaactattaagtgtagagtctggtgaagaagaagatcacgatttctttggggaggacagtgacattgtttcattaccgacgaaaattgccacgcccaagaattggttaaaaggtgcttgcattggatcaggcagttttgggagtgtttacttgggcatgaatgctcacactggtgaactaatggcagtaaagcaagtggagataaaaaataataacattggtgttcccacagacaacaataaacaagccaattctgatgagaataatgagcaggaggaacaacaagagaaaatagaagatgttggggcggtaagtcatccaaaaaccaatcaaaatattcacagaaagatggttgatgctttacagcatgaaatgaatttattgaaggagttacatcatgagaacattgttacttattatggtgcttctcaagaaggcggaaatttaaatatttttcttgaatacgttcctgggggttcggtttcctccatgctgaataattacggtccatttgaggaatcactgattactaatttcactaggcaaatactgattggggttgcgtatttgcataagaagaacattattcacagagatatcaagggtgcaaatattttgattgatatcaaaggttgcgtaaaaattactgattttggtatttcaaaaaaattatcacctttgaataaaaaacaaaataagagagcttctttgcaaggttccgtattctggatgtcaccagaggtggtcaaacagaccgctactactgctaaagcggatatatggtctacaggatgtgttgtcattgaaatgtttaccggtaagcatcctttcccagatttttctcaaatgcaagcgatcttcaaaataggcacaaacacgacccccgagataccttcctgggctacgtcagaaggaaagaatttcttaagaaaggcatttgagttggattatcaatacaggcctagtgcccttgaattgctgcagcatccatggctggatgcacacataatttgaaaaagggctacttattaattctttttatggcactaaagtgctctggccgattttttatcaaataatacatatatatcatatttagtgacatttattgaatatatctgctatttaccggtttttttttttcaattacgctgattaagtaatcataaatcacaattgtgaaaaaaagaccaaactagatgacggtatttgattctcatacccctggaataaaatcaagtaagataattctgataaaaaaatccgaccgcacagatggaagcacgaagaaacaggcctttctttgcgaggtgatatcaaaccattgatatcttctcaataacctgctctaggaaaaggaggtagatagacaaaagcaaggaaataatccatagagtttcattcacatgaataatctgttaccaatttttctcataagataaagccatctatcaaaaatgatattgaaatatttgaaaaatgcttgtttttatggggaccacaattcgcctgtacctctagaagcgtaaactgttttattgaagttagtcctgataatttctctaccgttttcgctttcttccttagtgccattttttagcatcatattattgaatttttcactttctctaaatgatttatcattcatgtccttggacaagattgaatctacatcaacaattgaacaggaaggaatattgcattgcatggccatttcccggatttgaggatcttcactaattaaaaaccaatgtagcccctcatttccttctaggtagcatttgtaaatacaacttttcaacaaattctttaatctcttaggcaattttgcaatattaatctttccagaactatcattatgttccattacatctgaccataaaataatgtctaaaacttcgggaaattcgataaaaactttcaaattagcaaatttagaatcatctaatctatcgataaacttcaaggattctcgagctgcaaaacttttacgcctttgttgaaggaaatccaattcatttaatgtgaatgttggaatataaaagttcaaagtcacagcttctgtacagtccgagcaccacctcttgatgttgcctagacccttttcaaaagctgaagcatctataatgaaattatattgtgtcattaacctgctttttgaggagaccaaaattggaaagaaagaaggtgcttatatttcacgaatgaatgatattagcaggtgtaatattcttctataacaccactacactaacttttaaattaaagcgctcttcattgttacttcaaatcaatttctgagattatgaaagtcgtcacgttttacgaaggtattgaatttttcaggttcttttggaaaatagtagtatacatcagtttattaacgatgagatggtattattacttgcaccttttgtaaagataactagtattcataaagtccataagctacaatatgcctcaaaaaccacttaaagttactaagaaagccaaggacccccgtagggtcacaaagaaacaaaaaaatttgagaaaagctgccccattgcaattgaaatcaaaaaagaaatctttgcaacatctgaagaaattgaaaaagagctcttcccttaccgaaaccactgaaagattagttgcgagtaaagtcgggcatttggagttgttgagaggtactagaaaggagttggaaaaaggtaagaagaactctaaatgatttcaagtgaataagattcgcccatcattgaaaggtatttattttcgggtaaggactatctaggtacatctcatcaaattttttatagtccaatttgatcctagtgtttgtatattagctttgtaacttctaagttatccaatagaaaaaatgcgttgcttttttgtttcccgcgagaaatttaacaatatggtgaattaagtgttgatgccacagtttgtaaaaaaaatcgacacaggtttgctatttaagcagacgtaagtgttgtaaaattatgtattcccagtttggccagaagaggagtaaatatcgcatatttatagaataagtacaacatcaaataatgtctgcctttgttactaaagctgaagagatgatcaaatctcatccatatttccagttatccgccagctggtgccccgactgcgtctatgctaattccatttggaataagttgaatgtacaggacaaagttttcgtttttgatattggttcacttccaagaaacgaacaggaaaaatggagaattgcgttccaaaaagttgttggtagcagaaacttaccaacgatagttgtcaatggtaaattctggggtactgagagtcaattgcatagatttgaagcaaaaggcactcttgaggaggaattgactaaaatcgggcttctgccttgaacaggttggatatttttatattaatatgtacgtaatatgtctggaatatttcgaaaacacgggtaagcaaataaaggcctcccattcttccttctatagaagcgtgagcgcttcctcattaacctcttctttagcagtccatatgtaaagatatccaagagattgttcccataaaacgttgacgctaagcaccttcatcagtgtcatatagaaagacagcgctccaagcaccatttccgttttctttcattttggaatggttaaataatgactatctatgatagtttaaaaataccaatatcatagaagatgaaagtcaaatatatgactaaaaatttaggtgaaaaatgtaatttaatgtatacctttcatttacaaaatgtcaaagactttacacagtctccgcgtcaaattatcacatgaatgtacaatcacttttctgactgctctaagctatgtcattgcgatgcagaatttcactgccgcatagacaattttgtgtttcttttgacggtgaattcatactcatctgttccgtttatgcacatttacctcccacttcgctcttagcgattttatgtcacacaacaactttattcgtttatgccggactttcctacttatacataatggaaaacttaaaataattttaaaaggaaagtttctgccacatataactagttctcttttcttatatgcaattcggttgcatacttaaaagtaatcagaccgaatgaacatgtgcctttgcattacttcttttcaaaggacatctctttgcaagctaaccatctgaaaggccgatgaatggtcaaaggacgtcattcaaaacgcaaagggaatttccacattattttacgtaatgcttcgctgttacaaagacagaaacttgacaaatcaaggtcaactggatcgttgctcgaaagtcgccgtcagccatgcgttttactttcgtttgcaaaactctttctcttgtgtatcgtatttagcccgaaattagactataccaaaaaaaagaccaagattcttaagcttcatcaatcctttggaactgcaactattcttacaatctttcatttacatggctcaagaagtgttgctgctcaaaatttcattctatttcatgattatttacattaaacaagtatgatccgttattcttctcgcaaccggagtgctcgagaagtgccagtaagacgacaccctatttttcaagtccagcattggaagacttccaatgaacactcttatcattattctttatgcattacgtttcgcagtaatcctagaaccctaactttttctaaaattaccgtcaaaaatgacggacgcaacttttctcagaaattttttttttcatttctcttaaaaagttttctacgctggataaattgttctcttccctttgaaatatggagacgttcaaagtcaatttccacacatttaaggtgaacaaataaattataagataccacattaacaacaagtatgtggacgaggtgtggtaagatctccgctgaggttgattgaaaagtattgggtaaatttgtactttttgtctgctgctggtcgtttgtctttcgttttaaaattgcgctagacaagtaaacagggattgcttaagaatcaaagtagcttaactctaaagtattattttcctcagttgtgggcccatgtgttggagggaaggaatatattgaaatgtaaatgttcttaagttcggttgaacttggatattgttacaagagttctagtctttgataccatttttacgcaattacaaccgcattatttaccttttcatcttcagttttacggttcagtttattctgttacgaaagaactatggtgattcaaaggcgaagtgcgtaggattgtaactcctatatctttaggatacttacaattttgtactgttttcaagaccactgtaaccgataataaaccggaggacacattttaacccactatttttttcagaagatcagatgcgagagctcgaagcataagtataatactaacgtttcaaaacatagtaattaggtaaaaaatgactcgctcttccgttttagctgatgctttgaatgccattaataacgccgaaaagaccggtaaacgtcaggttctattgagaccttcttccaaggttatcatcaagtttttacaagttatgcaaaagcatggtatgttccaactatttttcaatattttcacatgtgtttcaatttctgcttatttttaaatgttaccacgaggtttgtccaagttcaatgttgcgcaactctaacgaagaaataattattgccattgttttttactccgggctgataactagatggtgtgatcgggcagtatactaatttatactggacaaagactcgtaaaagatgttctttgtgcttagtcccatactgttttttaagtgtccgggatatttaatcccatgtggaaatgcttcttacacggttatggattacacctcatgtgtagctactatatccattaccgtttacttttcctcaaaatctcactcttaaaattttcaatggcaaaattcttccgcacaacttagacaacattttcttgttttttatgaagtaagcaaaaatttcgaatcaacaacgctccatgagattcttcaatactaacatttactccttatttaggttacattggcgaattcgaatacattgacgaccacagatctggtaagattgtcgtccaactgaacggtagattgaacaaatgtggtgttatttccccaagatttaacgttaagattggtgacattgaaaaatggaccgccaacttattgccagccagacaattcggttacgttattttgactacttctgcgggtattatggaccatgaggaagctagaagaaagcacgtttccggtaaaatcttgggttttgtctattaagtaagtttttagtagtggtacatatataatattaattcttatatccgtcttttctctttggttattttctcagcttcagatattcaaggaaccgtatttttgcgtaatagcgaaaaattgtttatgttacataataagtgaaagctggaggagcatatgtatagaatcgaagagaaacctgaacaatttttcggtattagttactaaaaggctcacatatacatgacaaagaggagaaacctctttatggttggttcttccttcacaatagatcatttacctccagaaatatggctttgtatttctaagctggtcgggacgtctgacctgcataacttgtgtttaattaacagaagattgtatttgacaattacaagtgatgaaatttggaaaagaagatgctatgaccgatggataaatcgagaaagcttagatattttaactggtaatgattacgattctatacccgtctctcaatggtattcttactatttaagaagagcaaaatgggagaataaaattttttgtctattatgggggttaactgaagaaacaaatccccaacatttcagagagaaatatttgcatatcctccaatttagacattacaaactggctacatttctgcataggattataaaacaaggctacatacctgataaaagaccacttgatttaatcacgtatgcaaactatctgttgaaaaatgtgcgacataagtacgtatttcctttattttatcccacaaatgccgctgaattgaaaaatcttaataatatggcctcaagggatgctgaaatgatatatttaagattatctgccattgatacgtcttttgatgacttactagatgctagagaattcatattaaatggaatatgttccgatctactacaaaagtataaaaaaattgaagagtttttgaaattacgaccggtgactagggtttccaagttaatctcaatcagtactgactatctggactgcttcacacaacctcatgattcagtgggtcaaacaaatgatagggccacaggaagggagctacatagagaggatttcatgttactaagagtatattcccgagaaggacgaggttataaaactatcattctagcaataatacaggctatcactaagagatataacgttgattcatatcttgctcgagatcatttggtggtgtctgaaccagactttccagatggacgggcatttgttaccgtgaatgaggatttccagccatacatttttgataaagaggaccttttgagcgtttggtcgaacaacttccataacgcagaaaattttgaaagtacagttttaccagcattattagaaccaatatcgatacaacatcttctgacggagttctttcgagaactgctgcgatgcaagcccaggccatttgagggatatccaaacagagcacacggattacgcgatatgtttccatacggaaaagtggaagttcccagagatgtgacgatgtattttgcatttatatacgatcttttcgatggcatgtttgaatctggaatgacaagtttacggggccagatgttgagagatttactgaactacgttaacgctaataattttggtgatttgaatatcatcattggacaaaatgctcttaaggaaccaaatgactgctggtccaacaagagggattacgttcttcttgatgacaataataagattggatatttctatacggatattgaaactgaggatactttatgtgccttaaaccaatatgaagtggacggcaaagtttttataacaacaatagatatcttgggtgatataagagtacgcctggctgaaggactaacgccttttcagggagataatgataagttgtgggagagcttttcttccgttgttccacgaactgactggggactttttttcaaaggctatgacaaagaaaggcgtagaatgcaattaaacccttacatagaggaaaagctttccaatctagcgaatgatgaacagcctttacataatttatagtcatatttaaggaggtttccaaaagtagcatcctgacacattctattacacctttttttatcagcccgagcggcctttccttaacggtgtatacattttctaacagtattaagtcaaaaacagcagcatcaaaagtacgactacttttacaagatttctttagatatttacttcacatagaagaagaaaatcaacggaataaaaatccaaaaatcatgcttaaatctggtagactcaactttctcaagttgaatatcaattcacgattactatactcaacgaaccctcaactgactaagaaggtcattggtatcgacctgggtaccacgaatagtgctgttgcatatatccgtgattctaacgacaaaaaatcagctacaatcatagaaaatgatgaaggacaacgaaccacaccatctatagttgcctttgatgtcaaaagctcgccacagaataaagatcaaatgaaaactcttgtagggatggcagctaaaaggcaaaatgctattaattctgaaaacactttctttgctacaaagagacttattggccgtgcattcaacgacaaggaagttcagcgagatatggctgttatgccatataagattgtcaaatgtgagtcaaatgggcaagcctatctcagcacgtctaatggtctcattcaatcaccaagccagatagcatctatattactgaaatacctgaaacaaacttcagaagaatacttaggcgaaaaggttaatttggcagttattacagttccagcatattttaatgattctcaaaggcaagccacaaaagatgccggcaagttagctggcctaaatgttttgagagttattaacgaaccaactgcggccgccttaagctttggaattgatgataagaggaataatggattaattgcagtttacgatttgggtggtggtacatttgacatatccatcttggacattgaagatggcgtgtttgaggttcgtgctactaatggtgacacgcatttaggtggagaagattttgacaacgtcattgtaaactatattatagataccttcattcatgaaaaccctgaaattacacgggaagaaattacgaagaacagggagacaatgcaaaggttaaaagatgtttctgaaagagctaagatagatttatcccatgtgaagaaaacttttatcgaacttccatttgtatacaaaagcaaacatctacgagtgccaatgacagaggaagagctggataatatgactttgtcattaatcaacaggactatcccacctgtgaagcaagcattgaaagatgccgatatcgaaccggaggatatagatgaagtaatccttgttggtggtatgacccgtatgccaaagattagatctgttgtaaaagatctttttggtaagtctccaaattctagtgttaacccagatgaaacagttgctttaggagcagctattcaaggtggtattctatccggtgaaataaagaatgtcttacttttggatgtgacaccattgacattagggattgaaacatttggaggagcgttctcacccttgatacctagaaatacgacagttccagtaaaaaaaacagagatatttagtactggtgttgatgggcaagcgggtgttgatatcaaagtttttcagggtgaaagagggttagtgcgtaacaacaagttgattggtgatttgaaacttacaggaatcacccctttgcctaaaggcattccccaaatatatgttacttttgatatcgatgcggatggtatcatcaacgtatctgccgctgagaaaagtagtgggaaacaacaatccattactgtaataccaaattctgggttaagcgaagaggaaattgcaaaacttattgaagaagcaaatgcaaatagggcacaagataacttgatcaggcaaaggttagagcttatctctaaggctgacattatgataagtgatactgagaatttatttaaaagatatgaaaaactgatttctagcgaaaaagagtattctaatatcgtagaggacatcaaagctctgagacaagctataaagaattttaaggctaacgaaaatgacatgtcaattgatgtaaacggaataaaaaaagctacggatgcgctacagggtagggcattaaaattattccaaagcgcaacaaaaaaccagcagaatcaaggtaaataagtgaacaaaacacaaataagacttgtatattaacgtgtatatcgttcattaaagcatattttgacgtatttatactttatacatttatatatttctttcccgtttcaaattttcggttcaaataaagttgcatgtggattattatgttcccataaattctagtttttattattttccttgcaccgtatacctttatagagatttgttcatgaatcttcttcttgtgaacgccaaccaaaactttgagggatattccttagaatctgtagagctatagactctttctaatagtctcattgccaattcttgacggaattgctgaatataagtcttcaacaagtccatcgaattatgatcttgtactggaacttggtaaacattattcagagggaaacccggtgtacctggtaaagtaaagttgtccaaggccacattggttaacactttgacggcttcgttaaatgacgttgttattttcaaatgggctaggcaatcattgataaagagaattccgtagatgagcactctgtcggcgggtgatttaatttcaaaattcttgaagaaggaattggcacgaaataggtccaagcactcgtcgataatatcgtaatcggaattgctggggtatgcaggacccctgaacttagtgttcaagggcagaagcgcaaagttccctaccatgcggtcagtgttaggatctacagggaaagtcgagtgatacgcaggcatttattaatatactgggagtggagagactgataataccaataatcttcctttattgatgtttgttactgcgcaccaagtgtttaatttattgttattcattgttatactaaaccaaaccgcaacggaaaggataggggttcgtggtggatgatccgcgtaacggccgagtctgtgaaactgagagagaatgatagtgaaaacaatggtatggaagtccgaggtcctaaggcttgaagaaagtttttaaagggcattatgaccagtgagtactgacgacctaatttaataacagtattgagccgattaggttttcctggattttttttttgctgttttatagctatttttttatttgttgtttgtggtcattaatatattcattcgctctgttagtgtaatcgattacagtgctctattactgctgacttaattggacaattcatctcttttcctgcggttatgagcgaaaccaacgttgacagcttaggggacagaaatgacatatactcccaaatatttggtgtagaaaggaggccagattccttcgctacttttgatagtgactcgcacggagacataagttctcagctgctgcctaatagaatcgaaaatatccagaatctaaatgttctgctttctgaagacattgctaatgacatcattattgccaagcagaggagacgttctggagttgaagccgccatcgatgattctgatataccaaataacgaaatgaaggggaaaagctcaaattacattttatcgcagcagactaatattaaggaagttccagatacacaaagtttgtctagtgctgataatacacctgtgagcagtccaaagaaggcaagagatgccacatcttcccatcccattgttcatgctaaatcgatgtcccatatatattcaacgagtaatagtgctagtagacaagccaagcactataatgaccaccctttgcctccaatgtctccaagaaatgaagtttaccagaagaataaaagtactacagcttttgtgcctaagaggaaaccttcgctcccgcaactagcacttgctggtcttaagaagcagagcagtttttccaccggcagtgcatcaaccactcctacacaggctagaaaatcgcctttgcaagggtttggtttcttttcgagaccaagttccaaagacttgcacgaacagcaccaacatcaccagcatattcagcataataatattaacaatcataataataataatactaataataatggcgcacattatcaagtgggtagtagtaacagtaattaccctcaacattcacattctatatcatctagatcgatgtcgttgaactcatctactctaaaaaatattgcatcatcttttcaatcgaagacttctaacagcaggaaagctacgcaaaaatatgatataacttccaacccattctcagatcctcatcatcatcatcatcatcatcactcttcaaacagtcacagtagcctaaataatgtccacgggtctggaaactcctcaagtgttatgggaagctcgtctaatattgggttgggtcttaaaacgagagtttcttccacctcattagctttaaaaagatacacttcggtttcaggaacttctctatcttctccacgtagaagtagtatgacacctttgtcggcatctagacctgttatgagcgcttcatcaaaaaaacctcaggtatatccagctttgttgtcaagagtcgccacaaaatttaaaagttcgatacaactcggggaacataagaaggatggattagtttaccgtgacgcatttacagggcagcaggcagtcgatgtcatctgtgctatcattagaacttctgatagaaacttagccttgttatttggtagatcactagatgcacaaaagctgttccatgatgtggtatacgagcacaggttaagagattcaccacatgaagtttacgaatttacagataactcaagatttacaggaacaggttccacaaacgcccatgatccactgatgctactcccaaactcatcatcttttaattccgggaaccactcttatccgaattccggaatggttccatcaagttcaacttcatctttgaatagtgatcaggcaactttgacagggtcgaggctacatatgagtagttcattgtcccagcaaaagaaccctgcagccattcataacgtcaatggtgtgtttacattactggcggaatgctattcccctacgtgcacaagagacgctttgtgttactctatttcgtgtccaagacgtcttgagcaacaagcaaggttaaatctgaaaccaaatggcggcctgaaacgtaatatatcaatggcattggatgatgatgacgaagaaaagccatcttggacaagttccgtatctaaagaggattgggaaaacttaccaaaaaaggaaataaaaagacaagaggctatttatgaagtttatatcacggagaagaactttgtaaaatcattagaaattacaagagacacattcatgaagactttggctgaaacaaatattatttcagcagatattagaaaaaatttcatcaagcatgtttttgcacatataaacgatatctattcagtgaatagacgttttttgaaggctttaactgataggcaaagaagttcaccagttgtgagaggaattggggacattgttttaagattcattccattttttgaaccatttgtttcatatgtcgcttcaagaccatatgcgaagtacttgattgaaacccaaagatcagtcaatccctattttgctagatttgatgacgatatgatgagctcctccttacgtcatggtattgattcgtttttatctcaaggtgtttcaagaccaggtcgatatatgctattggtcaaagaaatcatgaaatctactgaccccgagaaggacaaaagtgattatgaagatttaagcaaagccatggatgcattaagggattttatgaaaaggattgatcaagcaagtggtgctgcacaagatagacatgatgtaaaattgttgaaacaaaagattcttttcaaaaacgaatacgttaatttaggattaaatgacgaaaggagaaaaattaaacatgaaggtatactatcacggaaggagttgtcaaaatcggacggaacagttgttggtgacatacaattttatcttctagataatatgctcttatttttaaaggccaaagcagttaataaatggcaccagcataaggtattccaaaggcccattccattgccattgttatttgcatgtccaggtgaagatatgcctgcgttgaggaaatatattggagaccacccagattgttcaggaactgtaattcaaccagaatacaacacgagtaatcctaaaaacgcaataactttcttatactacggtgccaagcagagatatcaagttacattatatgctgcgcaatacgctggattgcaaacgcttttggaaaaaataaagcaaggacaagcagctattataagcaaaacggagatgttcaatgtaacgaaaatgagcgataggttcttcgattacaccaacaaaattaacagtgttacttcctgtgatgggggtagaaaacttctgattgcaacgaactctggattgtatatgagcaacattaaaagacagcagaataaagatcatagacataaaagctctgcttttttttcaactccaatccaactagtacaaagaaataatatcactcaaattgctgtattagaagaattcaaatcaatcatacttttaattgataaaaaattatacagttgtccgctgtcattaatcgaagcagaaggtaatgggacatctttcttcaaaaagcatcacaaggaactgatcaatcatgtgagtttcttcgcagaaggagattgcaatggtaagagattaatcgtgactgcacacagttcatcgcattcaattaagtacttcgagcatgaacatccattattggccgaaaaaaatggtagtggtagcggtaacaaaaaaagtctcaagaaaaaaatcaccgaggttatttttgattctgaacctgtctctatttcatttctcaaggccaacctatgcattggctgtaaaaagggttttcagatcgttagcatttcacagaatgctcatgaatccttgttagatccggccgatacatcattagagtttgcactaagggatactttgaaaccaatggcaatctatcgtgtgggaaatatgtttttgctgtgttacacagaatttgccttctttgtcaataatcagggttggagaaagaaagaatcgcatattattcattgggagggagagccccaaaaatttgcaatttggtacccgtacatcttggcattcgacagcaacttcattgagatcagaaagattgaaactggcgaattaattcgttgcgtccttgctgataagattcgacttctacaaacaagtactcaagaaatcctgtactgctacgaggattatcgcgggtatgatacagttgcgtcgttagatttctggggttaagatagcaacgtatatagactttccttattttctttagaataaaaagcataactaaagttgtaaaaggagcagaattatgaataataaacattgatgacaatagtggaaaacgacataaataataattttataatataataatgataattcaccgtcagagggatttgtatgcaaatgattgatgacgcgagaaaaaaaaacgcgaaatttttcttcccaaagcttcgaagtttttattccgtccacaaagtgaaaaattttcagaaaattttccagactgtgaataaacaaaaggttggcttacgcatttggcttgtcttttttttttttcacaggttcttagtaaataattgtataaaatatttatctggagtcttctgtttgttgtttagccttgtttgaagttttatttaacttattaccccagttaggtactgtgtattttccgcatatctggtgtctttttatttggtcattgattggtttttgacagctcttcactcgcttcaagcttacttctagtttatttattcggcttttttccgtttgtttacgaaacataaacagtcatgaacactaccacatctactgttatagcagcagttgccgaccagttccagtctttgaactcttcttcttcatgtttcttgaaggttcatgttccttccattgagaacccattcggtattgaattatggccaattttctccaaagtgtttgaatactttagtggctatccagctgagcaattcgagtttattcacaataagactttcttggctaacgggtatcatgctgttagtattattatcgtttattacattattatctttggtggccaagctatcttacgcgccttgaacgcctctccattaaagtttaaattgcttttcgagatacacaacttgtttttgacttctatttctctagttttatggttgctgatgttagaacagttggttcctatggtttatcacaacggtctattctggtctatctgctctaaggaagccttcgcaccaaaattagttactctttactatttgaactatttgaccaaattcgtagaattgattgacactgtgtttttagttttgagaagaaagaagttattgtttttgcacacttaccatcacggtgccaccgctttgttgtgctacactcaattaattggtcgtacttctgttgaatgggtagttatcctactaaacttgggtgttcacgttatcatgtactggtactacttcttgagttcatgtggtattagagtttggtggaagcaatgggtcactagattccaaattattcaatttttgattgacttggtatttgtttactttgctacctatacattctatgctcacaaatacttggacggtattttaccaaacaagggtacttgttatggtactcaggctgctgctgcttatgggtatttgattctaacatcttatttgcttttgtttatttccttctacatccaatcttacaagaaaggtggtaaaaagacagtcaagaaggaatctgaagtttccggctccgttgcatccggttcttctactggtgtcaagacctctaacaccaaggtctcttccaggaaagcttaaataggaagcgagaatttttgacagcgaatgaaaaagaaaaaaattaaatgttaacattttctttatattaaatatgtacgataaatgaaatcattattatagaaatgatagattattggcttggtgtttttcccattttgattaatcatttccttagctgcccaaagaattgcacgcttacagtgaggagtagtgatacattacaattataaaataaaattatatagcagctaaaatttaaaacaaacagactttgttcctttgtatgtcctatggaagatactgacttgcagtttgtaaagtgtccaagtcgtaatccactttacttgccacgaattgatcattgaataatttaattttaataatctcttgagttaaatcgggatgtactctgggaatgaagtcatttaaaaatgagtactctcccctaatggaggaagatgactgacattgcattatcttgaacaaaattctaattatcggcccagcatcattatctaagtattgggaccagaacgcgttacacacaggaacatggatatcaagtaactcttcaatgaagttcattggttgttctagctctccaataatagagtcctctgttattattctcttcttgaaacggccactatctctaatgaaattgctttgttcacaatacgacctgtaagatatgggtacgatggagtttactgtactcaagtaatcatataagtcctcttgaatgatttgtaaaaagatactatctatttcctttgatatggtagagtccgataaatgatgggtatcgctaagagaaccaaatgataggttattattgctattctgtggttgttgttccggtaatacagaattttctccaccagtaggatctatatctattcttgatgcgggcgtatttgaattcgagtggttgtcgttgtcgttatcatgttcgttatcattattgtcgctgttgttgccgcttctattgttgatgttgttcgtctgattatcagtgtgaatgttcatgttgctatgattggaagtattatgactgttgttaacgttgcctattgtgtgtaaattcaaaaaccttttcaataaactgaaaattgatgtagaaagtttgtcgactatttcagaaagtgaaatggtatgaaaagaatattccaggacttctctttcgaataaaatcgcaggacacaagaacattgctaaaaggttcatatcgtctgaaaataaaatggttttgaattcttgaattttagacaaaaatgtttcaaatggtgcaattaaccgttgaaattgtaggctgcccaaggtggacaacagatgcttttcaatagacattatggcgaacaaaacataggtaaagtttaagcttttggaagaagtaaagaactttagtattctattgatggaattcaaagtaattaataaatagtctattatttgaaagtcgatttcgttgaatttttcaatttggatagaagattgatattcttctattatgggacgaaggttcaaaaaagtttgcagtgaaacggtggcggtagagtaacgggataaatcgaatttcgaacaaacgaattcgaagccaaatttttcacacaatgaacggaatttatctaactgccacgaattagattgtaaatcatccaaaaaagaattgattctggaaaaaatggaattcgaaatatctatatttgacaaatcaattagagagtccaataaagtcaaaggttctttggagaatgatgattgtctcggatgcgtaatatcggcggatttaggcgtaccgaacaatggcaatatcgcagaatttattatggaaataatgcaattgtgataatagtttttagcattcgtatacgtattcgggaaaaagggttggctatccattacgtttagtagatctactatttgagatcttggtagagtgatagaaatcacagtattttgtaaaccaggtaattcttgtgagattttgagcagttgagctggaatagatagtttggggtcattgttatattcatgtaagttttggatgataaggggtaaagtctttacttgggaatgaaaatcatcatagtactgaatactcaatatagatatcgtgttattccaaacggagtggcttagagagaaaaaattgattttttgcatttcaaataattggttcttcaacctgtttgataactgattagatctatcggttgggtccattagtaagtagtttttgtcgataatcaacgacaaatcggaattgtttcgcaaagctgtcctttgaatgattctatcgagattatatgcgatggacctgatagcattcagaattaagtcatggtcaatgaagcttagtgagttggcgttctgattgatcaaaaggcgtacggcagtgttgtctacgaacgacagaggcaagttttctgatgcaattatgatcgcaagcgactgcacaagaggcaaggccatttctttttccctagttctcttcaaaaagtcctcgtctatttccagcaggttagcaatgctgttcgttgtggcgctaccgccttgatggttcttcaaaggtggtctgaccataaaagtagaacctgcttctacgcccgtccatccgctatagtaattggcattcgggtctatcttatgcgtgctccacaaatgagtttgcgaggcttccgccatgcttatgctgtttccttgccgtcttattatcacaccgcagtacttgcattttactgcctccagcatcttgtctacacccagaaaatggcccaagtagcgtgacctgtctctggtaagcatatatgcgggcacccattcgctaccatcctctgctaacgactccctttcctcatctctatctccatctgtatctgtatccgtatttgtggccgtcgtagccgccgtcgccgacgatacagttgaattcatgggaggcaacaccaatcctctttcagcactctgtacctgtgtgtccatcgctctcatatgtgctctcgtgcttgtttatcctgtggatgctgccagcaaactctctctttcccatctcttgatggttcatgttatgtgttgtttattgtttgctgatcccattcgcgctttcccggccgtggtaaatgactacacggtgaataattgcgccattttttcgccgttgcggtgttttttttgtagccgttggaagcatggcagtaccatctggaacaaagcaacggtataaagaagacagactgttggtaagcgctgcatgttggtgacaaaaagttggtttcgagaaatcagggtgggtgttttttgtgtggcatgtgcagcgagcgatgagtaatgcaaacaatagtgctatgaaccacatcacgttgcctcccatctcgtcatttgacaaccttatcaaggcagccgagagacaatataatggcgaggcttcgtccgcctcgacacatccgacactgcctaatatgaacattagtaacggcagtggcagtgcgggcgcatcatcgtcgatgctgagctatcagttgcttccgcactccaatgatgtgtcccggtcgaactccagctcgagcttccttccctccgtgcagcagcctacggaaggttccgcttctgcatcggaaacttcttcatctgcatcaccttcacgttccatttcaccaattttaaaagtggctggtccttcatctgttggcggtgccggggtgagtaccccccatagcaccaaaatcaataagccaaggaaaaagaagcaatgtccaatttgtcgtaatttttatgccaatctgaccacgcacaaggcaacgcacttgacgccagaggatcggcctcacaagtgtcccatctgccaccgcgggttcgccaggaacaatgacttattgaggcataagaaaagacattggaaggatgagatactgtcccaatcgggagtactttcgaaccataatgatggtaagggaggatccgtttctcccaatgatgatgatacccatgaaaaaatgacaccgatgaattctgtcacagattatgcacaattgaaatcgttgcatcaaatcaagggcacattcaagtgcccattcaactccaccttaatacaattggacatggatatgtacccgtataaactgaaacctttaaattttgagacttccaattgtcaccagacgggggtgttctcacgttgcgacaccttcaaaaaccatttaaaggctttgcattttgaatacccgccaggcacgaagaaaaaggatagaaatgttgttcctggtagatgtaagcattgcggcctgaagttcgagaacgttgacgtttggctcaacgaacacgtaggtaaacaatgcggctataaataccattgattcccggcagcataacgacttttcccctgtttttattagtactagtagatatttaatttatgtatctgagtttttaatgttttttttccttctcttatcattcttcaagtgcggctatccttctgtactgtggcctgccgtcaacaacttctctgtagattatcagatccattcccttcatgtatgaatcaggtagttttgtggggtacagtgtaacgccgcttttcctcttgattgaccacttatcaactaaggtgttttcgataccattatagaagtctgtgggaaaacttttggtgatgatccagcagcccaaaaattctcttagtttccttagaatcttaaacagtttttcaaatttcgataaatttattacatcatagtttttgtcgctttcaaaattcaagaaagacaaattgtcgattactattcctcgtaattgaaagttgaaattatcaacctggcacctccttaacgcatccatgggagagtcatacagtaactctagaaatacgattaatcccgtgatgtttatgcaagatagcgaattcatgtagatcgcgccatgctgtctttgcttttgttgggaccatattgatactatatctatgattaggatcttttcgtcccccgtagtacaattcaccaacttttgcagcgctaccgaaggtttaaaatcactttcaatgatgtgcaagaaccctagtttactctcctgctcttcactaattaggtttcttaattcatttggtaggtttatatagttcttggttgatgtgatgaagtttgacaaaggataaattctaatgttctttaaaacttccatcccattccattcgctacttcctttctcttttcctaagaattttcattattagaaggagtaatgcttacggtacacatacatacacatatatatatataaatatatatatatataaggacatatacagatttttttttttcgcgtactaaagtacagaacaaagaaaataagaaaagaaggcgatcattgaactactgtgacttgccaatatggtctaaaaatttgtcaatttcacctgaagaacccaaccaaatagaagatttgtcatggatatgacttggcaccaaatccaagattctctctccgcgatcgttgaccgcttttccccctgcttgttccattaagaaagccattgggaaggcctcataaagcaacctcagttttccgttggggctcttcttgtcgcaagggtatgcgaaaaggccaccgtaaagaaacgtcctgtgaacatcagcaaccatggatccaacatacctagccgagaaaggcttgttgttgttgtctgcttggggttgtttgactttctcaataaatgttcttatagtctcgttccagtagagggtgttaccttcattaattgagtagatggccttttgaggcggaattcttaagttaggatgagtcaagatgaattcgcccaagtttgtgtctaaggtaaacccatcaactccatcacccaatgtcaatactagatgcgtagaggatccgtacatggcatagcaagcggctaccatttctttaccacatctcagtacgtcgtttatagtacctgatgagtctggtagcagtctgaatatagacgcgatagttccaacggagacaccggcgtccaaatttgaggagccatcaataggatcacaacacactgcgtatgagcccgtgtttgtgggaaaaacgatcaagtcttcctgttcttcagatacaaggaccttgatgatcccactagccctcatggcattgataaatatttcatcacctagaacgtccaacttcttttgctggtcaccagtgaagttggaagcgcctgctaacccaaccaagttaaccaattcagcacgtctgatggtgtgagatacaaatttgaacgcgaattgcaaggcattcagtactaatgtgaaatcaccagtagcgttcttaaattgcttctggtgctcgattatgaatctaggaagagtgatgatatcggtatcaaacccttcggtagagtctcttcttggtccatttactagagttggcatatgtgtggtagtatgagggatgtttcttatatgttcgcactgttattcttaggcctatcatacaaaaagcaagatcaagacaaaatacacgtctgtaattgcactacttgttgctccatatatatacgtacatttgttagcgagtgaaatggataatattgcctatacataggacgatccttataatatagtgtggggaagatgccacaagttggcaagcgacaggaagaaaccaagcaaaccaaaaaaaaagtagtgggtattggccagttcggcaatcttcgccttcaaattccctgtctcaactttttaagctttcttgatatgtgggaataccaggctattgctgccttgcgttggctcttacgcccttaacattacctagctttactacataatgagctttcgggcccgcataactccgggtgtccgcacgaccgcgactactaagaataataataataccccggaggtgaattcaaaagcggcgattccatccgtccggaaaagagagcagaagttagcccgggaccatgcagtttgatgggttgtctatcttagactggaaaattcgaagaactcatccttgttagctcagttggtagagcgttcggcttttaagcgcatttgcttaagcaaggataccgaaatgtcaggggttcgagccccctatgaggagttctttactttttttttatcaacttcctttgcttcacgcctattataaatttagatcgcgtatgatattgttaatcggcggttagaatttataaaaatcgacgattttctaggaattatttgcgcatacatatatatagttatttagctctatacaggtgtaagaaggcgttgataaaactatggtaacaaaataaaaaaatagagggaggggtgtggctaaatgcgattttttttttctttggatattattttcattttatattcacatcaaatcagaaaatcctggaacgaggttcttagtaaacccaccttccttggcggcagcttcgtagtagccgtagatggtggtagtagccatcaaaatggatgccccagaacctaaagtacctagtaggtcggagccaacagaaagagcaccgatggtagcaccgccgaaagcagcagcagttggaatgatcttcttcaattctctgtaaatggaggtttctctcttaccgttaatgaccatgccttgatctttgaattgtttggcaatgtcacgtggggaagtgccggagatttcgatccatgtcttggaaaatactgcgcatgaaccaagaacaaatgtgatgtagacgatggtcttgatagggtccagaagagcttcggataaagacattaatggttggatgtagtaggccaacccgctcaaggccatttgagggccctgggtgcccggcctgataccccaaacaccgatcaaacgaatcaatggattggttgggtatttctggaaaaggatttgagagatcaagaaaatgttagaagtcaatgcactctgcaacatgattggggtgttggaagtataaaagagtttgatggggtagataccaatttgacctctcactttggttgacctgatgggcaattcgtaacggaagccttgtaaatataaaacaaagaggaagatggccacggtcatcaacacttggaacatattaggtagattggtacggtaaaaggcctcgacaagggctcttttcttgtcctttctgacagccaaaagatggaaaaaggcaatcacagcaccttcgaactccttaccacgaccggaattgactgtagtaggagcaaacgctctccagaaaatttgttcggcaatattggttgccgtgaacagagaaataccggaacccaagccgtaacccttagatagcaattcgtctaataacatcacaatcagcgatgcaaacatcaattgaaagattaacaacaaacagatgggcaatccgaggtccgaaggggcaccgtagttacctgtcatgacgaccacaagggcttggcccaagatcagaataatagcgcacaccttttgagcaatttggaacagctctctgtcctgcttgctctcaggtctgatttgtaaaagctgagtaccctgcaaaaattggaaaatcatagatgaagtgatgatgggcgaaacacccaattccagtaaagtaccacggttggaggccagcatggcacgtagccagtacagagggtcggaagtctcactggacacgatcccgtacagcggaatctggcccagaatcaaaaagatcagtagagaaacgcctgtccagataagtttctggttgtatggaaccttcctttctggagcaatcacttccggcaggaaagattcaaatggcttaaacaagtctagaacacggttggaggacattttcaaagtaaagcgtgaaccagtgtcagtttttctacttgctactatatttaactatgtttttttcttttgctttcaccaactgaaccttgtagtaaatggagtgaggttgaattgaggactgaaaaaaaggttagttcggaggccgctgaagtttccgattgggagcaggaattgaggatggagggtgcaaagtgaggtccttgatttgttgtttttacactaaactacgttaccaccgtaacgccaattcaaggcaggaattatgcttgttgtttggcaaaagttgccgaaagaaagaatgagagagaacgacaaagagaatgagagagaacacgtaaagcgaaaaatctggagcgctgccgcgccgggtaacaagtgtgaagagagagagagatgtaaggaagatgaatacattcaatacattctagcttatagcaagctttcagcaggctcaattgcttatagcggtataactgcaacaagagtgaaaattaatatggtgacgaacgacggattcggtagtacagtgttataatgccggcaattaccgtatgccatcggaatccagatgcatttctgaacctttccactcgggaaaaccactcgtcatgtcacacggagagttggccatgaactggctaatgggatggtctaaggcgaccactgtaagaagaacaagagatgatgcaagctaaagcaagcaggtctcaaataaacgctacttgtgccgttgacagcttgtttatcttgcacatggcaaggccatcgcgtccctgcgtcccaagagtgcgcggtatacgtgcggccctaaacgaggcggtctctgttctctgatatatttcttttctttcttcgttgttttgtttcgtgtttgttgagctcctgccttcaatcggcatcgtcctcttgcgtacgtacataaaatcgttacagctttgttcacatggtgaaaacaatagcgtttggtacgctctttaaatcttggcacttggtcacttacgctcctttaaacaaaatcaaacatacaaatatacggatacgtacgcacacagaagcataaaagcacaaaagcacataagaagaccacatataaactagattatgtcctttgatagacagttgaccgaagaccaggaggtcgtccttaagcaaatttggacacaccttttccatctgtggcaagttcccgtggatggaactcatattttccctaataactccctccactcctcgtccacccctgctaagaagaagaaatcatcctggtttagcaagcttcagtcctcagaccatacacaggactccagcgaagccgctgaagcggcacacctctatgaaaagggcaagatacacaaggcactagccaatctagacccgcaaacgaccaagaagcagttctggcacgatatcaagaatgaaactccagacgccaccattttgaagtttatcagagccagaaagtggaacgcagacaagaccatcgccatgttgggtcacgatttgtactggcgcaaggacactattaacaagatcataaacggtggcgaaagagctgtgtatgagaataacgagaccggtgtcattaagaacctggaattgcaaaaggccaccatccagggttacgacaatgacatgaggccagtcatccttgtgagacctagattacatcattcttccgaccaaactgaacaggagctggaaaaattctccctgttggtcatcgagcaatcaaagcttttcttcaaagaaaactaccccgcatccaccaccatcttgttcgatctgaacgggttctccatgtccaatatggactatgcccccgtcaagtttctaatcacttgttttgaggctcactacccggaatctttgggccatctacttatccataaggccccttggatctttaacccgatttggaacatcatcaagaattggctggatccggtcgtcgcgtccaagattgttttcactaagaatatcgacgaattgcacaagtttatccaaccccaatacatccctaggtatctgggcggagaaaatgacaatgatttggatcattacactccaccagatggctctttggacgtccatctgaaagacaccgagactcgcgctatgatcgaaaaggagagagaagaattggtcgaacaattcttgactgtcactgcccaatggattgaacaccagccattgaacgatccagcatacattcaactgcaggagaaaagagtacaactttccaccgctctttgtgaaaactactccaagttagatccgtacatcagatcaagatccgtttatgactacaatggttctctaaaagtttgagccaagccacgcgacgctccatactgtatagacctttattataaaaacatctatttctttatatgtccctctatcttatttttcttttacttttatttgtataatacgcgaaaaattatagaatcatttattatcaaaaacaatcaactatgaaatgaaaaacaatacgcctgctaatacggttcgcccttcaatttttgttttttttacatgaatgagtcttatactagatgatatcatcctctcactaacgaatgctaacgaacgaacgccaccacaggcccttaaaaccactttaagcctgctatacgaaaaatcaaaacaatatggtctttcttcgccgcaactacaagcacttgtaaggttactctgtgaaacttccataatagacacagttacaaaagtgtacatcgtcgaaaattgctttttacctgatggctacttgacgaaggaacttcttttggagattattaaccatctcggtacgccaacggtattctctagatatcgcatacaaacgcctccggtcctacaatctgcgttgtgcaaatggttagtgcatgtttatttcctatttcctgtacattcagaacgagaacacaatatatccagttctatctggttacatttatggcaattctcgttcttacagaagtggataactcccctggttatttggcaagccacgacgcccgttgatgtcaaaccttggaagttgtctattatcaagagatgcgctatgcatccaggttaccgggacgctcccggtagtgcgacgcttattttgcaacgatttcaatgtctcgtgggcgcatccagtcagattactgaatcaataattaccatcaattgcaatagaaagactttgaaaagtcatcgaaacttaaaattggatgcgcatttcctatccattttgaaaagaatattatccagagcacatcccgctaattttcccgctgacactgtccaaaacacaattgacatgtacttgagtgaaattcatcaattaggtgctgattctatatacccacttcgacttcaatcacttccagaatatgttccctctgacagtacggtctctctttgggatgtcacttcattggaacaattagctcaaaactggccacaattgcatattcccaatgatgtagattacatgatgaagccatctttaaacagcaatgttttactgccgcgaaaagtcatgtctagggattctctcaaacacttgtactctagtatcattctcattaaaaatagccgcgatgagtcgtcatcaccatacgaatggtgcatttggcaattgaagcgatgctttgcacatcagatagagactccgcaagaagttattcccattattatttcggtgtcctcaatggataataaactgtcttctcgcattattcaaacgttttgtaatttgaaatacttaaaactcgatgagcttacgttgaaaaaggtttgtggcggaatcttgccattatggaagcctgaactaatcagtggtacaagggaatttttcgttaagtttatggccagtatttttatgtggagtacacgagatggtcacgacaataattgcacattttctgaaacttgtttttacgttttacaaatgattacaaactgggttttagatgataaattgatagcactcgggttgacactactgcatgacatgcaaagcctgctaactttggacaaaatctttaacaatgctacttcaaacagattttctacgatggctttcatcagctcgttagatattttaactcaactgtcgaaacaaacgaagtcggattatgcgatccaatatttgattgtgggccctgacatcatgaataaagtgttcagttcggacgatcctttgctattatcagctgcgtgcaggtacttggttgctacgaaaaataaattgatgcaatacccgtcaacaaacaaattcgttcggatgcagaaccaatatatcatggatttgacaaattatctttacaggaataaagttctgtcatccaaaagtttgtttggagtctcaccagatttctttaagcagattttggagaatctttatatcccaactgcagacttcaagaacgctaaatttttcacgataactggtataccagcgctatcctacatatgtattattattctaagacgactggaaacggccgaaaataccaaaataaaattcaccagtgggatcataaatgaagagacgtttaacaatttctttcgagttcatcatgatgagattggccagcatggttggataaagggcgttaataacattcacgacttgagagtaaagattttaatgcatttgagtaacactgctaatccatatagagacattgcagcattcttgtttacatatttgaagagtctctcaaagtatagcgttcaaaattcttagaatatgcatccacatttatatacatatatatatatatatatatattataacttccaaaaaggagattggacaatttatatctataaggcattaatatttaactatttacaagcactagtggtaaattcatggcgtcatatgattacttgtggaataagaaactaatcacattgaatttcatgacaaattttttgatttttttattcatcaaatacattctcccttccggtaagttcatcaaagtttcaataacagcatccctacctaatttcaaaaagtttttgtcagccgtgtacatgaatttgactctgccatttaccacaatttgaaactttttgaatttggactcagtagtgcgctcaacttctggccagcggtattggttccattccatttgggagttgatcatctctgcagcttcttctgaaattgacgggacagcaggatatataacggttaccaacttttgtaaattctgtactatcatttcattccttacttcaccttttttcaatgcactttctaaaatattggttagcttcatataatcagatattacagtgtttaacgatagattaacttcaaatgattccgtaattgatttcaagaagcgttggaaatcgttgtgaaatttcacttctgcatcatttaagtcggtcggggtcttgtagtctttacttattgccaaatccttctcgagactgagaatatttttggtcaaatgaagaaccttctgcaaccaacgttctataccaacaatcttggattcatcccaattcagggcatctgcaattggactttggaagaggatatgtgctctcgtagcatcaggtccatgtcttaaaatacattcatttggatctgcaccattgtatttagatttcgacattttttcataagagactaccggaaccttgccatttgatttaataatcactgtgttgccatctggagagtcatttacaaaggttaactcgtcaggcttcaaaaatttaccagaatcggggtcaacataggttttcccttgaaccattccttgtgtcaccagttttttgaatggttcgaagatgccagcagggtcgctccatgcattgatagatccgagaaatttagcaataaaccttgagtataacaagtgtaagatagcatgttctactccaccaatataaatatcaaccggcatatttttacttgcaatttcacgatcaaatggttttgaagtgtttttgggatccaagaatctgaaataataccaagaactatcgataaaagtatccatggtgtcagtttctcttttcgcagggctcccgcatgaaggacaggcgacatttacaaattcatcgattgtggacagcggattcccttttgtatccaagccttcaagttctggtagcttgacaggtagatcactttctggaacggggacaggtccacagttgtcgcagtgaatgatgggtattggagtaccccagtatctttgtctacttatcagccaatctctaattttgtatctaacgacgctcttagacagtccttcgctattcaacatccccattatcgatttccttgccactacagtgagaactcctgagtgttctccgcattctttggttaggacaccgtcagtagatgtgaacgggacagtatcaattattctttgtctttcctgttcagttacttttgaagcatcgtcaaaaaaaggtgctatgcacgtcttgatatgttcaccaggacaatttgtttgccaaaactcaaaatctcggttatcgtgtcctggacaacccattactgcactaggtgctgaaccatagctgctgaccacatatggagctgcaaatatggggacttcctctttagttaagggatttacggcctttatgttaggtaactgaaatccttccttcgtatcgtttggtaattgatcacttttctgtataaactcttttaaatccggcatttcctcgcagtatttttgtacaattgggtggtctaatgcgagagcaacatactgtacagcaaaaagagtttccggtcttgttgtaaagacaatcaagttttcaaatttggggtccgcaactttgaacactaattctgcacccacagattcgcctatccaatttttttgcatttgcttcacgttggaaggccagtccttcagttggttcaagtgctttttcaatttaggagcgaatttcgttattcccaaaaaccactgttttagctgcttcttttccacaatagcccctgatctccaagaacggccctgggcatccacttgttcattagccaaaactgtcatatcaacgggatcccaattaatttctgcttctttacgataagctaagccattttcaaaaagttttaagaaaatccattgggtgaatttatagtattcgggatcacatgtagttatttctctgtcccaatcaaaatttgccagcatactttgcatttgttgtttcatttttgcaatattgtccctagtccatatggccggattaatgcttctttctatagcagcgttctcggcaggtaacccaaaagcatcccatcccatcggatgtatcacgttgtaccctttttgtttgtaaaatctattcaaagagtcgctaatgacataaactcggagatgtcctatgtgaagcgccccagaaggatatggaaactggcacagaatatatttcgacccgctattcagagtatcctgcttaggcaagccacgggttgtcttctgtttccatttctccccaattgcaattaattttttcactgcaggtccagggccccttttagtggataggaatcggcttgaaggtcgagacagcatttttccaccgtacacacacgtcgatttattcacgtacagactctacaatatagagtactagcgccttgtttaacactctgctgtgctccttcctccaagttcttgattctccaccggagcaacaaaacgactttcttcggtttctttgattcttcgcggagataagaaatgagattcttggatcaaaaagtgtgtcagaggtagggaaatgtcaagcaagttcatgaacagaccaggagtagtatggcatggtattaaagatttttctgtggtatttgatagttaggcaaaaggaacattttcatccaagttttatcaaaatttctgttttatagtgaaaattctaagttaaacttgccaaaaacgcgtcgcgtatactaaatttcaatgtttggatctatcaacatgaatatttatatttcatgtagtgaagttcataataagaaaaaaagacaagaggcatataggttcgcaagagataagtagctgctgttaataataataaagagcatattcttgttagattgctaaatggtatgatttcgactacgattagtggtaaaagacctatagagcaggttgatgatgagctactttcactgactgcgcagcaggaaaacgaagagcagcagcagcagagaaaacgcagacgtcatcaatttgcccccatgacacagtttaacagcaatacactagatgaagacagcgggtttaggagctcctctgacgtggccacggcggatcaagataactttttggaagagtcaccttcaggatatattaagaaagtgatcttgcgaaactttatgtgccatgaacattttgaacttgagcttggttctaggctgaattttattgttggtaataatggtagtggtaaaagtgcaattttgaccgccattactattggtttgggagccaaggctagcgagactaacagaggttcctctttgaaggatttgattcgtgaaggttgttattctgctaaaatcatccttcatctggataatagcaagtatggtgcttatcagcaaggtatttttggtaacgaaattatagtagaaaggataattaagagagatgggcccgcttcttttagtttaaggtcggaaaacggcaaggaaattagcaataagaaaaaggatattcagacggtagtggactatttttctgttcctgtaagcaaccccatgtgtttcctgtcacaagacgctgctaggtctttcttaactgctagtacctcacaggataagtatagccattttatgaagggtactttacttcaagaaattaccgagaatttgctttacgccagtgctattcacgatagtgcacaagaaaatatggctctgcacctggagaatttgaagtctttgaaagctgaatacgaagatgccaaaaaactgttaagggaattaaatcagacttcagacttgaacgaaaggaaaatgcttttgcaagcgaaatcgttatggatcgatgttgcccataatacagatgcttgtaaaaatttagagaatgaaatcagtggcattcaacagaaagttgatgaagttactgagaaaattaggaataggcaagaaaagattgaaagatatacatctgatggtactactattgaagcgcaaattgatgcaaaggtcatttatgttaatgaaaaagatagtgagcatcaaaatgcaagggaactgttaagagatgtcaaaagcaggtttgaaaaggagaaaagcaaccaagcagaagcacaaagcaatatcgatcaaggtagaaaaaaagtagatgctttgaataaaacaattgcgcatttagaagaagaactcacgaaggaaatgggcggtgataaagatcagatgagacaggagcttgaacagttagaaaaagctaatgaaaaattgagagaggtaaacaattctttagttgtaagtttgcaagatgtgaagaatgaggaaagagacatccaacatgaacgtgagtctgaattgaggacaatttcacgcagcattcaaaacaaaaaagtggaattgcagaatattgctaagggtaatgatactttcttaatgaattttgatcgtaacatggatcggctcttaaggacaatagagcaaagaaaaaacgagttcgaaactccggcaattggacctctgggttcccttgtaacaattagaaaaggttttgagaagtggacacgttctattcaaagggctatttcatcttcgctaaatgcatttgttgtgtcgaatccaaaggataacaggttatttagagacattatgaggtcgtgtggcataagaagtaatatacccattgttacttattgcttgagtcaatttgattattcgaaaggtagagcgcatggaaattatccaactattgtggatgcactagaattttcaaagcctgaaattgaatgcttattcgttgatttaagtagaattgaaagaatagtgttaattgaagataaaaacgaagccagaaatttcttgcaacgaaatcccgtgaacgtgaatatggctttatcgctaagagatagacgtagtgggttccagctctctggcggatatcgactagatacggttacttatcaagataaaattagattaaaggtcaactcttcatccgacaatgggactcaatatttaaaggacttgattgaacaagagaccaaagaattacaaaatatacgggaccgttacgaggaaaagctaagtgaagtgaggtcaagattaaaggaaatagatggcagactcaagagtaccaaaaatgaaatgagaaaaactaattttaggatgacagaattaaaaatgaatgttggcaaagtagttgatactggtatattaaattcgaaaataaatgagaggaaaaatcaagaacaagccatcgccagttacgaagccgctaaagaagaattagggctgaaaattgagcaaattgcacaggaagctcagccaattaaagagcaatacgattctacgaaattagcattggtggaagcacaagatgaactgcaacaattaaaagaggacatcaacagtcgtcaatctaaaattcaaaaatacaaagatgataccatttactacgaggataaaaaaaaagtctacttagaaaatataaagaaaattgaagttaacgtagcagctttaaaagaaggtatacagaggcaaattcaaaatgcttgtgcattttgttcaaaagagcgaattgagaatgttgatttaccagatacacaagaggagattaagcgtgaattggataaagtctcgagaatgattcaaaaagctgaaaaaagcctaggattatcgcaagaggaagtcatcgcattatttgagaagtgtaggaataaatataaagaaggtcaaaagaagtacatggagatagacgaagcactgaacaggttacataattccctcaaagctcgtgatcaaaactataaaaatgcggaaaaagggacttgttttgatgcagatatggattttcgcgcatcattgaaagtaaggaagttctcgggaaacctttcctttattaaggataccaaaagtttagaaatatacatcttgactactaacgatgagaaggcaagaaacgttgacaccttgtctggtggtgaaaaatcgttttcccaaatggcgctgttattggctacatggaagccgatgcggtcaaggattattgcgttggacgaattcgacgttttcatggaccaggttaacaggaagattggtactactctcatagtgaaaaaactaaaggatattgccagaactcaaactattatcattactcctcaagatatcgggaaaattgcagatatcgatagttctggtgttagtatccacagaatgagagaccctgagagacagaataattccaatttttataattaatgtttcttcatgtaattattcaaaatattgtgtaatcgtctatttgaattcgttttcacggcagcatatttgaaaaaaaaattaatttttacatctaaacataaaaaacctaatcgttttctttccatgctgttatagagacatttattagtacgaatattttcctttctttacgagcactatagacagtaatttatataactaagaaaatggtatgctcaaaaatcaacaatatgactcttagggaaatcatgaatctctggaacaggtatttctgggatataatatacttccccattttcattaaccctttctctatccttttcgctaatagaataaatttctttaacgttagccttcaataaatcaagtacttcaacaaagttcttttgaatttggtgagcttgctctctcatgtttcgtctacaaagaccctcaacaactctcacagcgtctggttttgtttggtttaacctctcaatcaatcttccgactgactgaaccaaatattcttcttcataaatagttcccttcttaccacgagcacgcttacgctcttccctacgcttgtttttagctgtacgtctggaagcaccagtctttgcagtacccccagttttgcctgtgtatctggtgaagaatgattcttgtgttgacgtctcagaaggagcaacagaaacgtcatccgcttgctcagtttcctggccataaaaggcgtatgggttctcctccttcttcgcgcgtagctctctcaatcttcttaactgtgaattaatctggcctttacaatcggcgagtaattctgcaattataccaaaaccttcgcctaaaccgggatcgacaacttcttccaagagttcatctttcttggcctttatcgccacaagagaagcaatatcatatctataggccttacagtacaaagctacggcttctttaacattgtccaaatattccaattgaatatcagcagcatcaacatatctatgttcaaaagtcaaagaagatatcaactcttctgcgactgactcaacttcctctgggaatttctgaacagcgatggacatggcctcacgccatcttttcgctgattggtatgcccccattgcttctttgagctttcctagcatctcgtacgccaccgccgcatccgtatacatttgatttgatgacaaatgctttgcgtaaatgttataaataacattctgcttctcagaatcataacggtaaagtgctaaaccatgcttatacaaatcatgagattcaacatagtctatgacttcctctgaaacattaccatctttatcaatttcggacaagtgttccaaagctttttcatagttccctaagtaatcatcaatcaaaaacttacggcgtaaaggctcattatcttgtaattcttgtaaaaatggcagatattcacgaggatccatttgtgatttttgggcgactaataatgctaaactgacatcatacaaagatagggcagatttataaaccacgttgacgtcttgcaaaaaacacaagtaagttacacaagagtctttttcttcagaattttctagttcactaattagttttagtgcagccgataagttttgagggttttgggatgcatatgctgtaatgatcgtttgcaagtatttcttcttgtattcaggattgcttaataaaacatttagcacagcatcgcatattttgttgactttagaggttttgggatcaaacattttctttttcatatatatttgcatttcagtcagtggtgctggttccattccaaatgacttcgagatacctgaataaagggtttccttatattttgttttggtaacgtcatcttccgacaaacaggaaataaataaattgagataatcaacccttccgatttggttgataaatacttctaagttttcaataaataactctggcgcatagtcatgcaaaatatcaaggttaattctgtgtgtacgacaaacaataaacgcctctttataacgttttgccatgatattctttcttacctctgccagtaccataattcttggataaattgtttctagattaccacgtgtggcttgcaaaacaacggaagacttagatggaataacggacactaaaatggaacctctttcaatggcacgcactctttcatcttccacaccctcctctaccaaaggcaatggcttgaaatcggtggaatttaaatgcacaaactgtaaattgtgttgtgccgtggtgaacaacagaaaggaatcggtaatctccaaggaagtaactgccgaagccaaaagaacttgattagcaaataacttaccgttatttgtgataccaaatgcaactaactcagaactttctgcagaccagttgtcatcatcttctgctgatgtgttatggactctttttactctaaaatcacgtaccaattgaggaaacttggtaatttccattaactggccttccgcatccaattggcaaactgtaccatcgcgagtttcatacaccaagtggttataatcaaagtcacttcttagtaaaacgattttatcatagacctccacaatagttattaaagttggttgcgtaatatcctggatatccaaaagcgctattctagaaaggttatctgtgtcaagcaacacaccgacaatggaatcgttaataaatgcaacttgccttaaagagtcaacctcacttgtgaactcagatttggggaattcgcagactatacttggatgtttgccttttttcatttcttcgatacttgggacggctgcgaaaattagaacatctttgttgattgctgcatatatttcattcgaaaaactgcacgctacatccaatacatttcctggagtttcaaaatcacgatagtacattggaggagggacattagcaagagctagaggagtgatattcactgtccttccatcaacaacaagagaggtaccgttatcgaacggctctaatgtcggaccctgcgccatcttataagcgaaatcaacgatattgataaatccagcatcagaaaacatcaacgtgaagtccttttctgggtgccatttaacgtaggaaatgtcgctagcgtacaattcttgttttaaataccaatggtaattcttggacgtccacaactgaatgcggtttgccaatactacggctagtgcctctgagttactattccagcatacactttctaccttctcatctagaggtaatcttgtatcaaattcaccatgccttaaaccgttacgttcgaagaaaatcacatccactgaatcctcctcaccaaggtcggtttttctttgaatggacgcaatcaaagaaccttgtggtttccagcttaactggtgttccatcccagttactggctcagaagcactatccaattggccttcacgggaaaaaactctgaaagctcttctttttattgattttgtttcatcatcttcgtctggtacctcctctacagaagaaacagcaaaataatcacaatcccctctccaagaaattgtgatttcatgactgtccaatgcggttacatcaccagtatctaccatatagggcatggtcggatctcttaattggttacctaccaaacctgatgcctttaagctggctaatgcttctctttccatggcacgtgcacctttacctctgaattgtgtttcctttttaccccaaccaacggtgacgtgctttgaaatcttaagatcatctacctctaaatggtattccgatatgggttcgaacagtttacttagaactaccacgttacgatctttagtcaccatggccagcgtctcttcgtcataggaccactgcgcggctgcaattccgttgtctatagtacccataatttcaattaaagtttcagctgggtccaaactgacaggatcataagtggctgtaatgatatcaccttgttcaaagacaaagactaattggttaatatccgcaaaatgaacaaaagataataatttgtcgtcaaaagtctgaatgttgaatgaagccaacacattcctggaaccatccttcatgaattgttgcacttcaatagcaccaatatccgtagaaccgagtacacatgttatactgtcggataatgtatcaaataccgagtctaacaaagtgaaagataagtcatcttcatcgccttctgcagtagacgccgttggcttaaatttacccttattcaaggtaataagattacgcatatttgatcttagctcctgcctctttgacccactcttgtcatgttcaaccataagccattaggcatttgtactgtttcttgcctaggcatcgcttttcattactatggaaagaaaaaaaaatttgatcatcgtgttatacgtattagatcatgtgctccagccttgtcagcaatgcctctttcaattgaggaagttctgtattctgtagctcattgattctctgcatgtagtagtaattggccaggtccactacagtcactggttgatcattccctgaagattgcgcattttttgggattccgtttgcgaagatatctgtaaccattgttttgagccctctcagagatatgtcgcggcagtattgagggccatataattgcaccaacttgtgtgtcttgaactctactagtacgtcattatcaatgacgggatcttttaacagcgtttgcaaatcaaccgacttatctcgatgagctagagtttgttggcgctgcaaaactaattgcagcaacaataacacaacgtttgaggggcaatccatcgtacgaatcttgaagtcctatcagcagctaacgaagtagagaattaactgtaaatgcagaaacaaagcaggattacaccgtgatttgatgaaatagcacgttccctttgtttgtcttaaatcgcgtttccgcgatgctcgaaaaagaacacgagaggaaggttcatagagaagcagaaggaggaaccttttgatgctgctgtgcttatctgctcaggctacaacaggaactggaacatggaaaaatcgattgccaaaggtttaagcgacaaactatacgaaaaacggaaggctgccgccttggagttggaaaagttggtcaaacaatgcgttctagaaggggactatgatcgtattgacaagataatagacgaactatgcagagactatgcatacgctttgcatcagcccatggctagaaatgcaggattaatgggcttggctgccacagcaattgctttaggaataaacgatgttggccgttacttgaggaatattcttcctccagttctcgcatgttttggcgaccagaatgaccaagtaagattttatgcgtgtgagagtttgtacaatattgcaaagattgcgaagggtgaaatactggtctatttcaatgaaatatttgacgtactctgtaaaattagtgctgatacagaaaactcggtccgaggagcagctgaactattagatcggttgataaaagatattgttgctgaaagagcatccaattacataagcattgtaaataatggatcgcatggtttgcttccagccataaaaacggatccaatcagcggggatgtctaccaagaagaatatgagcaagataatcaattggcgttctctttaccaaaatttattcctttattaacagagagaatttacgccattaaccctgatacgcgtgtttttttagttgactggcttaaagtcttgctcaataccccaggactagagctcatatcgtatctaccatcatttcttggcgggttattcacgttcttgggcgattctcataaagatgtcagaacagttacacacacccttatggactcactacttcacgaagtcgaccgcatttcaaaattacaaactgaaattaaaatgaagagactggaaagactgaaaatgctggaagataaatacaataacagttctactccaacgaaaaaggccgatggtgcacttattgctgaaaagaagaaaactttaatgactgcattaggtgggttatccaaacctctgagtatggagactgatgataccaaattatctaatactaatgagacagatgatgaaagacacttgacaagccaggagcagctgctagatagcgaggcaactagccaagaacctcttcgcgatggcgaagaatatatacctggtcaagatatcaacctcaatttcccagaggttattaccgttcttgtgaacaatttggcatcatctgaggcagagattcaattgattgcattacactggattcaggttattttatccatttctccaaatgtgtttatccccttcctttcaaaaattctttctgtgcttttaaagctattgagcgattcggatccgcatattactgaaattgctcagctggtgaacggtcaattactctcattgtgcagctcatatgtgggaaaagagacagacgggaaaattgcatacgggccaatcgttaatagcttaactctacagtttttcgatagtaggattgatgccaagattgcctgcttggattggctcatcttaatttatcacaaggctccaaaccaaatcttgaaacataacgacagcatgttcctaactttgttgaagtcattatcaaatagagactcggtgctaatcgagaaagctttaagtctcttacagagtttatgttctgactcaaatgataattatttacgtcagtttcttcaagatttattaactttattcaagagagataccaaattggtgaaaactagagcaaactttatcatgagacagatatcttcccgtttatcaccagaacgtgtttataaagtaatttcttcgatattggacaattataacgacacaacgtttgtgaaaatgatgattcagattttaagtacaaacttaataacttcaccggagatgtcgtcgttaagaaacaaacttagaacttgtgaagacggtatgtttttcaatagtttattcaaatcttggtgtcccaaccccgtgtccgtgatatccttatgttttgtagcagaaaattatgagttagcttacacagtgttacaaacttacgcgaactacgagttgaagttaaatgatctagtgcagttggatattttgattcagttgttcgaatcacccgttttcacaaggatgcggttgcaacttttagaacaacagaaacatccgtttctgcataagtgtctatttggtatactgatgattataccacagtcaaaggcatttgaaacattgaaccgcagattgaatagtttgaacatatggacatcccaatcttatgtcatgaacaactatataagacaaagggagaatagtaacttttgtgattccaattctgatatctcgcaaaggtccgttagccaaagtaaactacatttccaggaactaattaatcattttaaggccgtttcagaagaagatgaatattcatcagatatgataaggcttgaccatggtgctaacaataaatcacttctgcttggaagttttttggacggtattgacgaagataaacaagaaattgtcacaccaatctcgcccatgaatgaagctattaacgaggagatggaatctcccaacgataatagttctgtcatattaaaagatagtggcagtctgccattcaaccgcaatgtatccgataaattaaaaaaataactacccattacctgattgaaagcatctttggttaagaaatggacctgacatgctacataaatagatacgtaaacagatatttaaccgagacacataagatgacctattgcaacaactcatccctgtaatgtgtttgaaagttaacccttttaatttcgcgacggatctgcgtattaatggcatttttctccaattgttgcattttcttcatacccttcttatattgcttctcggtaacaccactgaccatccttctatcagcagctgtaatcgttcttctgctttcgttagggtttggctgcgaaggtaaattttgtctatagtacctctggcccgcacgatgacctagcctagcgcctgttggcaaggtaagttctaaaccagattcatcaatagatacggtggtatagtttgcattaatgtcattttcggatgagaccaacgtgatatctacctccccatcttcttcatcatttttggccccatagacagatgaaagcttggaagtaattgctctgtcattctgaagatttttgctaatagagtgatcatcgtaagtaaaatcgtaaaatggggcgaaaagctgacgctcctcctttgtttcatatggcagcctgcaatgacgcttagaagccatatgcgctcttatactttccaaaccggagccatgaaagttacaacacagacagttatgatcaataacaatcatttttattaaaaactctagtaaaccgtttagatcaatcaaatatgacctttcaggtatgaaaagaccatgctcgctaaacatatgtttgacatttctttccacttctttattgtctttcccgcaatatatacattccgtgatggtaatcttttcattttctttatcacttggcttatccgctatatctagttcctcatcactagtagcatactcataattagagtcactagtgaaaccgtattcagagacagtatcttcaccataatctgtattcgtgttttctgttcctactgtcaaattagataattgtgaagatattgatccagaaggggacaccgatctattctgtttttctttagcaatatccctgtctttcctcttcaataagttcgtaccaacttttcttcctctctttgacttgatcggtttcttctgtttctgaggcaaagcgttactttggttcataacaggctttagaacagggaaaccaaactcatcaacctgattttcagcttgttccttttctgaaatttgcaatttctcagcaaactgttccgcaccaattggcggcaggttggcaattcttctctttaagttgtacctgtgccattcggtcttcatgtgatatctttgcaaatcactagtcttgaactgaataacacaacagttgcatgtaaagaaagtagagctcatctttcaaaatgtaaattctgctgtttttaagctgctataacccaataatgataaggtgattgtaagatgaattgtacaactgtgttgccaccgtcttgtgactattgcatatgactaagtcgttttattctctttcgtgagtggcaattttgaagaaacgacccaaaaaaaaaggacagaattctacaacacctgtacctccaaaaaacccatttcttttctgtttttactgaattgtaattcgcgcttgtctattcgtcattctgaaaaatttcacgcaaaacaactgatgacagatcttgaccatagcatagcatgaaggtgcaggaacatgaggcaggagcaccctacggggcaccgcgaaaatagctgtgtgaaagtgctatgcgatacacatataattaatggttattagatgcgcgcatttaacattttccctaactcaagtaatagctgaaataccacgaacaaaagtgtaaattagggtatgtaccaagttctattcgaatttaaaggttatgaggtacaggaaggctgaaaaatgaaaacttcgagatgaaataatccacgtcgaaagtaatgctgaaaacacaagtagctctggattcaaatcataaggacgtacagaagtgttgctgacaaatcgcttctttttgatattagaatttcattcaatgaacaacggattgaagaattgtcgtgtcgacaggattgtacattttaccaggactgaggaatgaattcaacggctttgccgaacaaatcacggcataacctgcagaataacataacaacatagcgcttattatcattgcgtatgctggctgaaacgaacctttcactgaatcagctcatatcgcatggacggaataacaggtataaaaaatccacgagttatcaacctcattctctttaaaattggaatccaatcaaccgaattcatttgtactaacaacgtttcctattattgcagataaaatggctcacgaaaacgtctggttctctcacccaagaagatacggtaaaggctcccgtcaatgtcgtgtttgttcttcccacaccggtttgatcagaaagtacggcttaaacatctgtcgtcaatgtttcagagaaaaagctaacgacattggtttcaacaaattcagataagccatcataaataaacaatgacgaatatataaatactatatgtatacatatatcaaactgcctttgtactttttatggtcctattgctccccgaatctttagatcctatatgtgctcttgagtatcgttggaggattcgtcaactcgaggtacgagatatgctttgtctcttccttgtattcgcttgctgatattccgtaccctagatttcttactttcgaaatacattacccggatcaattccattattttcgcctttcaaaaaatttcccggttgtataaaaaggcaggacttcgacagtcaacaacaattttgagtatatttaccacattttttctgatttttttttaagagggtgaatcaaaaatttattttttacacggaaacgatgccacagttgactgaacctgtcttctaacagtagttaattgccagtatttcaaacaagatttgaaatacgagtttcccagaataatttatttggacaggataggaagtccgatttctgtgttgtctcaaacgaggcgatagaattgggatgtcgaagaaagtctacattactcatatatttacgtactgtctcttgcaggtaaaaagtcttgaagatcagtttcaatattgaaactaacaaatttagttagtttctgtacttagtccgaggtatgtatgctaagattagaggatggtaaaaaaatcagctatgaaaatacatgtacgtacgttgtcgtgcaacacaaccccttcactttctatttcactctgattcagaactattattcagcttaggaggcgcggaaatctcgaagtctttcattggttgacgaacgggagctacaaacagcgtcgacttgaatgccccgacatcttcgatcaactggccagttggatacttagcggtgtccaattcattttcattgagctctttgtttccacttgagatttcaaatgtagaatcaacttcgatgcgttctcgctcattatataattctcataaaaatctatcatttgctgctttgtaatgttagcaacgagcttagcctttttttgacgatgtgtgaaattgtaatcacctaagtaaattgctgctgtgtatctggcgctttcctcggccatattcttgaatttttgcaatagactgttgcataacgcctctttgtgtttttcaaagtcctcttctggcatatccctcaaaacctggccaaaagtttcataaaaattgtttattctccattctagatatggcgtggtatgttctgactgaatcaagatcctaatgttcgctgtaccgtgattgttcaaactcgaactaaaaacaacgtagcccaattgctcttttgttcttaaggtatcaaaacatggctcgtgaatcaattgcgcaaataatccgctgagggcagataggtcttctgaatagacatctagctgggtgacatgttgaatacatgagttaacattctgggagtctttcaaagcagtttcatatctgaaagttttgcctttaggaagtaagtaggatctcaaccggttgttagaaacctgcagattatgaatgttgtttggaatcaaagacttgatcagagaatccacctccaatgcttcttcatgttttatgtttccgtggattaaagtttcaaaataaacgccttcgtaaatggtgggtatgaagttgatcaattgttcaaaggtcaatttttcaaagacttgtaatttttctgcagttgaccaagaacgttcatttattatagcattgtagtaattcgacatttgtgaataaggaacttcatataaaaggtttttcaagtgacgtatggtcttatctttcaaaatctcaaaacgatccttcttaggttcgaatgaattaacgccttgtaaaaaccttgttaatagaatgatcaatttttcgttgaacccagacgcggtaatggcgaggccttgattagttttattgaatgatatacgaagatcggcacaagcagcatcatattgtacatctttcaaggcatcgttggccagctgagtgtatagcgtagaaagcatactattaatgatgcttgcatgcgtatgtggaagtttaaaagacaagtaaatgtagcctcgtggttgccagaatcggtcgtccttcttgtaccataatttgctgacgtcatcggataataacaaaacaggttcatctaatggttttataccgtcaattttatcaaccttgaaatttgttgaaacgaattcatttggacgtggcaaagtcagagcagggttcaaacctggcgatttcatgttttttattaaatctgccggataatctaccactttatacgcagtaccataccatttttcagcagaatctgtttctaaactccttgagatcagagtaacacgagaattttccgggaccagagcgtccgtatattgggtaagcaaatcaggttcatatttcgttaacaaacccatggctaaaattctgctaacaggaatgtaatccttttccaagcattttgccaatgatgaaactgtggaagatgggctaccagcttgcttaaacttgaaggtagcattagagatatcttgcagttcattgaatatccatttttgaggtagtgagtttttcaacatttcaatatactggaagatcaagacaataacatcgcgatagtgtgtcaacccgttgtctgttaaatctatatcgacagcaaaaaaagcatttcctttggacacagtatgcccaccagcagatagctcattggcccagcccaattttttcaaatgtgctagtaatgaaccggacccttcatggccgattaaatgacttaatatcctcggtggcttggactcccaatgttcctccatatcagggacagtgaaagagatttctagttttttcaaatctttcacaggacggacttgaattattttttgcaaatgctcaggctgcataataggttccgcataaaggggtacttcacgaccgttattggctacatccttgaagagatcataagtccaatcagagagagtatcaaggtcttctctaccaagaatacatagcttcattaggttagcggagtaaaaattcttatggaattttaacagttcatctctaacatttagtccattttcctttggcaatgtgcccaaagtttcgatgtttcctgtagaaaatttgtgatatggatgttttgtattggtcaaagacttgtctaattggtaaattctccaaatatcattctgtaagttctttttgttttcgctgttaacggcgttgatctctttatcagtagagtccttgttgaaaagaggacaagagaaaaaccctgaaaacctgtctagcgcaccaaataaatgttggtgattaacctcaaaaaaataatttgtgttttgcgatgctgtgtaggcattggatgaaccaccgtgcttgcttaaatagctcgagtattcgttttcgtctggaaatttctcagagcccatgaataaaagatgctcgcagaaatgcgccaatccaggtaggttctttggatcttcaaaggcgccaatattgacgtctagcgacgctgctgctttatctgcttttgggtcctggatcaacagagccttcagcttattaggtagctcaataaaccgatacgatctttcgtctaaatccggctttaaaaagtccagattgaatgtcttaaaattggatgtcatattataaggatttgttgtgtaatagcgtgataagcacgtgaatggcttgaagcgtcttacggtgaaattgagactgataggtgagaggtgaaccaattgagtgaggagtggtttagttacaaatgcagaagaagaagctaaaagagatacgcccatacagagcaatatcaaaatgagcaagaatgaggtcttccgaatggttggttctgacttactatttgatttcactttctctgattcattcaggaagaaaagggcgaagtcctcgaaatgaaaatttcaacatcattaacagaccggcgcgcgcctttacaatttagtatgtacgccaccaataaaagctgcttaaacaataagctagaaagcccaaagggtgttaaatagtacagcgaacccttcagcaacggtacatcaacaaccccttgaaaagaatagagacaatacagctacagtcatccccttctcttgtatttttggccacaattgattgtattacatcatattttgcctgtgcgcttcttctatcttttccgcataaactaggggaaacgcgatgaagaaatggattggctgaaaaatacaacaattgtagtgttattcagtcattcaactgacaaaagtaacaaacacaagaaacgtcaagtccagtgcaatatgcgaaagaacactttagatatggtcactataggtatcgcatgccttgtgggagtctacacgggcacgagatttttcgagcccattgttatcgatagattgcgtaaggatggaaacttgagaacggacattcccatcccagaatacgacgaggacggaaatctgttaaaggtcacgccgtctttatcatccacaccagctgcaccacctacaccacctacacctcctactccaccacaacagtaaggaagcgtactagaaaatacctctatactttcttttcctgtatatagcatcaatagtaaagccattataacgttacaaaaacctattacccggaaaattactatttatagaagcattggacccatgcaccacatgcattaggacccattatttcttttttacaatttttccgttaatttttcacgaatttttcaccgtttataaacactctcgaacttataaacaaagggatgataaatagatttcgccagttgttaatacacacagggtcaaagctcacagcactactacactcgttcaacactcgttatatattatcatgcgtgccaccactttattatcttcagtcgtttctttggcattgttgtcgaaggaagtcttagcaacacctccagcttgtttattggcctgtgttgcgcaagtcggcaaatcctcttccacatgtgactctttgaatcaagtcacctgttactgtgaacacgaaaactccgccgtcaagaaatgtctagactccatctgcccaaacaatgacgctgatgctgcttattctgctttcaagagttcttgttccgaacaaaatgcttcattgggcgattccagcagcagtgcctcctcatccgcttcttcatccagcaaggcctcttcttctaccaaggcttcttccagtagcgcttcctcctctaccaaggcttcttccagtagcgcttcctcctctactaaagcttcttccagcagcgctgccccatcttctagcaaggcttcttccaccgaatcctcttcttcctcttcttcttccaccaaggctccttccagtgaagaatcctcttccacttatgtctcttcgagcaagcaagcttcctccactagcgaggctcactcttccagtgctgcctcttcgaccgtgtcccaagaaacagtctcctctgctctaccaacttctaccgccgttatttctactttctctgaaggttctggtaatgttctagaggcaggaaaatccgttttcattgctgctgttgccgctatgttaatctaattatctatcactttatttctaatgggttaaggtatctatcttttatatttcttatttcctcttcttatatgatgcggatgattttatttcttcaaaaaacattttaaaactcctctttatttcgttatgttccagttcactacgacttcttttctcttaaagagcaaataaaagtatataaatctatattaaatgaaaatcaaaaaaatattttttcgatcagctccttgttcttttcatttcaaagttttttacattgttacacatgtgcatgaatatatatgtttgcagaatatttttggcgacgcttaactcgccatttcagtatatgtcggtggcggtacatatctgggcagagcttcagcttcaacgtgctctctaacttgacaaaagatctgaacaggatcaatgtttacttcagattgcttcctaattccattgattccccattctatcagtagctgtaaactgaatgttctttttatcgtgcatgtcttgaaactatacaacctattgccgcgatgtctatagtcttcttcattaaataccaactttcttaaaatggggtgatcctttaaccgtaattcacattcaaacatagaaccatcaaaattttctcgtatttcgtttaagtccaaaagaggtttattggatttgagctgattcaaatcaatctcgattagcttcaaagaagagtaattgccgttcgctattccctgagataaatatgttgtagtctctagcaagttcagttgtagtttaagtggggtaatttgcattttgctcaaacttgctatattcccctccatgactacatagaccttgtcaaaattttggctgccagacctaaacaagtagtctttcctgtatatttgcttcaaatctcgacttctaacctctattctcatattgctttccccatcaggcaaccccattttataagtagatgggaaaactttcataccatttactaggcgagtagattgtcttgttgatgtgactgatgataccggtctcgatctaatgtcgccgttttctatcaatatagaattagcttgagaaaagttcctgtcactttttatatatccgactccattaacgactttgacgtcctttgatggcacctttaaatttgaactattgaaaaattcattgttggtgaccatactatttcctctactattgttactgaaggcattaagttcttcattgtcatcttcatcaggttctataataagatcttttggctcaggtataaattcgaacgtctcgatttcccttatcagtttatggaatggcttaaaccaagatgaagatttccctagctctaattgaacttgcaccatatatataacttttccaaaagagtaaaaatacaaatccagattatcgattttattaaattcttgccaatgactattgaacgtaggtgggagtcgggcattacttcttgtcacaaacgctactgtctttgccgtatgatttttcagacattcaggctttctgggaaacttgtcaaattgaaagctataattatatgaacctggtttaactttgaacggcttggaggagccatcaagagcattccatacattatctggagggaaaactctctgttcgaatttcattaatgtatgaaaggatttgttgtcttggcccggcatcatcatgccattctgttgaaacatgtactcttgatcaatttttgttaaggtctctgagaatccttttagaatgacggaaattttccttatagatagcgcttttgttaactgaagactaactatccctgacatttgatcattagagctataaaactccccgttgtacggtgggtttaaggatattgaaatttttggagccatggtttgacaaactgtatggttctcaaccttctctaatcaaaagcagaatcttaaatataaacactcacagaatatccgttggtcaatgaagtaattctcctttgtactggctgctttttctcctctagtttatgtaattctacttttggatgggtgcgactgcttttaattgattgagtggcggtgttagaagggctgtagagtcgaaggcttgtttctctcttacgcacctcttgtgaaaagggcgtgcaccttccccaggaccctctctcaccctcaacccgcattttgctgagaattttcaccaaggccctaggtgatattagattccacctgactaattgcattacagccgacccaaggcaatatcagtttaataaaatatcatgtatctcaccctcttcttggtattagtaaagagacgcctgatcttgtaacagtggtgaagattgtactagagcagaatcaagaatttaaaaagtgtaaaggcaaggcagaggcgatgtacataaaacttcgaagtaagaaatatttaatagttctcgccacatcactatgcagctatataaaaactactataaacgtttgttttgttccttacgcacaatatccttgcctagaaatcgtttttgaaatttaaatttttattaccatttatttgattcgccttcagaaaaatatggaagagtgcatatttaaaaaggactatttcagcatatagtaaaagtcaggttatttgtttatttgcgatatcagagtaacttaaactaactatgcagggcacttttaaaaggttttaccatcccacgcttacgcggatgtccttcttggataaattcctcaagcctatgatggcaacggcttccccaaaggaataccagatcaaacaactggtcaagccaataggcttaacacaagcaccaaggaaaagcaccaaatactcccaggggaactctttgagggatatgtttgattcggaaaagacaaaccacagagttaaagagttggccgttgaattcagcaaatctggactttatgacgtgcaagtcttccaaaagacaaaggggaaattgtttatagctccagtttcatattggaaagaagataaagctttgttttttcctcatttgataggaacggcaatggatggtacgaaacaacagaatatcgaggatatgttaaggggtaaaaccagtatagtgaggttatttagtacagcatctggcgataagttgagtagttcatacttccaaggaatcgtagacgataacaaaaaaactgactacttgactgaagctgatgcgcgtttaagtttaaatgacagtaacgtccaaatcatcgaggtcaatcttgtagaaaacgctgtgaaaagtgctctagtgaaaacgcttgctcgttgggccaatcgcgttccatcctggcgccagccattttatttcgaatgttctagaggccaatggccattttccgtcagggaagagctcttttgcaataatgtcttttctggatacgtctttcttgtggaccagcagttaaaaattaggtgggcagcttgcggggaggctactccatctgaaaaggaagcattgtggaagtttgccaaacgtctgtgaagttgacgctttgtgcggcggccaacaagggatgggcggctatttggcgatcgtgttcattccccaaactaacacgaagagcatgagagagaaaaaacaaaagtgcttgaaacaggtaagacgtttatcattgatatcaccaaagaaatatataatgccggattctatttttgaacagccctttgtttactgtggtgtttgccacagaagaacatcgcatggagatccattgaggctgacctcatgtgctcatatcctctgttcgcagcattctccattaacatcaaaggtgtgtcctatatgccgttcgagcgatatctccatcattaaccttgtggaatctaaacagctgcctaccgacattaggattttttttgagccactgcccccacttttggagtcgttatataatgtttcccaattccaactgaatgggctttcgaaacagtgtcaatactatcaaaatcattgtttaaagttgagagaaaaatgtgcaagacaacagcagctgctatatcaggccaaaatagagttggattctatggcgattcttaagaaaagaatacaggaattagagtcagttttgaatcataacaatgtttcttcgatgtcagttggtgtgctaccaacaagaaatagccatcaaaatcattaccagccccctccaaccgttgatctgacagttgatgataatagtttagaagaattcgaagccaaatcctttattaaaaagttgaaaaaaaactcttctttgagaaattcttcaaaaaataacaatggaactgtcactccctctacaagtggtcgtgtaaataaaaaccagcctctctttatggagacattgaataatcctaatagaaatagcattcctcctcctggaatgaacccaaacgcaaatagtaatctacctaatatttcgactattgcagaatcaaccaatctgaacagattttcgttctctcctgtgcgtgttgcaaaaggcttcgatggaaagttgccaaatcttgacatcctcacgaataatggctctgtatcttccaaaaatatatcaagattatcttcagcttctctccaaccctcttcgcctctatcttcatcatcaaataggcttattttaccaaatagtaacctcaaagaattgcatcattcaaatacacctttaacaagtacctcgacgcagtttccctcagctttagaaaaattaaaaataacaaggaagagaaataatactatcagcggttcgaatagaataacacacaacttgagctcacacgtaagaagcagtggtcttgccttttcatcttcatcgaactcattgcaacaaagtaaactgccgaaatcaaatatactaaagcggtccaattcaactcagcaactgactaatacacatttgaagagtgataatcatctgccacctcgctcaagtaatactgtgttgggtagtagcaagaaaaacaataagtttagaaggattaggtaaataggtgtaaggattccccgtgacgaaaacagccttcagaatagatagagtatgttactgtattataaaagttattctattttcttatgtgttactatatatggtattattttagaagaaatttgtcgaattatgttcttcttagatccttctttcccgccgtctcaatacgaaggcacaaggagaggattatgaatatatgaaaagaaaattgtacaaataaataaaacgatgatatgcgcacctaggaatagcaaagaacacactctaaaacgtctcaaccaagcacgctatgtacacacatctatccttcaaacttatgggggtgttttaaaaagcacctgactttttcaattgaacatagcaggcaacaaatggaacagcaaatccaatagcgaagaacccgaaatgagataaggcgtaaggtgtctttcttcctttgactttgaatgggatattttcatacacaccgtctttgaagtgtactgacctcttcatgataataggtctggtcatgatattgctacttctcttagctgtcgttctaatcatctgttggcacaacattgcgtaatggaaatggataacttttctgtttagtttgctctgtggctctatctagaaaattaaaggatacaaaactaattaaccattcttataaatcactaagccagcacaatggtttctactgctgtcagcctttattttcaatttttcttagtcccctagcttttccgtaaacaccgaacacttctctcgtatgattggtgcaaaccgtttggtgaaaaaaagcacatttgcatatacaaaaaattaacaaatctatcatataataattaagatatagagttcatgatccttgtgccattgatcaagccatcggcgatgatgataaaccttttattgataccttttttacctagtattttttgcaaatgcttcattatagctatttcacccattgttacacctccgaggaatactacgagtgcaatatcctctgcagcatgaaatgtcccattagatccgtctatggaccgtctattattgctcttgatgcttgcattgatcttttttgtaatggttcccgggacccatatactctcttcgatcgcatgtgagtctccatataactgttcaattaaatcctccgtttgagaaactctaggttctcttgacagtataaaaggctgctgcgaggaataattatggaacaagatagacctatcatataacatctgaaccagtctcattgtcaagggcactacaccactgtaagcaaaagtggcttccgagaagtcatcgttctcatttgtgattttatcggcagcatgctcgtcttctatgggtactgtattgaaccattgtgaaatataacggtattctttctgtaatcttgttgacttacttgttgtaatatgcaaatcagtttttcccgttttgctagtgaaaaatcctaactcagccaatgattcaagttgaaagcatttttcaatgccccaagagtcgatcataaaggttcttagatattcataatccttttctcgaagtgaatttttacaaagagacaataaacagattaatctgagaatcttcttttgatcaacctcgtactggtactgcaactcgagtataatatcttcaatgtcgttattaagtgtatttcccatcaaaatttccagctctaactctaagattttattgaaagatccgtactcttcagtctctaccactttcaaaacgtcggatgataaggttgtgtgatttttcaaaaaagcttgcctttgttgcaaagaacctaaggaatcaacgaattctttgatttcatgtacgctctcggctttatgccttgtatcatattgcgtttgtagttcctttgccaatttatttaactgcggcccaatcgacccaaaatttaaaaatttcaaatcattccatattttatcttccttataattgaagttcatgtctttctcctttatctttatgccagaattgaattcatatagatcatctagtattcctgcatacgtaagttgtgtcaacaatggcgttataggatcggtattcctttccaagataatcaagtccatttctagtccacagttggttcgttcaccataaagcgtacccttgatgaataaatcattctctgtttgatgctcatcgattcgtttcttcaaaagatggctacatctcttagacagattacctatcgacacaacatttgttatgatactattagtttcaaaaatcaagctctgcaacgaattgaccatatcatcaaccagtattgactctgtggcactctgcaaagaacgtaagttgggataatacatgtttacattttccatgttataaagggaatgagtcaatagaacattttcatcaatctgtgggaagggcaagagatcccaagggtaaagggtatattcgttcgatagctcctttaactgagattcaatgacgttagggaaatgtgttttttttgaattcaaatcgaaaccatccttttgccattgctctgtatcctccaaagtattttggaaagacggtttccatcgacagtatattatatgcaaagatgataaattgtgcttttgagcagcatcaagcagttgtggagggagtcggagagatgttctgacatcaataagaaaaataagatccatttgcggaacgctgcctaaggcactcggtaaatcgtcacttagctgatcatcgagtaacgtaattttccttacaggagttgattgagtcaaatcttggaaagttagcaaactattgagtactggcaatacacttggttgaaccacaagaacttcatcattttgagatatctcatttaaggtagcacatagtccatcggcatttgttaatgaaaatttcttagtattccaaaatctattcatcgtgaaatgatttgataaagttggagatgggcaatatcagctttttcttcctttctcgaattttctatcttttaactaattaacatataactagttccaatttgctaacctttatgatattttatttatgtatgttcgtgtgaagtgattaatatattatacaaaatgaccggagttcagtataatttctatctactattattgagcacacaaaggaaaagaattgactatgaacaagcttacgaagatgaaccgcttcttagagcaaactcttcataataagagagcatttctggagtaatgcccctagcaattcctttaaaagctttctcaaaatgacgtaattccacttttgcgacatctaaatcttccattatggcagccaagcccgcttcttgacaaagcagcacaacttcagctccggaataaccttctgtacggtctgccaattcatgaagatcgactccagactcttctgtattaaatttctttgtgcacttctttaagatttccaagcgggcgtttacgtctggagggccaacgtaaatgtgtctatctaacctaccaggccttagaagagcagcatctatttcatcaggtctattcgtcgccgctacaataactacaccctttaactcttcaacaccatcaatctcattgagtaaagatgtgagcacgtgattagctgcagaggtggaactcccgtctctatcaggagataatgcatcgatttcatcaaagaagataatacttggagctgcagagcgtgctttgcggaaaatttctcttatagctctttcggattcccctacatacttgttaaaaatttcaggccctttcacagctaagaagttgatacccgattctgtagcgagagcttttgcggttaatgtcttggagcaacctggcggcccgtaaagtaatacaccttttggtgcagaaattcccagcctggcaaaagtctccgaagcctccaaaggcaactgtatcatttctttcatctttgttttaagctcttcttggccgccaatgtcagaccaataaacttttggcatttctaagaagatttctctcattgcgctgggtctgatatcaaccatggcgctctccacatctttcaatgtaacttttagggaaaacttgtcaatattggcgtctgttcctagtcctcgttgtatcgtcttcataactgattctctgcagagagcagttaaatcagcaccaacatagccatgcgttttagaagcaatgtacttgatcgcttcagaatctaatacgtgacgatccgaggacattcttgagaattgcttagttaaaatgtcaaatctggcatcaacgtctggtataccaatttctacttcttggtcaaacctgccaggtctcctgagagcagggtcgacagaattaggcctgtttgtagcagcaattaccaccactttacctgcagcgcccatgccatccattagggtaagcaatgtagccacgactctgctctcaacttcaccggagtcatcgtttgctctatttggtgctattgaatcaatttcgtcaatgaaaataatggaaggctggtacttccttgcttcattaaaaatatctcttaatgccgcttccgtttcaccaagatatttggagacgattgaggggccattaatggttaggacgtgtgcgttggacgtatttgctacaactctcaaaagcatagttttaccagtacctgggggtccgtgaagaagtatacctcgagggggagaaacaccaaagctactaaatagcgtcggttgatgaagaggtatttcaatagcacttttcagtgattcaatctccttgtctaagccgcccactgctgcataggataagggctccggaagattgtatttacgatttgcctgggtttctttcgaaaaagttatatgtgtggagccttttctgaatataaaaggtggagatagataaaacaggttatctaatccaccgtacatatcgtccatgttaagatctagttggctgacgtcgggaagcgaatcatcgctcgcatctgtaattacgacatcaatgctttcatcacctgcttttgtttttaagttttgaaaaatcattccaggcattataacgccactatcatccagtagcttttgaattactttttcctccatacattccaaaatattatatccttgtaaggaccccacggtaaccttagtggcataaggtggttgcacctgggctttctttaattctagacgatcaccaaggataaggttcccaacagatcgtatagttgtggaaagggtgataacattaacaggatgtacttcttcatcacccgctctagctattactaaaataccattttcgcctatcttaccgacagtacaaaatgatcccggatttatctcaagcgaggataatacgttaggatgaatatatgctgtgcatgtttccttgccatgatctttagaaggatgtggtctggtaataaattcagcaggcaatttaaatttggatgcttttgcatcagcactattagaacttgccgatgatttctttttggaaccggaagaactagatttaggagccattttcctttctatgattgggcaattttgagaatgggcaatgttgagaattcaattgtatattgttcgcatattagtttatgtgatgaggcaatataaaattttcttacaatagtccgcccgttgcttacatgaaagaaaaaaaaaataaagatggatcgaagtggacttaaaaactatgtatacgtgtgtgtgtgtgtgtgcaataagagttcgaaaacattaacttttataaacatgactcacattgagaataaatgagctctctataaatacaaacttgcggcgaaaacaatatctctcttaatcaactcttgagccctgctcatcttcatatgtaatgtggaattaccaataataatagaggcagtcttaacttcgcggcaaatttcgtctagccaagtgataactctgactacagtaccttcagcctcggggctcatttccatgatttctttgaatgataaaccacgggcccactcatacaccacattcatcatggcaaacctttttctgtccaaaaactcagcttcatcctgagttaatggaatctgatgcgtattgaaaacacaaagcattttcttgtaaatttcctcaattctttgtttaccctttgctagccttggtgtgacaataggaggctcctcttccctggttttcccctcataaacaaatactgataataaggctacaatctcttcaggttcaaagcttcctaaaaagttgtctaaaattaattcagttaaaactaactcataaccagaattaatttcacatgccactctaccttttaacagcacgttgtggttttggtcgataaattcagtgtctttcagaacagccaatctcttttcataatcgggtagtaagctcagattttggtcagacatcaaatggtacaattcttcaattttctttttaattacatgcgccttaaacttgggaacaatgtgttggcttaggttgggacatttaatgctttttagtttgaatatctcatcccttatatttgtacggtctaacaatatttggtgaatttttaaaccttgcttttcaatgttaattgcttcttttagcgttttgccgtccaaaatgttatttgtttcagcgttaaactcgttcaaagcggcaacatcctttttaatcacttttcccaagggtgcggcaaacttgcgtttagtgatcacttcaatagccgtcacaggaacttcttccatataaaaatcagtcttctggaatttagggaagttccttcttctgtatccatccgcttttggaaagtatattaaatgatttggctcaccatttgggagtttgtatggttttgtgaacgtcataatgacacaaacagcatccttcagagaaactttaaatacaaatcctaatttcaagcaatcattggggtccctaaaagcaacgagtctgccctctttcaagatatgcaatatcgaaggcgatttaaccatttcttgcattaggttgactgttgcctccttatatgccagcatcaattccaaaaacttttcgatatcattatcacagatttcacaacttttgtactctatggtttgtaattcctcttgtaatactttgatttgtttttcatgttcaggttgtaaagtttctttggcattctcactaaaagaatacttgatcatttcttcaactctcaacgcctcaattcttaaaagatttaatatcatattgtatgttaatctaaactgagactgcaacctcgtcggaacacccatcgttacttctttgaacgtagcaatagataaaggactattatatgccatcacaatgactgtaccagtggaatccaagccccttctaccagctctaccagccatttgggtaaactcacctggagtcagttctcttaatccattaccatcatgtttacggatgctgctaaagataactgttcttgtgggaaggttcaaacccatggcaaaagtttctgttgcaaataaaactttgataaaacccttggaaaataatatttcgatcaactccttgacaatgggcaatagccccccatgatgaacagctataccacgttcaagtaatgatctggttttaagaatttgaggcaaatctctatcctcttttttcaaacgagtaatcgacttctcaataaacatgtggatttgtgatttttccttattgttgcagaagttaattccctccaaccagtcagcatattcctcgcacctctttttactaaatacgaaaacaaccattggtagaagctctcttttccttaggtaattgacaatttcgggccatgtttttttcgaaggaccatcttgagtgaaaaacttacgcttgttggagccaattgcgccagcacctcttgaacctccacggttggcacctccacgtgttgaattaccacggcctcctcttccatctcgagtattggatccaccacggccccctcttgctgtggatccacctctcccgttgtcagtttttgaaggagccccttttgcactctccccatttagaatctctttatgtttcctgaaattagcttctaaaaattctgaattttgattaataaccggtatcagttcctttttagcccatatatttatttccaatggaacgggtctttttggtgtggaaatgacataaatatttttttgcttagttcttccaatccaattagcaaactcataagtgttaggaacggtggcagataataagataaacttgacatgctgtggaagcataataataacttcttcccagacaacaccacggtcttgatcattaacgtagtgaacttcatcgaaaatgacaaactctacatctctgatcaaatcggcacctctataaagcattgatcttaaaatttcggtcgtcataatcaaacagttagcatccggattaatttgcacatcaccagtaatcaacccaatattaacatcgtcaaaagtttctttaaagtctcggaatttttgattggataaggctttaatgggtgatgtatatatagttttagtcatgtttctatgtgccatggcaattgcgtattctgcaacaacagttttaccagcagatgtgtgggcggcaacaaatacggaatcaccttgttcgagatgatagacggcttccttttgaaatgtatccaattcaaaaggccacgatctagcggggtttggaatcaactcatcgaaattttcgatcttatggttcaaatcaacaacatgggcccattcctttttaacaggaacacttttcgaaactggtttagttctgccaaagtctattccaattggtaatagttcatcgatttcggcatcatcagcattatcggcagtcgtttcttcagtggcttcctccataatttcttcagaaattgacttggcagatttttcctcctcttttaactttgcctcgttcgcctcaatccttatgtctaattcattatctatctcatttagctgtttcaattctttgaactgtccgttttgatcctcattttcagctggagaatccatcggcttaatgcctctattcataccctctggaatatcgaataaaccttgaccatccttgtgtaacaatttagtagcgttggccattgtagaagatccattttgttctgaatctgtcttgacagatttcatgggaattccgcctggtgtgaaaggcaattgcgctgtagaaccccttactgagttttggttatggttgatacttctcgtaatcgacagtgaatttgatgcattggcatttgcaacttccttcaaatcaacctcttctttgtagcctgaaattttaccttctaacccagttcttttaaactggtatgatgttctattaattgggtccgggactttcagcaattccttgtaatctagtttaccagagcaatcttctggagaagacgtatgtggaacgtcttggaccatgtccaacaagctccaaggaagagcattagaaggtctcaaaaatctatcctttatgatatcatttgcatgctttggttcatcggtgctctcaaaatctaatttagtaatgcgatcttcgaaaagctctacgtctgcgttgttagtgatttcttttaacgattgatataattcctgtatggaactgctactgaatccctcagacatataaattagtattagtacagtaaattttgtgagttaggttgttcatatcggaaagaactatgtggcaatgtattatagtttctgcgttgacttttaaattgatgaacaggttaggttgtctttcaatacttcgtccgtcgtgatatcattaactaaagttatgccatccgatgggcgttctgagacaagaggaaatttttattctaattattcattattatatagattatgaattgatctatatgatgagatcatgtgcaaatgattaaccttgttaggtttatgtttttttttgttttaaatttgtgagctttataatgttacaaccgatatgaaaatgaaaaattacctgttattcctttttcaaacctctatccgttcctaagatcttttctatctttattttttttccttccctttttgtatatgagcttaagattaccacttaattaatcaaaatatcaaaatggtgctcattcttctcagtcgttgaagataatcaaattcaaaattcagtcactcttcttcactttcgctgctaacatcgtcatctgaagatgaggaaaacccgttgtgtgcagcgctttgaatttggcctggggagccgttttggctcagaggtgaagcactgtctaagatagctagtttattttttatcttttctatctgcctactctgctcctcttggcttaatgccttagatcttctctttctgcttcccgcacttgtaggcgacaaggacgaagcatctcgcgtaacacctgaagtaccgtccaaaccgttagaagcaccggatgagctttcatattgtctaaagaaagtgttgtacaatgttaagatggtgtgattatctaaagtgtcgaggtcaagttctacttcatcgtcttcagaaatattgggcatggatttttttattatgtcgattgctctttctaatttggaagttggtaaatcattgatcctctctgtaatgatacgtttcatatcatatgtcactactgttttcaatttattctttttatctcgccttcctttcgaagaagcgttcttagacccactccttcccttcgatcttttgccgcgtttctttgatccacgtgctaagcgcctctcttttcttattttttccagttcttgcttttttaattgttgcaactccactttcatccgagcaagttgttcttccaaatactggatggctggatttgtaattatagtttcatcgatgtcagactctgaatactcagattcataatcgtcgtagtcgccttgggtcctcgaatcttcatcggaatcgtagtcatccaaattaggcctatccgcccatttggaattgaaaacttcctctagacgatgacccatcatattaacgatcgtgccatccggattgaacgtgtagcagtttttaaagaccaacctcacgtctctctcaaaatcctccattgtttgatactgccagtcatttaatttcttggcgattgtgcctaaatccattggctctttaacataatcgaaataagtcggcaaattcatagaaactgggtctactggttccaaaaatgggtagttataagaggcgtgcttcttggccatcaattcctttagcacactctgacaaaatttcattgcttgttgtagtcttttggatttcggtttcttcgattcataaggataaatatcctttgatttcggcggatgtatagtccttttcggcctcccattatgagtttgggctcgtctaattacaattggggcatcctcttgggcactagaccgccgtcccttggctattacaggtggagcatccttagcaggcatatttagcatatgtttctcgaaagaagcttgtatgtttcttgccatttgtgatatgcccgcatttggaccgttgaatttaatactgttgttaaccatgagattgaaatcctccgtgatttgctccggaacttcataagcgcctacgttcaacttcctctctatagtagacaagtccattggcctctttatgtagttaaagtaaaagggaatatccaatttcactgggtcaacaggttgtagaaagggtctcgcatccttcaagcgtttgacagctttaatcgcaagcaatgcatgtttctgctggtgctttggtattggattctgagggagattattcatatcgggctctggaggaggagcaggggcaggttcctttggaacctccatcggaagttcttgttttgagttttcatctaaatcctcttgtttggtaccttgtcctccttcttccttcttcaacccctgctgttcgtcttctgcgccacttccggtggcgttatacccattttccccgttagccgccagggtggcgccttcaataccgttctctgcaagtccagcaggcgatgatgttagagcatctccatccagtctagcctttttgagatgcaactggttattggcggggttttcttcttctgcgagtccattcgaaggatccccttgatctataggcctctttagattactggaaacgtcgtcattgacattattaccattgacatccacatcgttctgtacgggtgtgatatcggtcattacgtacgtttatcagagccgttgagattcgaccgccttttagcttgtttactgtggcaagggagaaaaaatcaaattatttgggaaggagcgacccagtaggcttaattaagggacaagaaaaacccgctttgtttaaatacttcgcgacgacgcgcgacaagcgacgacggccgacgttgtgagttcacggagcaagcctgaagttgctgcacacacaaagtgcgcggggctactacagcgggggcacgggtgcatacatcttcaagaagaaaaaggtgctgggtaatacaaacacgaatcgacgtaaaacgttattgtacttcctttccgcggctaatagcaactgcagcgtaggaataaatatgccaaaagtgtaaatccaagcgcctgatacaaagtagatgttgaattgttttaaaagacttactcaagtaccaggaaggagctatgtgaacgggatgtaatgaactttccagacaccccagtttgcgaaatgccttttttcagaggcgacttgcgagattcaaatcactgcgcgttttctaaatccacctgtatttacctgctatttgagccactcaggtacagttgcatcaggttgatagttatgttcatttgtgttgcgatgataacctgtccgaactcgttaagattttctcaatacacttttctccgctcctacctaacccttcccagctgtgcttattttgattttcttggaacccatacctcacgtttgaaattgacacccgtacatattccaattctcgtcttgcaaaggaaaaataaccgcgcttacccatcagatatgatttatgatacatgtacacttgattttctatttaggaatctctgtttgcataagagctgctcttatgtttggggacaaatacaaagttctcgtcggttttaccgaaaaatagatcacttagcttgatccaatcattaacatccgtactacccattagagtttcaagttcgtctcttccacaccagtttggcggtctctcattcaacttcacagggtatctttcacaaatacccatgggacatacctatgaaaaaaggacatgaactcgcagaagaatctacgacattgagaaatgccgtattcgtcggtgccccagtgttccatagagaactgcgcataatcccttaaaatgtctaatctttccgtacttgtcttgtctagatactgctgcgactcaacctcttcaaaaatccatggtttgatcagggcccctcgagcaaccataacactatcaatattttcatttccgttcaaatagcggtaccagtcttcaaaattgttgacatcaccatttccgacaaattgaattctgttcttggaatccctgccttctttgccttgttcggtttcgatgaaatccgcttcggcggatctcaaggtgtcagccacttgactcacgtagtcccaatccgcagacttagtgtacctttgttgcctagacctaccgtgtaaggtaatcgcagccacatcagtttcgttaaccagtcttttgactaacccttccgcgataggatgaccttcctttgtacctgttctgatcttcaccgtgataggaatatctttcgatacgtagttcatcgcgtttaaacaacgaatcattcttgcagggttatccagcagggcgctaccagaaccttgtctgtatagcaaatcgatggggcagccagagtttaagttgatttcacttatttcactgacggagtttgcgagtgcttctgcagcctttgccgcctgccaggctttagaacaggccacttgaaccccgaacccggggaactctgatgtgtgagctttaggtaacgcccactcagaattagttccttgaattaagggaactgccaaggccatttccgaatatgtcacatctgcacctaactttctcattagacgacggtatggtaaattgcctacggttgtcaatggcgacacgatttttttgtggtacaaatccagtggctttttttcttgagcaaaataacgagtgtccttgtacttcaagtatacttcacgctgtttcattctatgttctgacaattctttgttcctctgttcgacttggggggcaactggttgttccacatctgggtcttgtttcttcagctgtggcgttgactcaacttcttcttctggcttcatggaatctctacattcttgttggaaagagtcgatgatttccaatatttcattactttttgtgaaaggaaatcttctttttataagatcgagttttctttccggtgagatatggtttacctcacctttaacggaccatattgtttgcgcatctggatcaatctccttcttcgatattaggatattatcttctttattcagatgagacgataaaaatctgcatttgaatcccatggggcaaaatcccaacgagttgaagaccggacaggaaggaaatatattactttcaacttcaggcttttttgttgaaaggtacagattgatatcgtgaacaaacctacagttatcaccaaaggagcatttagatatatcgccatggatcaagcgtgggcacaagacattctgttccttgacctgcctgttatctctattcttgttttgcccacgcttcttacctcttccgttcttatttttcttattagtcccacctgcaaactcgtttgtcattctgtcggaagacatctcttcatcatagatggcgaccttctggttttcattctgcttcaatggtacaatatattctggtttgatatgtgcaatacctttggacggggaagtgtcttgtctcttcacggttgagttgtcgtcgccaacaatagagcgtttttcagcgttttgctccatcaataatgtttagaagttgcctttttttcctattctgagttcattaatgtttcattactgctcatctcatcactacacattcgaactaaattcttcataactttaactagatcttatgaaacttttcaaaaatggtgcacgggctttctgtatattgaactttccgtcgcttttcggagctacaattcccctacccggcttgtcggcattaagtctcttcatcccgtgtactattacccgacagtttctgcggcatgttctgtggaacgacggtacgggcggtgactgggtgccaaacagtgcggcgttcccgtgcgcaaggtggtctgcggtaggaaaaagaaacaaaacgcgcctacgtcgtgcaaggggacaggattttgtcagttacataataaggagcaatttcgaatcaattgaaatttggaacaaatgggcgatgcattcgttaaaaggcgattttgtatcaaataacgtcactatcagccattgtcacttgccactgtcgcctgccaccgctattgccattatcatttgctttcgcatcgtcaccgatttaaagctctctaggctaacgtacgcattttacctcccaggccctatctcttttctacctgtcatccctatataacgtcttgtacattctagtggctccgttaacaaggtttgacaaatattacaatcaaagaaggatagcgctagtcaatctaatcattaagttcgcttataaagagaaggaaagctagattttttttctacttcaattacatatcggtgcttctctctggtggttttctgtttttctaatattgatcgattttacggtgagttaaactacttccttttatcgcaatatcatatttagagcgagaaagcaagaagaataaagctaggagaaaaaagcgccacgatacattcatactaagtttataatataccggtcgtcttttggctttctgataccatattatatcctcgaaacactttctctggattcacctactattaatcacctcaagatttcacttgtaaggcgttttcaaatttattgttattaaaagacatattcatattcagtatttttatttttcttcgaaacaggaaaagcttatctgagtatggattttacaacaatgactatggcaagcaatatggctactagtactactacgacggctacatcggcacatgcatctataaattcgtcatcaaactttaatattgatattgattcgaaccagaatactccttccattttgataaataacaattcggattcttctaatggaaaaaacacagattttaacggcgtcaataatattcaccaaaaaaatatcatgaataatacaaataatgttcatttgtactctccaaatataatggaccaaacgctactaactccacaggacattgccaagttacggagagaatcaatagcccattctcaagggatgggtggtgtttcatggggatccattagtgttggttcttggttaagagatgaaattattagccgtagaaatagtattgtacctgcatcagcaaacggtgctgcctccgctgccgcttctgcaaccactactgccactaatactttgcagattcaacaaccaactaagagaccctctgttagtaatccgccttaccatagagggtattctatttctcctcagatagcctacactgcttatctgccaaatctagaaaagcaatattgtaaagattattcatgctgtggtctttccttaccaggtttgcatgatttgctgagacattacgaagaagctcatatatccacgtctcctaacactaccaatatgtcacaaataccgatgaactctgctggtaacactagttcatcagttcgtatgacaaataatacctcttctgccaactataacctgcagaataacatggccgctaatacaaaaaatgcaggtcataagactaatactatgcaggctcatagcagcaatgcaactaataacacctccattaataatatgcatgccaatcttcagagcaacatggattccaactccacaatacgacaatctcagcatcctcaccatcagcagaatataatacaacaacagttgcaatcgaattctgtaaatcatacatcaggggctgtacccacaccgagtgtaatgggttcagcaactgcgtcgtccacaactgcaaatccaaatgtgatatctataacgggtgcccccaactcgggcttatctatggctaatcactctcaacaactacatctgaatggtaatctagtcgatgccgtttcaacgaatgatgtgtttttaagaacgagcaattctccatcaagacacgttccgcacaataaacaaattaacagtaacaataatagtggtatcaatatcaataataatacctcacacaattctaatattaacatgggtagtaaaaacgccatggtgaatcgtccacatacttttaataactattccttgaacaaaacgtccaggaatcctattcaacatcaatcaagaaaaattgatcctcatcaaaccgatttatcacctctggtacttgtccaagatatagatttaagttttatggatgatgatattttgggccctagtaaccacaattccatgaactctgtcgtaaatccaactacaggttctcacaactacaatacttttcattcttccgtacacgcaaaatcttctcaaaacatggtcgaggatcaagacattgatgacattgatgatgacgatgatgttgatgatgacgatgacgatgacgatgacgatgacacagaaaatggctccagttccaatggaaaatcagttcataacaacaattacaagatgcctcagcaagcttatatagacgatcctgcgagaaggctctatgtaatggatcatgaggaacaaaaaccctttaagtgtccagttattggttgtgaaaagacttataaaaaccaaaacggtttgaagtaccataggttgcacggacatcagaatcaaaaattacatgaaaaccctgacggtacatttagcgtaatagatccagattcgacagattcttttggtgatggaatgggctctgcaaaggataaaccataccgttgtgaagtttgtggtaagagatataagaacttgaacggtttaaaatatcacaggggccactccactcactaagatataattgtttctttactgaattgatttagtatgctatttagatactaattctaccgttaccgactcatgcatcgagcggccgctctttctcttgttgttgggcgcaatttatgtgatcatctttgaacgaaaatgcatgataaagctgtgctcttcgactgttaccattaatttcaaaaaataaaaagcatatctattattgaaaaatgaacttataatagaataacattttcttgttttgtcatcatttcctctaaatactccgtcatgaaaacgatttgcgctctgtctggtctctccttttagtattattgttgtgtgttttttactattcattttttactactgtgtttttactatatatattttggctttacttacttccttctgttctgatgtattaaaaactatttttattctaagaaaagaaactttaattcttcttattcatgctctaaatcttaaataaaaggttccgttttttatctgcaattctgtgtatttgtaagtgaattaccatgcacgttgtcggatcgtttttctaggcagaaactatcttattgaaccattaaaagattacttaaatattacaattaatcttacgaagcatattaattagactggaattacagcgcaactatcacaggttaataattggttgagaaaatattatagttttgttagtaatgttgaacttttattttatacacttatgaaagtaaattaattcaatatcaataataatatactataagtaacttaaaaagcaaccttcctcccaaacctacaatccaatcacgctgataagtattatctagaaagttgacaacaccaagccatatggtcaagaaacatttattgagagttattttgtaaataagacttttcgtcatccatataaagcaacctaattgttcatctaatactagagtcgctcttttgaaagttaagtataactacctcatcattagttgctactatgtgtataatttgaaaatctcaacgtaaggttattaaaaatataaatgcgcgtaagacagaaaaatagagacagcttacggcaaattatcaaaatgtgaatccaaggtttcaagaaaataagataaagtgaataggaaggatgaaaatcaatgtatcccgtccattacagtttttacaatggagttcatatattgttgttgcatttctgatacaattgctaatcattcttcctttatcgatcttaatatatcacgatttttacctaagactattacctgccgattcctctaacgtagtcccccttaatacgttcaacattttaaatggcgtacaatttggtacaaaattcttccaatctattaaaagcattccggtaggtacagatctgccgcaaacaatagacaatggcttatcacagttaatccccatgcgtgacaacatggaatacaagctcgatctaaacctacagctttattgccagagcaaaactgaccatttaaatttagacaatttgttaattgatgtttacagaggtccaggcccgctattgggtgctcctggaggaagtaacagcaaagatgaaaaaatctttcacacttctagacctattgtctgcctcgcactgacggattccatgtcgcctcaggagatcgaacaactaggcccatcacgtctagacgtttacgatgaagaatggctaaatacaataagaatagaggacaaaatatcgttagagtcttcatatgaaacaatctcggtgttcttgaaaacggagattgcccaaagaaatctaataatacatccagaaagtgggattaagtttaggatgaattttgagcagggattaagaaacttgatgcttcgaaaaagatttttatcttatattattggcatttcaattttccattgcataatatgtgtacttttttttatcacaggttgcactgcattcatttttgttagaaagggtcaggaaaaatccaagaaacatagctgatagaattgtacttctcgctatataattttaaaacctagctgttattttctaagtaagtaggctcttccagcattctgcttcttcgccctgaataaaaaaaagatgatcagcgaaaaaactcaaaatgaaaataagagatggattcttcaaagttataattcatatgcagaataaagattctaaagaaaatgcacacaatgcatattccatccggtgatgttctgataccgaagccgaagcttattactgaagaaacagatccactgcatataataaagacgaggcaaaagacacatggtcggcccgtgaccattgcaggcccaatggttcggtattccaagttaccattccgtcagttgtgccgagaatataacgttgatatagtttactcccccatgattttggcaagagaatatgtccgtaatgagcatgcaagaatctcagacctttctacaaataatgaggacaccccgctaatcgtccaagtaggtgtaaataacgtggctgatttactaaaatttgtggaaatggttgccccatactgtgatggtattggtattaactgtggttgtcctataaaggaacaaatccgagagggcataggttgcgctctgatatacaattcagatttgttatgcagtatggtccatgctgtgaaagataagtatggcgacaaactaagaattgaaacgaaaataagaatacatgaggcattggacgagacggtggagttatgtagaaagctatgtgatgctggggtagattggattacgattcatggccgaacacgtagaactaggtcatcgcagccggctaacctggatgcgataaaatatatcatcgagaacatcagcgacaaaaatgtgcctgtaatagcgaatggggattgttttaagttatccgatttggaaagaatcaccaaatacactggtgcacatggtgtcatggctgtgcgtgggttgttaagcaatccagcgttatttgctggatatactacctgcccttggggctgcattgagaagttttgttattgggctctagagtttggtggcttgccttttcaattggctcagcaccatctgtactgtatgcttgaaaatatggagttgaagaaatctctgttaaagaaaatgatgaatcttaaaaattacattagtctgatcgactggtttaataaaacctttgagttcaagcgttacggcgaggatggatttggcatgggcgttgaaattccttataaagctaatagctgtgtgcagaggagcgcctcagtggttgagagacaagaatgaataaattttgaattacaaaaatctaataaactgtggtactgaaattgtatatattttcctatcattcaagagcgtatactcgtaccccgaaagcagctctgtttgtgtaataatataacctaaaagaaataaaatgcttataagatggacattatttttttttttttacaatttaagcatcttcttcaacgacaacggtttgtagacccttagcagaggcaaccaaaactggttcgacgtaggaaaacaatgggttcttggcatcttcttcttcgtttctctttctggagattctcaatctcaatctgtattcaacacccttaacacctcttttccagatagcttggttcaattctggggctagacggacatcttcagtacccatgtgtaatttggcgaatttcttgatttccttcacagctcttggagctctctttttgaaactgacaccatgtagctatattaatatcaattcaagattggtctgttagtaaaaaaaaagttgttataagaaggtggaactaaagcatcacgccaaaaacatcggcccaagcgccattatagtgtaaacgtgaggtacggatatcgatcgcagaacacagagaaatgcagtaccgaagaagaaccttccagtccttgcatcacgcattccatataataacctctaatattccgaattaaaacctggggtcaatcattggaaaatgaaatttcacccgtatagatttcgcttggtatttcaccacaatatcgcttgttggctttcaataatttcccacgtaaagacaacgctaatttcgacatactcttttgtgcaagttgatggtgtattcacgagtgacaacgtcttttaaaccggccattttcaagtactttggattatctgctcgtgcaattgaaatatactaagacccaagactatgtaaaactaaggaacctatcaacaatgagactggtcaaataatagagtaaacatgtacatgaagcactaccatcagaaagagcttacaaggttacgaaacaacgtcagtgccctctgtcgcattaccctcggtttcgcgcccttccagttggcatttgaagtgccaatccaattgtgagcacatccaactagcgtgcccttgcaatcccagaggacaccatacaacttccagcctagtagtgaacttaccaggcgaggagcgcgggcgccagagggcagctcatctgcgttccggctctaacgagaagggcggaaatggcaccatcacctgaaaaagaacgtaatctaggctgagccgcgcctttaagtttttgtcgcatctggctgcgcttcatttaaacggcactcctaaaaaattgtatgaggtgattttttttgtgtacagatgtacggatgtacggatgtacggatgtatactatgtaataatgcacggatgtagagaaacagaaacgaggataataaaatcggtttttgtatcatctggcggcgatatggcgcaaggctttaagtaaacgtcctatatggtactaacggggttttattccgaatcaaaagaaaaagagatacgaagtctctcttagtaaaaaagtctttatggaagattatcgataattcgataattctaccgacaacagtggttttgtttggctcagcaaacgtgcagcaccatgatcttggtagatttcttctttaccctcaccttccccacaccatgtttgcttgctacccgtgtgtaatgctatcagcgcgcgtttctttttttttcttgctaacatttttcaactttaaaatgaaacgatgcatgagtgatagaggcattgaactttagtaaacaatagaaataaccatcggagttattatttttttctgcttattctttggtcgcaaaaaagtgtgttgtataattctttggaatatttataaaaacagggaatactctaacaacaaacgctagtgcttagctactcttccgctggtacttcaatatagcttgtcacatatttttgtccattaaggtcgttaaaacccgaataattttgtacgatcagtttagtaaaagaaatacagtattcaaaagctaacggtttattatgactgtttctacttccaagaccccaaaaaagaatattaagtataccttaacacatactttacaaaaatggaaagaaactttaaagaaaattacccacgaaacgttgagtagtatcgatgactctagtggaagcgatgaaaaaatagaggctctgtttactgtgtctcagcctgccgtcgtagcctccaagggtatagacagagatagtggtgcttctatgtcgcaggtaggaggaggtgtcaatagtacattggagatgaagctcacagatgagagtgaggaatctagctctgctaataacacgaccacaaccgcctcgcatactctatcgaattcgaagaagtctacgcagaactttgaaaactataacgtagtggaggaacgcataaaattagcacagaaaagtaaggcgccgttttgtaacgctgagaaaatctggaaacgaagaagacaactctggacacaacccactgagcaaagtgaaagcgccaataatgacggagttactcgaagggagattttccaagctatacctcaggaatattatgctcgagtttacaagaaactggtggtagatgataagccattgagagagcctctaaatctggaagatgctttacaagtcataaatgcaggctggacggaaacgagaaagtgggctaatgctgccaaggcatgccatgactgagtgtcgacgtcctttttgttttgccttatagcatcttttcctttcttcaaatttgcattacacaactttaactcagttaaagaacttcgtcatttacttattcttcttttttttcttacccttctttctcaaatcttatttctgtataaaatacgtattgattcattccattaataataacatataataatagtactaatttaaaaacattgaatatatttatcgttttatttcgagttgcgattcttttctatcagttggtacgtcatttcaaggattcggagatccctatccacaagctctgcttccttttgtaatgcttcggtatgccccatatacggagtgtacttttccaacatatagttaataggagaaacacacttatttttaaatgagtcgtcatgaagtcgcaataacttcttcaactgtacatttaaaatatatgattgattattttcaatttcttgcaaagtcttcgaggcttctgttctatgcggagagttgattattttgtcgagtaatcggtcaagttcttcagacctgtttggcatttttacgattatccagttcacacacattgagaatgtaaggaacatttatttattgtcgatcatttattaaatgtgggagggaccctttaagaacactgcaacaaacccaataaataattcttggttaccctctcaaaaaacatcataggaaaaagaaaaatatacaatctgcctttgttactaatatacttgttctatataatgctcacgcggtggtcacaaaagctgccactcccatgcaaaacttcacaagatcatctaatctgtcttccttcttatgtacatcctcccaattttgaagagcagaggcaatatcttgattcttgttgttagcatgaataacatcaccgtgtgccttaaacagtaagctcataaacgtttcataaagttcgaaatttttattgctcttcaacccctgtgttaacgcgtcgataaaccacacaatttcatcaaatggctcaaaggaattcaatgatcttatctccaaatccactgcagcaggtgagaaatttattagagtggccagcaatgatgaatagtccttggattgtgagccctctcgtaattgctttgtgaaatgtgattcaaaccctaatcttcctgtaactttgaatttattcatttgctcttctgcatctaacttcttttgtgcttcttgatctctgcgatggatttcttctggtgtttcatgtgctatgccttctctgacagaggcttcatccccaaccttttccccagatagttgcaagaaaaatggaagcttttctgatttctttggagcttcctttggcttagaacgttttctgataacatctaaatgaagcaatgtgttcattttacttctaggtcctattgataaagtcaacagctccttatcaatctgttccaatgatgtataagtgttgaaatcaatatcatttaggtcttctcctccattgctttctaaagcccctgataacatcgagtcgttccctcgaacagatgtgctaggtaacgccattcttgcaaattcagactcatcgatggttcttgtcgatactgtcttaaattgtgctctgttcgtccagatgcatataccattaccagtaacatgggtagtggcaagcaagtcaccattcggagaaaactttacattcgtagcgacattatctactatgataccatcgatacatcctccggttggaagatcccacgttctaatggtggaatctagagaagcggaaacaatccaacggccctcaggtgagaaatcaaatgcagttattctattactatgaccccataattgacgaacaactctttgagtaactgcgtcaataacaacaattgataagtcgtctaaagccaatgcaaatagatcggaagaacgatgataaaccattgcggtaataggtgcatccaatttcaattttcccaacaaggttgacttgttaaagtcataaaaaccaacaataccgtctagtccacaagaaaccattttacgattcataccatctaaggatataccggtgactgctcttttgtgcaatttgtattttttacggagtataccactttgcatattatagatggtgatagagccgttagaagaaccgatgaatccaaaattaccacattgcgacatggccacagatttaacaaatccatcatcagtagtatcaaaagtccacctgccaactcttttatttcgcatatcccaggttcttgcaaacttttcatctttatgtgcagtgataatgttttcccattcacctattctggcattttcaattgcaagagccactatttcaggaaatttagacttaattgtactaccacctaccctgccgccatcttgtttcttgtgtaacctttgtgacatttcttgcgactgtgcatctttacgcagagaaaagctccataatgatctatctttggatgctgatagcatgaagtgtgattgcgaatcagcaaacgcaatgtatgaaggtggttgagaatgaccccctctggaacgtagatatcttggcggttgaacaactacatcaccgcttccttgagataatgacggatcgaaaacgtactccttcagggaattgtcaccacctgatgtaacaataatgggttgaccatttaaaaaagtagcctgagtgacaccaccgtacgattctctatgaatgttcttcaaaacgtgtattcttgaacggcgatctaaatcataaaatattagatcaccactgctcgttcccacactcaaatgagaagaaccgtcggttctgaaactcaatgaggagattcttgattgcggaatcttaattgtgcggatccttttaccttttctcatattaaacataataacctcaccggtcacggtacctagagcaataatatccaggactggagcgggttcagcagttgtgatttggtctggaaattcgtttgatgtgaatacaagcttcccggttctgacgttaaaaagtaaaacgttagatttggtaacgacagttaatttattcaaataagttgccaaatgttgtaaagacacaatttcgccaccttgaatttcagtaacggtaagtttagtgtagaattctgatggatatttatcttgcggatcggacttcttgtatataaagatggaattgtcgtcggtggaagcgcaaagataatctccgaatatgcacaaatgttcgacatttgcatcagtttctagctcaagcaaatgttcctcaatacccctcttgtaaataccaaccttgttttcatatgctgcgtagacgtagtgaaagtgtgctgataatgctacaattgaggatggtgtttctttctcggaaacaaaaagtaaatgtaaggtattcgcatcatatatctgaaatgttttaccaacacacgttacaatgtaaaaggtagatcccaatgtaccagtagcaaaaggaacaccattgctaacattaccaataatccggaaaggggaaaatatcttagaatttttccctctacttcttacgtcttcttcgacttttctttttttcaagtcgatagacataatgtactattcctaactcgctatagccttttcagtgtcttattccttgctgctgtttcgctgtatatttattgtgcttaggacttattaaatttcattagcaatctcatcgcgaaatttttctcaaaatttttcagttaaaaaaaaaaaagcacgtgctcaaaaatgtttttagaaaatcatttatttaagataggaaaaatgcaattaatcattgaatcaatatgttcaccacttaaattacccactgagcatttcatacaaattcaaaagcatctcgtagcatattaatatattgcagaaggtcatgagtgggataaagaaggaaccgattgaatctgatgaggttcctcaacaagagacaaaaaataacttacctagtgcaccttctgagatgtcaccccttttcctaaacaaaaacacacagaaggctatgcaatctattgcaccaatattggagggtttcagtcctaagacgtcagctagcgaaaatatgtctttgaaattgccacctcccggtattcaagatgatcacagtgaagagaatctcaccgtgcatgatactctgcaaagaaccataagcactgcactaggaaacggaaacaacaccaatacagttacaacttccggtttaaaaaaggcagacagtgaatcaaagtcagaagctgatcctgaggggctcagcaattctaacatagtcaatgatgcagataacataaattccatctccaagaccggatcgccccatttacctcaaggaacaatggacgctgagcagactaacatgggaactaactctgtacctacttcatcagcttcttcacgcaaatcctcgactagtcatcccaaacctaggctacccaaggtagggaagattggggtatgtgcaatggatgcaaaagtcctttcaaagccaatgagacacattttgaatcgtttaattgaacatggtgaatttgaaactgtcatttttggagataaggtgattctagatgaaagaatagagaattggccaacttgcgactttttgatatctttcttttcttcaggatttcccctagataaagcaattaaatacgtcaagttacgcaagcctttcattatcaatgatttaataatgcaaaagattttgtgggacaggagattatgtctacaagtattagaagcctacaacgttccaacacctcctagactggaaatcagtagagatggtggtccccgtgccaacgaagaattaagggcaaaattacgtgagcatggcgtagaagttaaacccgttgaagaaccggaatggaaaatggttgatgatgatactttagaagttgatgggaaaaccatgactaagccctttgttgaaaagcccgttgatggtgaagaccacaacatttatatatactatcattctaagaacggaggaggcggtcgtcgtctattccgtaaagttggtaacaagtcttctgagtttgatcctactttggttcatcctcgtacggaggggtcttacatttatgagcagtttatggataccgataatttcgaagatgtgaaggcttatacgattggtgagaacttttgtcacgctgaaactaggaaatcacctgtggttgatggtatagttagaagaaatactcatggtaaagaagttagatatattactgagttatcagacgaagagaaaaccattgctgggaaagtttccaaagctttttcacaaatgatctgtggtttcgatttgcttcgcgtttctggtaaaagttacgtcattgatgttaacggattttcttttgtaaaggataacaaagcttactatgattcatgcgccaatatattgagaagtaccttcattgaagccaaaaagaagatggatatggaaaagaagaatctgcccattattcgtgaagaaaaggaacaaaagtgggtattcaaaggactggctatcattatccgtcacgcggacagaacaccaaaacagaaattcaaacattcattcacttcgcctatttttatatcgttactaaaaggtcacaaagaagaagttgtcattcggaatgtaaatgatttaaagattgttcttcaggccttaagaattgcgttagatgaaaaagcaggaaatccagctaaaattaaagtgttagcaaacgctctagaaaagaaactgaattttcccggtacgaaaatacaattgaaaccggttttaaataaagagaacgaagtggaaaaagttcagtttattttgaaatggggtggtgaacccactcattctgccaaatatcaggctacggaactcggagagcaaatgagacaagattttgacctattgaataagagcattctacaaaacatcaagatattttcatcgtctgagagacgtgttcttcatacggcgcagtactggaccagagctctttttggggccgatgaattaggtagcgatgaaatcagtattagaaaggatcttttagatgacagtaatgccgccaaagatttaatggataaggtgaaaaagaagttgaagccacttttaagagagggtaaggaagctcccccacaatttgcctggccttcaaagatgccggagccatatttagtcataaagcgagtggttgaattgatgaattaccataaaaaaattatggataacaactttgctaaaaaggatgtcaactcgatgcaaacaagatggtgtacttctgaagatcctagtttgtttaaggaaaggtgggataaacttttcaaagaattcaataatgctgaaaaagtcgatccttctaaaatttctgaattgtatgatactatgaagtatgatgctcttcacaacaggcagttcctagagaacatatttgacccgggtcttccaaatgaagctatcgccgatgaactcggcagtcattctttagttgaccgatacccaattaacgttctcgccaaaaataattttaagataatagacagtcatagcatgaacaattctggaaagaacagtagtaatagtgttgggtcgttaggatgggttctggaaagcggaaaaacatctacagcaagaaaccccaaatcttcttctcaattcgatgagccacgctttatgcagttgcgggagctgtataagctggccaaagtattgtttgattttatctgccccaaagaatatggtatttcagatgcagagaaactggatatcggtttgttaacttcgttgcctttggcaaagcaaatactaaatgatataggagacatgaaaaatagagaaactccagcttgtgttgcgtacttcaccaaagagtcccatatttacactctattgaatatcatatacgaatctggtattccaatgagaatcgctagaaatgctttaccagaactagactacttgtcgcagatcacttttgaactttatgagagtacggatgcttctggtcaaaaatcgcattccattagactaaaaatgtctcctgggtgtcatactcaagatccgttagatgttcaattagatgacaggcattatattagttgtattccaaagatttccctgacgaagcatttggatatggactatgttcaacagaaattgagaaacaaatttaccagggtcattatgcctccgaaatttacaccagtaaacattacgagccccaacttgagtttccagaaacgcaaaaccagaagaaagtcggtatctgttgagaagttgaaacgtcctgcctcgtccggatcttcatcatctacctccgttaacaagacattagattagtgatcacacccaatttttaatttagtaacccaaaactaaataagtatttactcaacttttttttaaaaaaaaaaaacttaattgaattttgctcgcgatctttaggtccggagttttcgttgaacccttagacgagcaaattagcgccataaggatatgcgtcagagcacattaattagtgacatatacctatataaagagcaaccttcttgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcatggtagcgcctatgcttcggttacttctaaggaagtcccatcaaatcaagatccgttagccgtttcagcttccaatttaccggaatttgatagagattccactaaggttaattctcaacaagagacaacacctgggacatcagctgttccagagaaccatcatcatgtctctcctcaacctgcttcagtaccacctccacagaatggacagtaccaacagcacggcatgatgaccccaaacaaagctatggcctctaactgggcacattaccaacaaccatctatgatgacgtgttcacattatcaaacgtcacctgcgtattatcaaccggacccacactatccgttgccacagtatatcccaccactgagtacttcctcacctgatccaatcgatttaaaaaatcaacactctgaaatacctcaagctaagacaaaggtgggaaataacgtcttaccaccacacactttaacatcagaagaaaacttttctacatgggttaaattttacatcagatttttgaagaactctaatctcggtgacatcattccaaatgaccagggtgaaatcaaaagacaaatgacttatgaagaacatgcgtatatatacaataccttccaagcatttgccccatttcatttattgccaacatgggtaaaacaaattttagaaattaattatgctgacatccttacagtcctttgtaaaagtgtgtccaaaatgcaaactaacaatcaagaattaaaggattggatagctcttgccaaccttgagtacgacggaagtacatctgctgatacatttgaaattacagtcagtacgatcattcagaggctaaaagaaaacaatatcaatgttagcgacagattggcctgtcaactaatacttaaaggtctatccggtgacttcaaatacctacgtaatcaatatcgtaccaaaacgaacatgaaactttcccaattattcgctgaaattcaattaatatatgacgaaaataaaatcatgaatctaaataaaccgtcccaatacaaacaacacagcgaatacaaaaatgtttctcgcacatctccaaacacgactaacacaaaggttacaactcgtaattatcatagaacaaatagttcaaaaccaagagcagcaaaagctcacaatattgctacatctagtaaattctcaagggtgaacaatgatcacattaatgaatcaaccgtttcatcacaatacttaagcgatgacaacgaacttagtcttaggccagcaacagaaagaatctaagccaacacacacaatagactcgaatgacgaactacctgatcaccttcttattgattcaggagcttcgcaaacgcttgtcagatcagcccattatttacaccatgcaacacccaattctgaaataaacatagtcgatgctcaaaaacaagacattcctataaatgccattggtaatcttcacttcaactttcagaacggcaccaaaacatcaataaaagcactacacacaccaaacatagcctatgatctattaagtttgagtgagctggctaaccaaaatattactgcctgctttaccagaaacactttagaaagatcggatggtacagtactagctcccatagtcaaacatggagacttttactggttatctaaaaaatacctaattccttcgcacatttcaaagctaacaataaacaacgtcaacaaaagcaaaagcgtaaataaatatccatatccgttaatacatcgaatgcttggacatgctaacttccgaagtattcagaagtctcttaagaagaatgcagttacatatttgaaggaatcggatattgaatggtctaacgctagcacatatcaatgtcctgactgtctaatcggcaaaagcacgaaacatagacatgtcaaaggatcacgactaaagtaccaagaatcatatgagccttttcagtacttgcataccgatatatttggtcctgtacatcacttaccgaaaagtgcaccttcttactttatatcgtttacagatgagaaaaccagattccaatgggtgtacccattacacgaccgtcgtgaagaatctatcctcaatgtttttacatcgatattagcatttattaagaaccaattcaatgctcgcgttctagttatccagatggatcgtggctccgagtacactaacaaaactcttcataagttctttacgaacagaggtattactgcatgctatacaaccacggcagattctagagcacacggtgtcgctgaacgattaaatcgtactttattaaacgattgtcgcacactgcttcattgcagtggtctaccaaatcatctatggttctcagcagtcgaattttctactataatcagaaattcattagtctcaccaaaaaacgataaatctgcaagacaacatgcaggtttagctggactggacattactactatactacctttcggtcaaccggttatagttaacaaccataatcccgactcgaaaatacatcctcgtggcattccaggttacgccttacatccgtcacgaaactcttatggctatattatctatcttccatcattaaaaaagacagtagatactaccaattacgttatattacaagacaaccaatccaaattggaccaattcaattatgatacactcacctttgatgatgatctcaatcgtttaacagcccataaccaatcttttattgaacaaaatgaaacagagcagtcatatgatcaaaatacagaatctgatcatgactatcaatcggagattgaaataaactctgatcctctagtgaacgacttctcgtcccaatcaatgaaccccttacaattagaccacgaaccagtccaaaaagtacgtgcaccaaaagaagttgatgccgacatatctgaatacaatattcttccatctcctgtacgatctcgtacaccccatatcattaataaagagagtaccgaaatgggtggtaccattgaatcagatactacttcacctagacactcgtctaccttcactgcacgaaaccaaaagcgacctggtagtcccaatgatatgattgatttgacctcacaggatagagttaattatggacttgaaaacatcaaaactacacgtttgggtggtacggaggaaccatatattcaacgaaatagtgatacaaatatcaaatacaggactacaaatagtacgccctcaatagatgaccgttcgtccaacagtgaatccactactcccatcatctccatagaaacaaaggctgtatgtgataatacaccctccattgatacggatccgccagaatatcgatcttctgaccatgcgactcctaatataatgcctgacaaatcctcaaaaaatgttacggctgattctattcttgacgacctcccacttcctgacttaacccataaatctcctacggacacttctgatgtttcaaaagatattccacacatacactctcgtcagactaattccagtttgggtggtatggatgattctaatgttctgactactaccaaaagtaagaaaagatcattagaagataatgaaactgaaattgaggtatcccgagacacatggaataataagaatatgagaagtctggaaccaccaagatcgaagaaacgcataaatttaattgcagcaataaaaggagtgaaatcgatcaaaccagttcgaacgaccttaagatatgatgaagcaattacatataataaagacaacaaagaaaaagacagatatgttgaagcttatcataaagaaattagccaactattgaaaatgaacacttgggatacaaacaaatattatgatagaaatgacatagatcctaaaaaagtaataaactcaatgtttatatttaacaagaaacgtgatggtacacacaaagctagatttgttgcaagaggcgacattcaacaccccgatacatatgattctgatatgcaatccaataccgtacatcactatgcactgatgacgtcactgtcaatcgcattagacaacgactattatatcacacagctggacatatcctctgcttacttatatgctgatatcaaagaagaattatacataagacctccaccacatttaggtttgaatgataaattactacgtttgagaaaatcactctatggtttgaaacaaagtggtgcaaactggtatgaaaccattaaatcatatttaataaattgttgcgacatgcaagaagttcgcggatggtcatgcgtatttaagaatagtcaagtaacaatttgcttattcgttgatgatatgatattattcagcaaagacttaaatgcaaataagaaaatcataacaacactcaagaaacaatacgatacaaagataataaatctgggtgaaagagataacgaaattcagtacgacatacttggattagagatcaaatatcaaagaagcaagtacatgaaattaggtatggaaaaatccttgacagaaaaattacccaaactaaacgtacctttgaacccaaaaggaaagaaacttagagctccaggtcaaccaggtcattatatagaccaggatgaactagaaatagatgaagatgaatacaaagagaaggtacatgaaatgcaaaagttgattggtctagcttcatatgttggatataaatttagatttgacttactatactacatcaacacacttgctcaacatatactattcccctctagacaagttttagacatgacatatgagttaatacaattcatgtgggacactagagataaacaattaatatggcacaaaaacaaacctaccaagccagataataaactagtcgcaataagcgatgcttcatatggtaaccaaccatattacaagtcacaaattggtaacattttcctactcaacggaaaagtgattggaggaaagtcgacaaaggcttcgttaacatgcacttcaactacagaagcagaaatacacgcagtcagtgaagctataccgctattgaataacctcagtcaccttgtgcaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacatttaaactattaacaaacaaatggattcattagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcacttctccgatagacttgtaatttatcttatttcatttcctaacactttgatcgaagaagagggataacaacagacgaaaacacatttaagggctatacaaagatgaatatgggaggcagtagcagcactgctgccaaaaaagcgacttgtaaaatatcgatgttatggaattggtataccattgacacctgcttcattgccagatcttggagaaatgacaccaaaggaaaatttgctggttcttgcatcggctgttttgcgcttgtggtggtagctcaatggcttactcgtttttcaaggcaatttgacgtagagctattaaaaagacagaaaataaagcatttagctagttactcgccagaggagtacgttgtcaaatgtggagaagaggatgctaaatctgatatagaagaactacaaggcttttacaacgaaccaagctggaaaacaactttaatttccttacaaaaaagtttcatttatagtttttacgtttggggtccaaggagattgaacgagccagaagacgacctgttaaagaaggtcctatcatgctgtacattaataacgccagtggatttgtacccaacttttttggatcacatgataagagttactattttcgtattacagtgggggttatcttatatcatcatgctgctgttcatgtactataacggctatatcattattagttgtttaataggtgctatcgttggtcgtttcatattttgctatgaacctctaggctcattgggtgctaatggatcagcccagggtacagtgagttatgataaagagagtgatgatcgcaaatgctgcttgtagaaagacaaaaatgaatagaggaaagccgagaggtttgtttcaaaaattgacgccttcctcatttttttcataattagctggtaaaagttactatttgtaacgactgctaaataacaaataattattcgtgtaaaaataaatagctaataccaccaggtgttcatattccatgactgcatatttgggaaacgagacggtttgaacatccttagttgatgtaaaactataataaaagctctatgggaagtaaactatctgcgggtcgggtaaggaatgatgcttgctcgacgtgtagcgatgaaaaaagtgaaaacttatttgaactctagaaaactgctaagatcctgaactgataccgaagttaatgaccttgaccggtcttctgctgtatggattttaaagcaagtgggacaaagtttaagaaaactggcaagaaggtagtgcctgctaaagcgtttgaagaaattgttcagacaaatagagatgttctgaaaaaatcagcattcctctcagatttacttgaaaatttacaaccgcacctcaataacattaagaaaatacgatgtgttgcaattggaaatttcaaggaggattttcctgcgacgtaccaattcgctcttctcctagagattactgattatataaaaagtgaggatgaaagggatgtcgttgtttccctgtatgatccaatatttactaaagaagagatacagtacttgaaaagtttaggaagcaaatggctgatagaggaagaattttcagagaacgatgcaattgattatgaatcggtattatatttccttccccatgctcctttggatttaactgagaacatactatcgtcacagcgaccacacttatggctggcaaataatatgatatcacacaccgatagatacaccaaagcaaaactttgtgaaaactatcctaatttaagcaagctagttcattacttgcagactaacgctccgccagaagttaaaaaagcacatgatgtagatggttttgcaacattcattccaaagagaaaaagaaaaaacagaaacaactcctctaaactcaaggtcacaccatctgatatagactatgattcaatagcaccgaagtttaagtcctgccaaatactcaccgattttgatgaaggaaagtatttgaaggaaaaaccctggatcaattccttctctgacttgacgttacatgctatagagtactaacatatcattcactacatagtactttataactaaactgtaactttcagggcatcgtaacctgacgctttaccatcaataacgacacgagaccgctttatctatgatactggaacaatcaacatgattgttataaatgtactcgacaggatcatgaaaggataccaacttagttgccggttcattgaaatggaaagctcaagaacgtatactgaaagagagcgacgtctactttgcccacaaaaatctactctctgaattgaatagtatttagagattgcataattcaagccctcctcgaggaaaggatataaatgaaaataccgtttttcctgctgatggttatcgtccctgtcaaggatacttctcggactcgaacaacgttacagctcaacttaaagaaggctaaatacgacaagggcgcttgccctaagaggaactgtttctaagttctaacgagtgcctgcgaagatcggttttttttaacttcgcgggcgaattgataaataaagttcttcttgcaattttttaagatcaaggttggggcaaaaaggacgcaaacgaatggttgggttaagaaagtggaaagacccaaacctgaagttcatttagttcttggcggaatgaatcattcgaacggcgcaatacgctcgtcaaagaaggaggtatgatttatgacggtttgtgggtagccctctaaacacgtggagagtaaccttttctgtttagcgatcctagaactgcgaacaatggtagctattcgcttactcaacaatattgttcttgattaatgcattcaaatatgtaacttcgtccctcatataagcgtctgacgcgtcgtgaaaatttaccctctcaagaaaatacaagagattacgtaaaattagaaaccaaaagatatgagtggaacagacacatatcacccatatttccttttcacgtaagaaaacttaagtactagtgcggtgcctgcgttagtgcttgtctttaggtcaaacaggtcatcttgaccaacttagcttataataagaatgataatcgattactctaaatagcattctttcatttgcggcatcttataacccacacaccgcatttaggacccgttttttttctttttttttttgttgaaaaaattcaacagttcctatttttttcttttcattctttttttttgccttgccttcgtttcgagaattctttttctttttctttaggtaagggaccttctcagctgaggcacggtggggtttgtaatagtgtccattctggcacaaatgcataagtgatgctaaaatagtgatacgtctaaacaaaacggtttggatgcctagcaaatagtaaaaagacttgaatatatcacttttatcactatgtaaaaaaactgagttatattattaagttttttttgaaatgttcccgtttgacgtgtatttagtacagtatgttccgtggatactgtttaggtgcatttaagcgctccagaactctcctttaaattcctgcagcactccgtcagttgcttcgtaaatccgcctggataccgccttgaagattaaagttcccctcagtactcgtttagcttgaatccaccgcattatggcctggtaaattccctagttgcttttttctatacggcgtcgtccctggaaaaaaaaaacttgcctacagatcttagtagacaaatttaactacgtcaatctattgttctgcttaaaaaaaaagttgaaattgttaaatcctcaacaaacttatcgcttttcaagctgctgcaatcatagatcttacacttctacacagaatttttttttcctgtaaaaagaacgacaaaatatataaacctttgacaatctagctgcatttactcacattaagccttgagattttcatttacttcataatagcttgtagatgcgatgctgatacagtaaaataaaaattcagtaatacagtcaaattattgcgatgaattttaaaatactcctcccgatttgtgctttattgacacttacaacatttctgttgaccattattgcaactgcgggttctacctcaaattataagccaataacgaacatttatatcggtgatgctgatatatcaaaaatcaacgttacaaaagttatgccacaagttggcccaattttgactgtgttaggttctgctctaaccgctccaaatacaacggtggataccatcttcggcgctcttaaggcaatcgcttctaccgaagccttgtctcctttactgcacttgttgtctaatgctgctaacacttcagccacattatcatctttgacacagttggctccaatggctttgctaggaaccaataccgctactaccacgaccttctccgctcttgatgagttattgactacctctaaaaacacaaccgaactcttggatgggtttagcacattgatgtcatctatgtcaaccaacacttcttctacttcggcttccttagaaaatactgttctaaccctattagtggattcgaccaatcctataggcactactgagtctttgatcactttaaataatatgaccacagaagaaaagacaaaattgtcgcctgtattcgagttattcgcaagttccaagaacattactgccacatgcgatgcgttagaaaccataatgaactctaccattccaacttcaacggtctcctcattgttttctagtctaaaaaccagtcttgcggaaggtggcaatgctactgaaactattatgcaattaggctccctcgttccttcgagtttaaaaccagctgtccaagctgttgttactctgtttgatgaaactacatctcaaaatgtaacattatccgtattgagcactatgattgccgaaaacattacccaatcatcttccgctaaagctgccatgggtgctttgactgacttgttgaattacactacaaaccaaacagagctgctaacatctgtcgaaagtttggccctctctaaagaagccgcttcctctactaaccaattggtggcacttgatgaaatcctttctgcaagtgctaacgcatccacagttgtttccataatccctactttggaatcccaattggccaataacaccgtattacttaagtacgttccatacttgttcagcctattagctgcgtcaagcgaccccgtgtcaagtttctcttctctggttaatatcaccaaatgggcagaaactaatgccgctacatttatgcccatgttgaaaattttaaactctgctgtaaacatgacaactatcacaccagaacaactcaaggaaatgactccttctatccttgaatatctacacatccctgtcatataccgtttgtccattttcacaatgtgtcgtgctcacttaaacagaacaatgtactcgtgtagcaagtcacacgctgttcaaaacatggatttccggtcgattgtttacaacaacattgaaggctcggactttaaaccttatatggatgccctgaacatcggtaaggacgatttgcatttagatggtgaattacaagacagacaacacatgtatgtcccagcagtgaaagcagctttagctatgaacttaatgtgcataatcacatccttcttcttaatggtattcttgttgctactaagtagacgttccgtggtgagtcaaaaattatggttggcattgggctttatttcctgttggatatgtattttcagcgggttgggaagcacaatctttagcgtcatccttaatatgatgaaatccggctccaagaaggacaattacgatgtcattatttctggctcttctccattttatggcctaatgtggtctggatttgtatttgccgtccttgtatttctctgcattgcatactgctggtggagcagcagaaagggagctgccatcgtggaagctgagaaagctgttcaagaaagtgactctactacctcaagaatcattgaagaacacgaaagccccattgatgctgaaaaaaactttgcaaggtaaaataataaaaagaagatcatgcaacatcaccccgtaaattttttcaattctccatccttttaattttcttcattataattttctgaattgtatatagacaatatattttaatcatatttaatatgaaacggaacacaaaaattaattaataaccttgcctttttcaaattcaaatcaatggtttttcctcaattggagcgttcgcatagatgacggtgggcctcgatctcacgctacaccatagaatgaaattcagtaatgctccaacgacagccccccacatcaaaccctggtagttcctaccaatgctcattgaaataccgtaatcactatagttatgctttaggatgtatttgatgtatgagtaagtgcccaaacacgaacctatactgactaatagggcggcaaaggcgaaaaatgaaaaaaaggcaccaaaccacgttagcggccttatgtggatgatccagcgcaatacgttgaacactagattcacaaaggtcaagacaataccaataagaatggtaatgaacatacacttgaccaaattgttgtagtatgtcattttactttttagtttttcgggcaaaacaacactggccacggaatccataagctccagagcctcattgttgttgatattgtcatacactaatgacgataggttaaaattctggataccgtgaggcgaagaacatgattggatgttatgcgaggagtccactgtacagtacgaccaaagccctatatttatatatgagggcaggcccaacgaagatagcgtagcagaactcaaagaagggagcaccgtcgataccttcatctgcgacagatccaattctgcacagtaaattttatttatgggactgtaatttttcgttgatcctgcgcatgcaacaatggctaatataagtgctcctagcgaaaatatagctgcaaaaaataacgtgaaaaaattcctcatgcttatagcgtccttcgatgatgtgtttgtttttttcttaatagttctctattgctttaatcaagtttcactactgcgcagcgttgtatgatcttgatctagtttcttttagttctacttccaaacaactggtccagaatgaaacaccactggacactcattgactactgagacatggaagagcaacattctcgcgtatatatacttctcagccaattttcctgcgagaagcgctaaaaataccgagctgggcttggctgatagtacgcccgatttggaaataacgctcgaggcgtgctgcgtccttttttgcctggccaggccaggccgggttgtcccgcaccattcaacggcggctatctggcgatgttgaaagagggggggagtggagagggctctgagggtcaagtgggaggctgtgacagttctcataagctgggcactgagatacatggaaagaaataggctgttcacagtgtacgtcaatgtgtggctgactaaccgttagcggggcggaaccgacatgtctggtgcagtgtatgtaagaaaaaaagaatgacaatgcatggccaaacttttgatctgtgacgttcgcaaaacgcactactttgctttctgtatgcaatgggaatgaggcgtagcgacatattaagaagccttttccatgtgaggaagcttcgccttgttttccagacgcgctttttttaggatcaacgaagaggaaaaagggtttcacatgtttcatctggaaaagatggagactgaaaaacaaaaaagcagagaaaaggtcatccaagatagaataggggacctcggctaggaatcaggaagtgtgttttgaaagtcattctttttttttcaaaagatggagtactggcattatgtggaaactacgtcatcgggccaacctcttcttcgagaaggtgaaaaagatatctttatcgatcagtccgtaggtctttaccatggcaaatctaagattctacagcgacagaggggcagaatctttttaacgtcacaaagaattatctacatcgacgatgcaaagcccactcagaactcgcttgggttggaattggacgatctagcgtatgtaaactattcatctggcttcttgaccagatcacctcgtctgatcctgtttttcaaggacccctccagtaaggatgaacttggtaaaagtgcggaaacagcaagtgccgacgttgtttcgacgtgggtctgccccatctgtatggtttcgaacgaaacgcagggggaattcactaaagacactctacctacacccatttgtatcaattgcggtgtgccagcggactatgagctcaccaagtcgtctataaattgttctaatgcaatcgacccgaacgccaacccacagaatcagttcggagtgaactctgagaacatttgccccgcctgtacttttgctaatcatcctcaaataggaaattgcgagatttgcggccacagattgcctaatgcatccaaagtacgatcaaagctgaacaggctaaactttcatgattctagggtccatattgagctagaaaaaaattcactggctagaaacaagagctcgcactcggcattatcgtcctcgtcctcgacaggatcatcgacagaattcgtgcaattgagtttccgcaaatctgatggcgtattgttttcacaagctacagagagggctttggagaatatactcactgaaaagaataagcatattttcaatcagaatgtggtttctgtaaatggtgtagacatgaggaaaggggctagttctcacgaatacaacaatgaggtgccatttattgagactaaattgagcagaattggcatatcaagcttggaaaaatctagagaaaaccagcttttgaacaatgacattctctttaacaatgcgttgaccgacctaaacaagctaatgtcgctggctaccagcatcgaaagactatacaaaaatagcaacataacgatgaaaaccaagacattgaacttacaggatgaatcaaccgtgaatgaaccgaaaacgagaagaccgctattgatacttgatagagagaagttcctaaataaagagctgttcttggatgagattgcgagagaaatttacgagttcacgttgtccgagtttaaagatttgaacagtgataccaactatatgatcataactctggtagatctatatgcaatgtacaacaaatctatgcgtataggtacaggcctgatatctcccatggaaatgagagaagcatgcgaaagattcgagcatttaggtctaaatgaattgaagttagtgaaagttaacaaaagaatattatgtgtaacgagcgaaaaattcgacgttgtaaaagaaaagctagtagatctgatcggtgataatcctggttctgatctcctaagattgacacagattttgagttccaataattcaaaatcaaactggacgctaggtatccttatggaggtattacaaaattgtgtcgatgaaggcgatttactgatagacaagcaactgagtgggatttactactataaaaactcttattggccctcgcatatataagtaataaatgcatggtttgattacctgctcgtaatactacattctcccaaataaatagtttacatataaacgcgcggctaaacttcacttcgttacttgaaatgccaataataacacataacatagagtacaaaatcggaatagaaacgccgactgaagaaacactttcaatggccgaaataccattcttccgtttatcgtattcaacggtatcctcttgaaataagttccttttctaaactatgccagaaataacgcacgacttccacatccttaaatcttttatttttgtcaagttcgaccttttctacattccattgctgcacgtgttgtggtacagaatcaccggcaaagtggaaatagtagcctttgcagcgttgaaataattcctgtggcgaattccactgatagttattaaactgccacgtatgaccagtagtgaagatagcgacaactctgtcccaatattctggcttagtaaacatcctagtgttatcgactataataaatctaattggtcttgatatacgttcgaagtttttctctatgttaactaatccgtttggcactgacggtaagttacgaggattcacgtattttgactccagcaggaactgttttatatttgcaacagttaaaattgatgacgcagccgaaggaatcaaaataattggatctttgcgagggccacctgatgaaccatttgttttggaaatacgaccgtgcgcgcccttatgaccgggaggcaatttagatcctcgtaaagatcctttgatcgactgtactaattttagttctgcatcttttattagataaccaaagttgatcggcttagcaccacgcaatgcagagttgtggtccaccaatatacgttcatgtttcattgtttccaccacaactggatcggaaacttcactatcattttcaagagatgctgaagtggttgattttacagtcgacaattcaccagccaaagttttattttctatatctactttatcggatgtctcgcctttctgaccgggtgctttcagatattgggatgattccgtattgccagacaaccaatttattaaatcagttctttgtaaaaatgaaacattagtcaattgtttattctgacagtctgctagatagtctgcggcacttgagtccttattcatccaacaatgaacaattattcgtaactgtaccaatgaaccatcaatctcaatttccgtttcttcattcaatggaaaactatcttgggtactaccatcactggatagagtttctaccatggttgctttcgtaatatcatcagtagactgtccctcattattttttagaaccagtttatcgccgttctttaagtgttctctcagtctgtctaatgagttcgccataattttttcaccagtttcttgctcaaattattattcttttaacgccccgaattaagaaacagcctgttttggaaacgcaatttgaaaaagggtggaatattcgttgaagtacttgttttaaacctgtccaatcgaaattttcatccttatgctttgagaacaatattgcgttgccggttaaccgtctcggtgttcgatgagttgaaaaattatacactaaaaagatacatactattcaaagttgtaaaagagactcttagctaagggaagtattaacaataatcattcactttatactttacatcgcaattgctttcattaatttttgataaatggccaaaaaaacgaaaaataactcaaaaagttcaactccagtgaatgatgtaccaacaactgctggcaaaaagaaagcaaaaggaaaaaagggacaagaaccagagccagaagatgacaaaagggccaagcaacaaagtaatagagcaaaagtgacatccacagcaagctggacaggtaaattgcctcatacaatcttacacgaaacatgtcagaaacgaaaatggaataaggtagagtatgatatgaagaaaatcggtgataaaggtttcattgcaattgcagttttgtcattcactgacccaaagacaaaagaaacattgactgcaagaatgaacgatccaacctatgacaaagcttcaggaaaaggccttgtaattcctcaagaaactccaattgaagctagacacatggcctccactattgcgctatatcgcattgcatacaacaccaacctgcacatgatgcttccgccaaaccatagaaaaacatggtatgccctcgacgattttcgaaaagataacctgaaaacagacgaaaagcgtataaacaaactatttgatcttgatcccttcaagacaatggtggaagacagaaagctcaaagcccaacgtgaaaaagaacaagtggcccagaataatcaagcacagaaagaacaagttgcacgaaccattttatctagccatggtggaatttcttcttctggaaaggacaggcaagagagaaaagtagcatctcataaaaactcacataatccttcattagtgcggtttccaaaaaaggtttgggaaaattctatatttgttgaccttgatgaatcgtctagacaactgatagaaacttcattgaaagagaaaattgattggcaagctaaaaaaattagccataaaaatgagacaattgctgaaaatcgggaagatctcaaggcaaaattattaactctacaatttagaccaaaacacgtagaggaagccatgctttataaagatccattgtctttcttattgtttaacttaccggaagatgatttaccaccattttttcataaaaagaaaggtgatacaaaaaacaaggttgaaataacaaacctaccgttatcaactagaatgatcgttgagcgtttaacagaaattggtgtctcttcagatgaagccttattggctttacaacaaaacgatatgaatgaaaatgaagcggccgggttcttgacgagggaaattttaccaactttaaatagcaatacgaatgaacctgtatcagaaactgaatctatagaatgttggaaccaagagctagagagcctagagagcatttatgagggctgcgtgatggacgccaaggaagattcacactacacgctcaatttaattgaaaaactcaaaataaaattgaaagtatatagaaccaaaaattatcctgcatcattacctggtattgtagtttcaacctttgataaaaattacaagctacctgattatattaagaaacaaatattaaccaggttactgcattatctccaggaaggaaatctaataggcgatatgttagtatatcatatttatgaatggttgaaagagaatatatctaagataattgacaaccctggcccattaattccagattcagattcgaaaggtgcaataaacaaaagaaacatttcaaacggtaagagaagtataaataattctagttcgagaaaattcacaaaaaccaccatttctgaagacacgctctctgtcctaagggaagagtacacaaaaaggatcaaaagttctgaatacaaaagtatgcagttagttagagaacaactgcctgcctggaagaagcaaaaggttattatagatatcatcaataaaaacgaagttgtattgattactggtgaaacaggttcgggtaaatccactcaggtcgttcagtttatactagatttcttacagaaggaaaaaggagatttcggtaagactaaaatcgtatgtacgcaacccagaagaatctcggctattgggcttgctgaacgtgtttctgatgaacgctgtgtaacttgtggggaagaggtaggttacgtaataagaggtgtcaataaaaccaaagcttccacacgtatcaagttcatgaccacaggtgttcttgttaggttgttacagaatgctagaactatgttagaaaacacaattgttgttattgatgaagttcatgaacgttctattgatactgacttgatagtgacattgatgaaaaatctcttacatagagttcgcggcatgaaaattgttttaatgagtgctactgttaacgttgacttgttcaaaaaattctttccggggctagcaacatgtcacatagaaggacgcactttccccatcactgattacttcttggaagacattcttagtgaccttgacttcaagatcaagagagagaaggctttgtcttatgatgatgatagcgttgatgaaagaaataatgacgaccaatatttgaagccgagagcagattctaagttttttacatctgggcaaatcaattatgatttgctttgtcaagtggttgaatatgtacataaacgcctgaaagctgctaatgacaacggatctattatcgtttttttgcctggtgtgggagagattaataagtgctgcaatttgctagctaataaatcaaatgaagcagattttatggttctacccttgcactccgctctaactcctgaagaccaaaaaagggtgttcaaaaaatatcatgggaaaaggaaagttgttgtatccacaaatattgctgaaacatctattactatagatgactgtgttgcaactattgacacaggccgtgccaaatcgatgttctataatccaaaggataatactacaaaactaattgagtcgtttatttcaaaagctgaagttaaacaacgtagaggtcgtgctggtagagtacgtgaaggtttatcttacaaattattttctaaaaatttatacgaaaacgacatgatatcaatgccaattccagaaatcaaaagaatcccgttggaatccctttatttatctgttaaggctatgggtataaaggacgttaaagcgtttttgagcacagctttggatgcccctcctttaccagctctgcaaaaggcagaaagaatattaacaacgataggacttgttgatgagtccgacaagtcactcacacagctaggtcaatttattagcctgatgcctgtcatggatagtaagcatggtaaattactaatatacggcattctgtttggctgtacggacatttctgttttacttgtctcgatactcggtattggagttttgcctttcatcggaggttttgaaaatagggaaaagataaaaaaactgctatgtaaatatgaaagtcgtggggatttatttgcagtattggaaattgtcagagattacttcaaaatcaaagattcgagcatcaaaaggaaatatttgagagacaatttactttcctataataaaattaatgaaattaagtcatcaacagcccaatattattctattttgaaagatgtaggctttctaccaatggactataaagttggaagcatttctgatttgaataggaacgagcgaaattttgatatcctaagggccattctcacgggtgcgttttatccacacatagccagggtgcaactaccagatgtaaagtatctatcaacaagttccggtgctgttgaaaaagatcctgaagccaaaatgatcaaatactggattcgaagcgaagagtatcaggacaaattagaagaatataagacgaaaatttcgcaagagacgcaaaaggttgatttggaagatttaccgttacctgctactagggcattcattcatccaagttcagtcttattttcaaccaattcagtaaacttggaagacgctaagttactctctgaggtggatggtccaatatcccgtcaatccaaaataccaaccgttgtaaaatacccatttgttttgtttaccacgtctcaagttactaataagttgtatttgagggacttaaccccaactactacattatcattactattattcggaggggcaatctcttatgacattggaggtactattcattcaccgggcatcgttgtcgacaactggctcccaattagaacctggtgtaagaatggtgttttaatcaaggaactgagaacacaacttgatgaggccataaggaaaaagttagaaagtcccgattatgctaaaaaatctcaaattgataattctggtgctgataaaactctaaaaattgttgaaaaaattatagcttccgaacaatagtaatcagttcctactgtagtccctgtataataattatcatcttcattttcgaaaaggaatttttttaacatatagaagtgtcaaagtataaaacactaacaaaaatctaagagattattgcgactgcgtgtttttctctttgctgaatcagggctagaatcccgtaaactacatagcacattgtctttgccatattttaaaaattttgtggcgccgtcaaaataaaaaaaaaatactgaaggatgcgaggttcgaactcgcgcggacaaccgtccaacagatcttaagtctgccgccttagaccactcggccaaccctccgtcgataatacaacaacaaggaaatacaggatacgaacaccatccagtttaacttgattaatctttacgcatgcatattgctacatcttttttattctgcaatatacatctgtttatatctcattaatgttggtaagcctctgaaaaatttatcaaatactagtacaattgtttaccaacatcattttcgttgctagaaaattactatacaccgttaagaaaagacataaatcatgagactaatagaacaacactagggattagccaatttaatgggagctgaaatgcagggattaattatgcaattacaaaatgaatggtatcgtttgaaatgaaagaagaaacactaatattataacatagaaatatcgatttcttcctgcgaattcccatgtcctcgttgagaacttctaatatgttttgtatgcctaatattatagctttacaaaaaaatagaatctcaacaattatcccacaattcactcatgtcatgctgcctctcgcgtattttttcttgaaaccgatgctagtttagttgtctttcggcatcagctctaattttttcaagaatagtatctacagagtcaaatttcatcattcggagaattccgatgaatcggcatcgtcagagaagctatataagaagagataaacacatttgaaagataggatatactttgaaagtgttctggtgaccactatatcacttaagtaatacctaacaaagcaatggtacaagaaatcgatttaggtttgacatgtgatatgcatgttcatgtaagagagggtgcgatgtgtgaactagtcacccccaagattagagatggtggggtttcaattgcttacatcatgccaaatttacaacctccaattaccacactagatagagtgattgaatacaaaaagacactgcagaaactagctcctaaaactaccttcttaatgagtttttatctttcaaaagacttaactccagatttaattcatgaagctgcccaacaacatgccattcgtggagtaaagtgttatccagcgggagtaacaacaaattcggctgctggggtggatccaaatgacttcagcgcattttacccaattttcaaggctatgcaagaagagaacctggtattaaatttgcatggggaaaaaccttctgtccatgatggagacaaagaacctattcatgtattgaatgcagaggaagcctttttgccagccttgaaaaaattgcataatgatttcccaaacctgaaaataattctggaacactgcactagcgagtcggcaataaagacaatcgaggatataaataagaacgtgaagaaagccactgacgtaaaggttgctgccacattaacggctcatcacttatttttaacaattgatgattgggccggaaatccggtaaatttttgcaaacctgttgcgaaacttccaaatgacaaaaaggctctagtcaaagctgctgtatcagggaaaccatattttttctttggatctgattcagcacctcatcctgtacaaaataaggccaattacgagggtgtttgcgcaggagtttactcacaatcttttgcgatcccttatatcgcccaagtttttgaagagcaaaatgccttggagaacttaaagggctttgtttccgacttcggaatttccttttatgaggttaaagatagcgaagtggcttcttcagataaggcaatattattcaaaaaagaacaagttatccctcaggttatcagcgatggcaaagacataagcatcatcccatttaaagcaggtgataaactaagttggtcggtgagatgggaacctcgttaatatgcaacaatatgtaggctcatttgagagtatagaccatatatacatatttatgggaaaaataaacttaccttccaatagaagttatagatgccatcatcatgcctattgttatggtccgtatctctttacagaagttcacagccaaatgcgttgatatggtatattttttctcttcagttttttatcaaaaaatgccacaaccttgatttaatcttgcatactaacatccacatcttgagctttttgcttttcgtcattgctttcttcctcatcactttcactactattattcagcactccaatcatcttattgtaaatttctttatctttcgcactcaattcatttaagggcaaattacctgagttcttctcttgcagccaaaagaagtacctttcgttggatgaaaaaactaaagcaaatattctgccacttttactggattttattggaacccacatggtctctccaggaattaaaatcaaagaaataggatcaagttccctcccgaccggcttttccgttggacgccactcgaaatcccaaaatcccaattcttcctcttcatttggtttgatctcgatttcaccctgaactggaattggcgtacatagacgtgaatcttcgttgtattcacaaacaccagccctgaatttaattacagttgaactcatactcatcaacactcttttaaaatttataagtcaaccagcacttaggtagttttctggcacccttatagaacctaatctactggtcatagtagagtatttagtagcaaagctttcgccacctcgcgaataatatatcacgaaatacggaggaattttaactgaaatatatcaataacgcatatcaaggaggggatgacttgatgagttgaaaataatataaatggttcaagcaaccgtttgtacaccactcagtcaattattgcttcaattgaaattatagaggaccgaagattagtcatataaaacaggggtctttttttctttagggagattactattacaatgtcgcaacaggattcacagcgctggctgcccacggatcggctaatatatggtgtgctagtcaaatctttccttcccttacaaaggtatcctgagctggtatatgaaaacagcaattatgcgaacgtttatgtgggtgcagaagtttacgtcttcgaagaatctgtggataagaaatggtgtagagcgtaccaatgtttacgaccctttcctgaagaattcatatcgaatatgaactcggcgaatgatgtactgccagacgtgaaaccgaaagtagtgatatttcctagaaaatatgttcattttgaagcagaaaaagccgtcagcacaatgccatttttcaaagcacctagtgctgaggattttaaaccattgataagtaaagaatgtgagtcccgctccttttgtgacagcctatatgttagctctactgatgatatatcaactggtaaaccaagaaagacaccgagacctccgttcccctttttcagataccaaaagaggtcctttaaggacgaaatgggtcctatattatctcttatttcctcgcatgtttactctatgtattcaattggcgagttttctatatataggaaaatgataaaactttattatgatttggacactatacgatttagattgtctatgaatttaaccacagaggctgagaaaataaatctgataagagcagcaacatccctaagaactaaaatcgcaaaatttttgtcctccacatacaggaagaataaactaattgctaactctactccaagaaacccagatccttatggtttcgaaggaatttttgccagggatattgatactggcgaattgctctcatacgagatcgacaaattaagaactttagtgtcatcgtcaatgctttgtggtttaactaataattttcctactgtacctgtggtagagtccgatgatgagtcctcatctaacggactattcggcacagttagatcgagcattttggttaacttgaaagatctggcatgggatccctctatatcagatcctaaatatcaagatctttctatttgtgtatacttgagaaccaaagacgaagttttaacagagtcttttaccatgacgaagtcgtccaatatggaatcagctctagatgaaattcctgcaatgttattcaagaatattttggaaacgatagtccataaaaataaagtatacttagtagtagtgctgaaggaaacaatagcaattacaacagaaactgctccggaaatttcatcttacaatatatctaccgaagagtcaagttcacattccccattttctccatttaattcatcgactgagaataagattgaccacgtaaaaaagggcttagctgccggagttattaacatatctccggtattcaagttttataacggcctatcagttgcgaataaagctcagaggtttaacctttatctttatagctccgattcctcggattcgcaaaacttcaactcttcaaaggatgcggatttaggttggggcgggttaataaataagataataaaagattcttctgaaggcgtttctgtgaaccctagggctgtttctttatcggtaactgtaaaggaaattataggcaaacaagaggcggaaaaagtgctctccacatctttagtaccgataagatctattcccacatacttttatgataccatgtttagccaagcagaaagaatttatctgaacttaggtagggtgtcgctttatggacttcctgcagctgatacaaatatagaaaatgttaccgttcaaatatcctgcaggaataaggccgtaaaattttgcaaaaataagctcgaagagagatctggggactggaagtttgtttcagttcgtccaaatgagagcataggcgaatcgattagaatagaaggggtagagaacatgaacgaagacgagacattaagagtattggtatatttgaatggatttttgatggcaaaatcaaatatacatatcaagaaaaagaacgaaatcatagaatatagaaagggtaccgtattccaaataatgtcatccaaatcagtacctctaattcatttagagcttgaagcatcatattttggtcggagatataatatcaaccctgccattacaaatttcttagttcttcaaaccaaaaatgttgaattcgaccagcaacttaaagagcactattcagttacattgaagcagctgaataacgtttcttttaaagatttactaaagcattttgacacaattttagcacactatttgttacttcttgaatcggtgaatgaagctactgataaaaaaggcccttcttcaagtttacccaatattgtattcagtgaattcgtcaagtttttaaatttaatgttaacacaccaagaaaactctagatattggtttaatagactgtacaaaaaagtcatgtcaaaggaactagaatgtcccaatgttgcaccgatactaataaaacatatgacaacgatctttgataggagtcattcttcttggactagaacaggaactgcaatctgccgaaccatcctgtacataattgtgttggcaatcggttcgtctcattctgatgaaatgcctaatttcagtcattttttcagaagcttgcacaaatttttaatgcttgctgatgagccaataatggcggatcaaattttgttaatagaaagtattccctctatgctggagacaatgaccaatcactgtaaggtggaagacttagttcgttttgcgatcggactgtttgaatgttgccaggaaaaagaaatgaatcaaaaaatgtactccaggccactctcagttcgagaagaagaatatttgaatacaaagtttaattgcctgttgaagttaattaacaagaaggttttgcaaaattatttaaccaatacggaatccgtagataaactgaggttacagtttttatctaaaacccttgagtggttacttacgccgtatactccaggcgatgacaaatgttttcacgtagaatccttacgcttggttaattctgttttcattacaataatcgaagattacaaatttgacatgctacaaaggaacttgataaggttactaccatatttgtgtaagtccttcgtccatttaagaaggtactgtaagaaagcacgtttaatgaggcctcgaagagtttttaccatgctttttcccagagaaattccatgcaactacataccggttgattcaatagtgaatgatgaagtagtcgtagaagttcttctagagcttgccatcataatttgtgaaataacgaaaattgcatcaagcagatttccatcatatcaatctttcagcgaaatcataaacttgtgcgataaagacactctttttcaatcaaatttttattcacgacaaatcacgaatgaaaatgtctatacaataaccaaaacagtttttttgttttttaaacaagattggttcccaggaatgaagtggcttggcgtatcagcgttattaggaagatcgtctctaatattgcttagtttatgcaaggattatatcatagaaaataattcaccttctccatcaaaggagtctgaaaagagggttgacatgcgactttgggcagaatatgtaaaagtcatactactagtttcaaaccataaaagtgcatccttgactaagttagctattactccacgtaaggccgtttatttgatatcgggtgacctgaaaaaaatttcagcatatatcctaaatgaatgttgggatgccctagccactgggcactataatatcacttatgctaaaaagtatggattaggagccttgagtgattgccaatttgaattgtttgttcataatcaatttttgatacgtgagatctttatttttgctttccatagacatatcgatgcaacaagaatttgttgcaaaatactatggggattagggctaaatttttggaggatatttgggtccctacaaccagcagtgaacgcatgtatcccagaattattcagcgcataccaaatcgggaagcttcgtttgaatgattacgaattggaaaggtttgtttcttgtttgttttttatgatgcacgttcccgattctgacaccttttttcctgcttgtatggatttcttaagagatttacttggttttttgcatattgtaaatgaaatctacaaaatacctaatcaagaagaatttgatgatgatcggactgctcggcacatagagatgttcgagtacttgctagaagcaaacaggccagagttgtttcataaaatgatatatgatttgtttatccactttattcagaaaaaagactttgttcaagcagctttgagtctagaactcttggcaggtacgtacgcttgggattctaatgatactcttgaagcaatatctttcccgccattgccagagcaatcttcatttgagaggaaggaatatcttcttaaggaatccgcaagaaacttttcgagaggccaaaaaccagaaaaagctttagcggtatacaaggacttgataaaagcctacgatgagatcaattatgatttaaacgggctggcctttgtacatgaccaaatagcaggcatttataccagattacagtccattgatagactggttccaacgtattttaaagtttctttcatgggatttggttttccaaaatcattaagaaataaatcgttcgtctttgagggtctcccatttgaacacattacgtctatgcatgacaggcttctacgaagctatcatgggtcaaatattgtacactcacaagaagaagtggatatgttattgatgaatcctccaatgggaaaatacattcatgtagcttccgtcgaaccgtgcttaagtatatccgataattacaacagtagtgacaagaaaagctcaattaacaacaaagtgcggatgtacattgagaatagagatttgaggactttcagtaattctcgacgtttgccaggcgcaaaaggagtcactgacctgtgggtggaggaatatacgtatcatactatgaatacttttccaacactaatgaatagatcagaaattgtaaaggttacgaagagcaaactttctccacttgaaaatgcaattcgttccttacaagttaaaatacaggagttatatgggcttgaaaacatgtgcaataaaactctgaaggaccacggtgatgtgaacgatttatttaccgagctttctacaaatattacgggaacaatatcagctccagttaatggaggcatatcacagtacaaggcctttttagaaccctccacatccaagcagttcagtactgatgatttaggaagattgacgctagcttttgatgagcttgttgcagtattaggtcgctgtctaacgttgcatgcagaactactaccatcaaaggatctaaaaccatcacatgatcttctagtgcgtctttttgaggaaaatttcgctgaggagatagaaagatatagtcgtactctcagtgaggccaatcgtagcaggaataacatgattactgctcgaataatttcgcacaagaaccccaataaaaaggcaagcttttctggaagggatcatcacacctcagggtccaatcatagccaatttgtattagaacatagcgactcatttggcccaaacagtttactttttggaaaatatttaacaagaacgttatcccactcgtccactacgagcagtttggataaaagtggaattgtttccggcacttcgagcacctttttggcagggtcacagccaaacaccaacacagattcacagcacaagcatgattactcacattcgggataatatgtcagaagttgttcactataaaatatacgcatatgtaatcatttatttattcattcatgacttttagttgaaaagggcacatttttctttgtcgtaaaagtgaagaagacagcgaattttttcctttctccttcaagtattgcttttttgataaagtatttttcgaaatattgatacaattattgaatctttgtaccgtatcctttttttccttttttctaaggattcttcacgttgtaatttaaagtgtacagggaagaaaaatcgtcaattttaccgggccagattgtctcaggaagataagttccattttccgctataaaattctgacgttcttcctggtcctgagcatctaaattctgcaactgcttttcacaatctttcaatatagttttcattctgtttgccacatcctttctcctctttgcttctagaactaagttaccgtagctttcttcaaaattatcataaaattcacaaagttccttagttgtttgaatatcttgtgtacaggaatttttgaagctatcaatcagattggaaatatctttaaagattaatagatattccaaatttctattgaaatcgtttattatttcagaaacttcgctgtgtagttctgtcttttcctttatttttgcctgcaaaaattgacccaagttaagaattgttttgtccacgtcatcaattacctcatgcagagttttgaaaatgttgtatagttctttgtcgtcgccttgtaccaccttaaacagctcctcacgttcatcgttatcaatttttttatcttgtaacagcaatgtcttatcaaagtgctgtgtcaatgaattcattatctctgctaaatctttttcaaggtccgttagttccctgctaaactgctctgcaacatttgtttccatcaggttatctataccaaatttactttggaatttttgagttacgtccgtcaacttggtatcaatcagttctttgttaacttttctgaccatattttcgtattgaagcttaatgttttcaatttgacgctcaattactggcacttctttcagtttgtcattcaataagttaacgttgtctctcgagatgtaatctcctagtttagagggatcggtatcatctttttctgatatgctcaattcatttactataccatccaacctttgtactttagaagtgatttcatattgccagtacttcatctcatcaactaagaccactaagacagcttgattccattgtttctggattagctttgtcccaatgccttcctttaaaatagtgtaaagaaactttccttgctgtctcaagccaactattagaaaattgagttttgaaatactcaactgccaagatgacaattttttcttaatatctacaatccttaaattagcacttgaacataaaagttgagcatcggtcagcgttttcctggcattattaacaaattttgtaacatctgcttcgttcataggtgttaaatacgttgataatatcctcgcagtatcgaatttatcgtacgttatgcgactttcaaataattatcaagttagggatatcttgcaatttttaatactgaggccttagagcgcgcatctagtatttacattatgtcaaaacaataacaaaaatccaaaatttcgaaatagtacaaccgagagaggtcgaagaacttaagccttcagtacgccaaaacatggaggattcggactccaacacagataaaaagttctttttcaaaaaaagaagaatcgattcctataattatagcgatgaggaagataataattcaagcatgaatagtgacatgacatacactaatgatgccttgaaaactagtagcggcaatgccccaacgatctcaaaattaacgaagacatatggtattggtgcgaagttactttcgagtatgggatatgttgcgggaaaaggccttgggaaggatggttctggtataactacaccaatagaaacccaaagccgacctatgcacaatgcaggtctaggaatgttttcaaataccaactccagtaactatcacagtgaaaatgaggattacttgagctctgaggatgaggtggttgaaggtatagaacaagtcaaattcaataaaacctccacggaggttttaggcgaagcgttgttaaatgatagtggtgatatgactatagtgcgaacactgagagaattgaggttagcaggggtacaattaccagagagtatcctaaaagaattagaccctttaaatgcagtaccaaagccgaaaaaagatgttgttgtggagatattgcaagagctgctgggtattgaaaaaagtttggaagctattcgtcagcgcacctctccgttagaagtgcaagtcaaagaatattatggacaagagaggcttctttctgaattggaggttactttgagggacgaaagcaagcatgtttccctgtatgataagattggtgctattttaaaattgtccgacgacgagctcatagataggctaacgtcctgcttattgagaaaagaattactaatagaatttgatttggatcatttagaaaagccaaacgatatacttgatgagttaacgcaaattatagaactactcgcatatagaatggatacaacttcgaaatttttgaacaggacacaaacaacaatctttaaagttatatatcccaaactcaaaaaattttgggaagggtttgatatgactaaatcaaaaatcgacagcgctatcaccctattactggatttccaacaagtgctaagttttatcgggtgtaaagagcatatcatggaggaattcgtctatccaaagctattacaggaattagataattgggaacttcacgatgaagtagaccatgtttcgccaagaatatgggtcttggattttatggttttaattgacgataagatcaaagacacaattgtggacaagattgaagcaaaattttttgcttattgtaaaaattggtaccatagggaatcattttgtatcactaattctgatattatatttatcaaagaacttatctgcgaacgaagatattacaaaattttatgtaaagagtttcttcctaaattcctggacgagctgtgggaaagacataatgaccccatctacgagttagaggattggaaggaaaaacaggaatggaaagaaaaagattctggatttttctattttatgaaaaaactgagaagttatacccattattttcatccaaaacagtatgaattgatgatgcggggaacctttaataatataaacaaaatactctatcaatggcatctttatagtacagtggaagacttacacaagtcaaagtggtggcttaattggctgatgaatacggtatttgagcactctttaccaacagaaatagaactatcggagatcagaaaaagctataatatattcgctatgtctcataggtaccaccttgataaatctacattagatgaagatttcgatttgagacagggtttacgaaacttaatggaaacacaagtgatcgacgatattagtcaaagcgaacaagaacctacctatactgtacaaaatattccgcttggaaaagttagcagctctttcaaggatgtggtagaagactactgcctggaaaaagggtacttgatcagcaaaataccaaataggtacactcaactgccatatggaagagaccaagattgtatagttcctttatttgagatccgaaacgggaagaaaaaaatggaagttgctttgaaacatgatattctttgggtggaggattccagtgggacctttaagccaatttatttatgggcccttgacctctagaaagtacctataaaagaggtgagataggcacgatttatatattattgtcgaaaaacaaaattgattagattactaaataaataataattgcattaccatttttagacaatggattaatttaaagtggagtctattaattccccttatttgatagttgttggtattttgcccttgaaatgtttccaaaatttattgtttaaacttttatacttcgctagactctcgtagttagactgttaagagttgtggcagaaggaaacgagtttcggatgggatcaaaggaccttttttatatcaagatcaaatggagctgttattttccaagaaagacagaagaaagcccgaatgtggctaagtagtgagcctaatcaagtagtcagcttcacttgatattagtttatacgattactattttaatggagtttttagctcactaaataatttaatgcaaaaaaaataaacgaccccagtgagggttgaactcacgatcttgcgattaacagtcgcacgccttaaccaacttggccatggagtcttttatttccgatatctgctgagttaaaaattatataatattattgatagcttctatcattgaccttcaattacttatgttggaatatcaaaaatgtgagattttttttttcaaatagttttgaagaatcagcgaataatttgatactttttgggattcttgttagtaacggctattgttggagttaaacttctttaaatttgtagagtatgtggattttgatgtaattgttgggattccattgtgattaaggctataatattaggtatgtagatatactagaagttctcctcgaggatttaggaatccataaaagggaatctgcaattctacacaattctataaatattattatcatcattttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacataccacccataatgtaatagatctaatgaatccatttgttagttaatagtttaaatgtttttatcggaagaggttttgtcatcacatcagcaatgttcttcttggtctcgatgtagtatacgtataaattattacctgatacttcatctctaagtctcattgcctttgtgccaaaaaatctgtttctaaatttctcttcatttatttctagttcatcctggtctatataatgacctggttgacctggagctctaagtttctttccttttgggttcaaaggtacgtttagtttgggtaatttttctgtcaaggatttttccatacctaatttcatgtacttgcttctttgatatttgatctctaatccaagtatgtcgtactgaatttcgttatcaccttcacccagatttattatctttgtatcgtattgtttcttgagtgttgttatgattttcttatttgcatttaagtctttgctgaataatatcatatcatcaacgaataagcaaattgttacttgactattcttaaatacgcatgaccatccgcgaacttcttgcatgtcgcaacaatttattaaatatgatttaatggtttcataccagtttgcaccactttgtttcaaaccatagagtgattttctcaaacgtagtaacttatcattcaaacctaaatgtggtggaggtcttatgtataattcttctttgatatcagcatataagtaagcagaggatatgtccagctgtgtgatataatagtcattgtctaatgcgattgacaatgacgtcatcagtgcatagtgatgtacggtattggattgcatatcagaatcatatgtatcggggtgttgaatgtcgcttcttgcaacaaatctagctttgtgtgtaccatcacgtttcttgttaaatataaacattgagtttattacttttttaggatctatgtcatttctatcataatatttgtttgtatcccaagtgttcattttcaatagttggctaatttctttatgataagcttcaacatatctgtctttttctttgttgtctttattatatgtaattgcttcatcatatcttaaggtcgttcgaactggtttgatcgatttcactccttttattgctgcaattaaatttatgcgtttcttcgatcttggtggttccagacttctcatattcttattattccatgtgtctcgggatacctcaatttcagtttcattatcttctaatgatcttttcttacttttggtagtagtcagaacattagaatcatccataccacccaaactggaattagtctgacgagagtgtatgtgtggaatatcttttgaaacatcagaagtgtccgtaggagatttatgggttaagtcaggaagtgggaggtcgtcaagaatagaatcagccgtaacattttttgaggatttgtcaggcattatattaggagtcgcatggtcagaagatcgatattctggcggatccgtatcaatggagggtgtattatcacatacagcctttgtttctatggagatgatgggagtagtggattcactgttggacgaacggtcatctattgagggcgtactatttgtagtcctgtatttgatatttgtatcactatttcgttgaatatatggttcctccgtaccacccaaacgtgtagttttgatgttttcaagtccataattaactctatcctgtgaggtcaaatcaatcatctcattggtactaccaggtcggttttggtttcgtgcagtgaaggtagacgagtgtctaggtgaagtagtatctgattcaacggtaccacccatttcggtactctctttattaatgatatggggtgtacgagatcgtatagtagatggaagaatattgtattcagatatgtcggcatcaacttcttttggtgcacgtactttttggactggttccttgtctaattgtaaagggtttattgattgggacgagaagtcgttcactagaggatcagagtttatttcaatctccgattgatagtcatgatcagattctttattttgatcatatgactgctctgtttcattttgttcaataaaagattggttatgggctgttaaacgattgagatcatcatcaaaagtgagtgtatcgtagtcgaactggtccaatttcgtttgcttgttttgtaatataacgtaattggtagtatctactgtcttttttaaggatggaagatagataatatagccataagagtttcgtgatggatgtaaggcgtaacctggaatgccacgaggatgtattttcgagtcgggattatggttgttaactataaccggttgaccgaaaggtagtatagtagtaatgtccagtccagctaaacctgcatgttgtcttgcagatttatcgttttttggtgagactaatgaatttctgattatagtagaaaattcgactgctgagaaccatagatgatttggtagaccactgcaatgaagcagtgtgcgacaatcgtttaataaagtacgatttaatcgttcagcgacaccgtgtgctctagaatctgccgtggttgtatagcatgcagtaatacctctgttcgtaaagaacttatgaagagttttgttagtgtactcggagccacgatccatctggataactagaacgcgagcattgaattggttcttaataaatgctaatatcgatgtaaaaacattgaggatagattcttcacgacggtcgtgtaatgggtacacccattggaatctggttttctcatctgtaaacgatataaagtaagaaggtgcacttttcggtaagtgatgtacaggaccaaatatatcggtatgcaagtactgaaaaggctcatatgattcttggtactttagtcgtgatcctttgacatgcctatgtttcgtgcttttgccgattagacagtcaggacattgatatgtgctagcgttagaccattcaatatccgattctttcaaatatgtaactgcattcttcttaagagacttctgaatacttcggaagttagcatgtccaagcattcgatgtattaacggatatggatatttatttacgcttttgcttttgttgacgttgtttattgttagctttgaaatgtgcgaaggaattaggtattttttagataaccagtaaaagtctccatgtttgactatgggagctagtactgtaccatccgatctttctaaagtgtttctggtaaagcaggcagtaatattttggttagccagctcactcaaacttaatagatcataggctatgtttggtgtgtgtagtgcttttattgatgttttggtgccgttctgaaagttgaagtgaagattaccaatggcatttataggaatgtcttgtttttgagcatcgactatgtttatttcagaattgggtgttgcatggtgtaaataatgggctgatctgacaagcgtttgcgaagctcctgaatcaataagaaggtgatcaggtagttcgtcattcgagtctattgtgcgtgttggcttagattctttctgttgctggcctaagactaagttcgttgtcatcgcttaagtattgtgatgaaacggttgattcattaatgtgatcattgttcacccttgagaatttactggatgtagcaatattgtgagcttttgctgctcttggttttgaactatttgttctatgataattacgagttgtaaccttcgtgttagtcgtgtttggagatgtgcgagaaacatttttgtattcgctgtgttgtttgtattgggacggtttatttagattcatgattttattttcgtcatatattaattgaatttcagcgaataattgggaaagtttcatgttcgttttggtacgatattgattacgtaggtatttgaaatcaccggatagacctttaagtattagttgacaggccaatctgtcgctaacattgatattgttttcttttagcctttgaatgatcgtgctgactgtaatttcaaatgtatcagcagatgtacttccgttgtactcaaggttggcaagagctatccaatcttttaattcttgattgttagtttgcattttggacacacttttacaaaggacagtaaggatgtcagaataattaatttctaaaatttgttttacccatgttggcaataaatgaaatggggcaaatgcttggaaggtattgtatatatacgcatgttcttcataagtcatttgtcttttgatttcaccctggtcatttggaataatgtcaccgagattagagttcttcaaaaatctgatgtaaaatttaacccatgtagaaaagttttcttctgatgttaaagtgtgtggtggtaagacattatttctcacctttgtcttagcttgaggtacttcagagtgttgatcctgtgaatcgattggatcaggtgaggaagtactcagcggtgggatatactgtggcagcggatagtgtgggtccggttgataatacgcaggtgacgtttgataatgtgaacacgtcatcatagatggttgttggtaatgtgcccagttagaagccatagctttgtttggggtcatcatgccgtgctgttggtactgtccattctgtggaggtggtactgaagcaggttgaggagagacatgatgatggttctctggaacagctgatgtcccaggtgttgtctcttcttgagaattaaccttagtggaatctctatcaaattccggtaaattggaagctgaaacggctaacggatcttgatttgatgggacttccttagaagtaaccgaagcataggcgctaccatgtagagaatgtggattttgatgtaattgttgggattccattgtgattaaggctataatattaggtatgtagatatactagaagttctcctcaaggatttaggaatccataaaagggaatctgcaattctacacaattctataaatattattatcatcgttttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacaggttcacacgaagattgaaagtgtggccacgctaatttagtttattagggaaatgctcctggtcagttctaattcacccaacgtagcgcggaatattttaaagttaatatagtatttcgatatgacaagcacctctaaacaaaaggttattttcgcttttgttcattgagcgtgtacttcaagcctgatcctgctttttcttctgatttgatctgattcgattaagcaagcggtactaccctaaaaccgccatctgttgtaatatagtaacgtcgcaataaacctgtcatataattagcagctaatccttatattccatctcctcaatttgtgatatttatcgtatataattcccatttcagaccgtcatttagtagtaggcatctaactatggaacggctttacccgatcttggtatgtatgccataatgtactaccgctatcgatttaccttaaccctaacgagtgtctctagccagtattttaaacttccatatcacaactaatgttgaagattgtataataaaaacatcaagctatttaatagatgcgattaatctcctaatcgaaaacagtttgttcggtgtccaaatactgttttagtggactatgataaacgttataacagctattttgactaaaacaaccgtaaatttacacagataggtgttcacagtaattttttggggagttaggtcgaaatcttttccaaaaccagtcatgcaaaggaaatgcgtcaacttttggggacttttcccctactcaaacacagttagtcaacatttaaaggttgtgtctttacttaagagaaaattaactgagcttcggtcatacatacgtaatttcgctgcttccagtcgagcagttggtgcgctataatcatttgatgtttttagcttacggcttcttaagattttctattgttcatactgactcgtcgcataggccgcaatataaatcatttagagaaaacgttaacacatcgtttaggtaaacaacccctagagaggatgatcagtacgcaatataactgttcaaaatccatttcttgcatcaatattttattcaactattatttctggaggttttagtggttctgtataccccctccagccactgttatgaacaattaattgatactacttcgaatataaacattaaaacaaaaaacttattgagtgcagcaagttaacatgtatcgatataatagaagttccccttttgaacgaacaccagaaaaacgagtaagccgtcaagaaagccaacgaaagagcatcgaattgcccaaactgccaccattgaatacgaggaactcctttttggatgattctgataacggaacagataatatctcaattggctggacaccaatcagtgacacccagcaattccaaagcccggtccctcaggcttttacctttacatcaaaacatagtgcaaggggaaacggtactagctcttcagaatccacacccaaatcgacaaagtacgtcaaagaaagacgaccaccaccaccgccaccccttttgtattccactgaatcaatacggatagactcacccatggtatctcccagttctcagtcccgggaaagatcacctaataaactatcctttataggaaactcagaggaacgacatcacatggaatacatatctaaccattccaggatcttaaaatcaccatttgcgaacggatttagtccaaattcccctaaatctccaagagatagtagcaaacagcaggctcacttctctgatgaatcagatctacggtgtcatgaaagagaaaaagctttacccccaattcctttcactactactcttctgctatctccttttgatgatgaagactcagaattttttacgaaaccaccaccgcctctatcaacatctagaaacgtaagtgggaatagccgagtatcagaagccctagaaagtgtttattctgactcagattatacttttaataactcaaatgccaggcaaagtagttttaactctttactaggagccaagccattagaattagcaccaagcattactgcaccgacacaaccattttcaattcaatctatcgatgagcacaagctttatcaatgtgataatgtttacaaactttctgctatttatgagtggattttgaaagtttattttgaatggtttaatgaatgtgtcttcacgaaaatcgatcttttccaaattgttcaattacttttagagtttcaaatgcctacaaatttcgatcaagatacgatagactcaaatgtggataatattatggcttcgtttatttcccagaaagcagtaagattcgatatcattaacgatgaagaggtagccgtagttgtgggagggctggatattactggtgttttcaccgaactactaccgtgctattcattcatcgataatacttatggatctacaaactccctgatttgttattccaacgtttgcacacatggccaaagctctggcttcagaaaagaaataaaactttccgaaatcataaataaatcagttggactttggacagaatactggcacttgactccagatgatttagcagaaattaatccccgtgaagtacaaagacaaagctttatatttgacttaattattttagaagaaagatccttaaacatggctactgccgcggtagaaatctatgggaaacggtttgacaaatccctacttccagatgagcctgagttcaaggcattggcatttgatatcttcgaacctctaatacaattacataccgaatttcttttgacgccaatattttggaaattaaaaacgagaggtaagtttattgatggcgttggaaaaatctattcaaaatggtgtggtgaagccaagaatatatatttgaattacgcgaaagctatggcaacggtacacgaaatcataatgtgggagaagaaaaacaagacgaaatttgtaacatggcttaaggagattgataactcggttgaaattacaagatcgaagatgtatcatgatgttatattctttggggggtttttcaaatctttacaaaacatgcccgtaactctgcgctcaattttgaagaacacggatccttccatggaggattatgaatacctgaaaatagtaattaaggaagtagaaaagttgaactttgaagttaatcaggtacatggattagcaattgaccataggaaactagtaaggttttcgaaacaattagtattaagtactaatagtagtaatgcaacaagctatgtgaacgtcggtggtagtactaacgcaaatgacgatgatgcaattcaggataaactagctcttggtttaacttatccggaaaggaagttagtactatctggcactgtttataaaaagagggatttatggctggacccaaccccagtgtatatcgcattattggacaattgcttactgattacagaggaaataagtaaaggagaaactcaaaaatataagcttattgaaagacctatcccaatagattatttaagtctcgagaaaaggaaaattccaggaacaagtaaacagcctctgagaaactactctcagaaagaacataaatccccaatgcataatttttcgacaccgattaactccatgagacctctgcttaaaagttctggaaatcacatgtcaacagcgtatggagatagaaagactagtaatactgaaatttctaacgcgaatccaaacacagacgagttctcatttaagatcagaaatacagccacaggtgaatcgttcaaattttttacagaaagtgcagaagtactcaaccaatggattgatgctatcatggaatcttttaaaagaaatgcagaaaatcatgatttaaatgcctttgaatttacagtgttgagctctgagttcgcatacttcgacaaggatgcaccggtgaatctacctgtagctccggaaggatcagaaattgatgtagcactcaaagcttacgctcaaaaagcaaacaaagattcatgttcatggagtaagacaacacggattctttgttgtgaagatgttaaattcgagggcagaatttacctatttgtggctacaacagacggtatctatgtgaaatatagagacgattatggtagtggtttcgttaaaatattagaattaaacgacgtcaaaagaatggaagccaatgttaagttggggctcttgtttgtattggataacagaaagttgtgctattttaatatctcaacggtagtgagccgttacctagcgcaaggaaacactctagatgaaaactgcattgtgggaacagtaatcagagataaggtgagattcttcaaaattgctgatgattttggtaactcaaaacatttattttttgaaagaaaggggaagatagttatattaacaccagaatttgatcaattgacaaaccaagtaaaatatttcaaattttacaaagagtataagctcccaagttcaagtaataacattctgaataacgaaattgaggatattgccatattcaggaaaagttttgctgtgtgtacaaagaaaacagtcatactttatcaagattcattcgaggataacggaatagtcttaccatcttttttgaatgataaagatatgatggcacacttgaggcatccacatttgaatagcttaccgttcaaaagtgctacagactccaagaaacgcccctccatagaatctctcactgaagaagcaaaaaaggatatcgccacttgcaaagctataccggtcaatttttttcaaatatcacaatctagtttttttgccttggtttatgatgaagccgtagtgaaaataaactgctacggtgagatgtctgattggagaaaggatattctcttacttgatttttgttgtaccggcgcgagcttccatggtaatcatttgattctcgttggcgacaatttgatacagatttacgacttaaaaaatgttgagcagaacctaggcgaattggttcccgtccagatcataaaaggaaagaagataaagctggctagttcagaaaggagagagaaaacaattcttgtgttaagtcatccaaatatacttaatagacaattattagtcgcgtgcaatcctgtagcaatggcagatcatcaataatataagatatagacacttttaatggtaaatatcgttgtaataatataagccaacaagaatatagtccagtaattatgctatttgcagtaactcacatcattattctctctgttcatataatcctgaataacaggttaccctcggaagtgcatttagccgtataacaagtagctctttaaaatcagtagaacagatacattaatatgtgataatacggctgtgaggaaaaggtgaagttctggtgatgaatatagactgtttgtgtcgttgggtagttctgccactgctgcgctatccacttctggtagctcttgtattgagatggtatgtaaagtagaaaataggcatgaggttagaaacagcgttttttatactaacatgacgaactaacctaggtctctaagcgactcgataagcatttgtctaacaatctatacactactgataaatgcattcctcattgctaattcctatataaagcggtcgggacaggtcgcctggaagagccttcgtgaatttaagaatggcatagttcttattactggaggaagtaaaggacttggacgggccatagtatctcaactcctacaagactacagcaacctgaccatcttgaatgtcgacatatgcccatcatcagtgaggaatactcgcgtgaaggatctcatctgcgacctgagtgatgatgaagaagttgcagcactactgaatttgttgaaaagaaagtataaaaatgaaatccgattgattgtgaacaatgctggagtaagggccaacttcaccggattcaacggcatggaacgggataatcttgataagatttttaagataaacacatttgcaccacttcagttcattcaagaactggcccctagtagacactcaactagacagtgttatattgtcaatatcgcaagcattttgggcatattgacgccggccaaagtagcagcttatgcggcgagcaaagcagcattgatagcctttcatcagtcgtacagttttgaattgcaaaacgaaggcgtaagaaatatcagaacactattagtgaccccagggcaactgaatacggaaatgtttgcaggattcaagcctcctcgccagttctttgcccctgtaatagacattactactctagctgccaagatagtccgttattgtgagctgggtcagaggggacagctaaatgaacccttttattgtagttttgctcatcttttgatgtgcgtaccttattcgctacaacgcattgtaagaagcttctctcgcatagattgctgcctcccggacgagtagaaagctatacatagtaaatagaatatttatagatgaatccgagtagacagccttggtgtttgcttatacattctttgcaattatgcacgccctcattaccgttgctcatatttttgggcattaattgtattttgaaaagtgctcgttcaggcccgtgtaaaaaaaggtgatgaagcaaacattataataaacacttctgagaagccacgtgtagaggggtaagctatatcgtaaacaccgttggatgtggaccacggtgcactgataaaataaagatatagtagtagaatctgttactaatcttaacacttttgatggtagaaccggacatgcagaagaaggcaagtggtggcagtggcggttccgagatggatactttaaatgctaccagcaacagtagtaaacaaggagtttcaaataataaaaggaatccggtcagtaaaaagaaaccagggaataaggtctctgatggaagagataatgcacataattatcacggggaaggccgcagaaaaagtagcaaacaacagaggtcaagaacgccctataaggagactagtactaggatcaatgatcaagatatagatttatctatccaggaagaaattcttggtggtaatttcaaattacgaggcaggaaaactcaagtttccattaatcatttgttgaatttccagttacctgaagtcgaaagggaaaaaagtaggtcctcttcaagtaagaaatcgaataggagacgcgatgagcacgtacatttacacggtgacacatttgttaatgttaattaccgtcttttggtagatgatcgttttgactacccagagcaaaactgtaacccgaacgttcctgtcgatcaagaaaagattctaagagtcatagtgccaaagggtcagaattgttctatttgtctgagcgaggaaccggtggctcccagaatggttacttgtggccatattttctgtctaagttgtctcttgaactttttctccattgaagaaaccgtcaaaaataaagagactgggtactcaaagaagaagaaatataaagaatgcccgctttgtggaagtattattggccctaaaagggtcaagcctgttctgtatgaggacgactttgatgtaaccaggttaaatcaaaaacccgaacctggtgccacagtacatctacaactgatgtgtaaaccacacggttcactattacctttgccagtagccttacatttagaccctctaaaatgtggaaatttccctcccgcaaacttaggatcaataaagcattatgcgcatattatgaagtgtggcgtgtcttactccttggagctctatcaaaaggacattgttgctattcaggaacaatatgaaatcgacaaggccatttataatgatagtggaaaatttgttaagcagtcgattgaaaatatcaatgatcaaatttcgacgttgctggctgcaaccactgatttgagcccactttccaacgatattaacaacggtttggacaattttcattttgatgacgatctcttgaccaaatacgatgattcttccgcttattttttctaccagacgttggtggcatcgtccacgaaatacttcttatctccactggatgtaaaaatcttattgactattttccactattattccaagtttccagaaagcatcgagacgacagtcgaaaatatacattatgatacagtggtaacggagcaattaatccgccgctacaagtacatcggccaccttccaatcggcactgagattgcccttttagacttggactggcgtaaaataccattccttcccaaggaaatttacgaacagtttgctcatgagctaaaacaacgtcgaagaaaattcacaatgaaaaagcaaaaggaagataaggaaaagaaactatatgaaaaaaggttggaacaagaacatgccgagttctacagaaaggaaaatggcaattctctcaagtttgaagactctgtacagatggctacccattatgaatccattgtaagctcttccatacctctcaactccttaggaatttctatgctgggtccaccgacaaattcctgctctactcctcaaaagcaagcgccctcccacacgaaaagaacaatttgggggacatcaattgcagtgacggaagacgaaaaagcatcaaaggagaacaaagaatttcaagatatgttattgcagcgaataaggcaggaagatagttcggatgtcacagattcgacggattctcctcctacaagtaatggtaagcgaggcaggaagaagaaaggtaaagtcatgctattcagcagcaatcatcaagccttgggttaggttacagcatgttctgcttaaaaatctctttccaagccagaaatgtgggaggacctattctatatcatttcaaaatcgaactctatatctttatgtataacttcaaacgctattgcatataaacaattactcatatatagtccaaatgcattcataccatgttatactattcaattctagtgtcgttgtgcgtgatttttcacttttgaccgtaaatagaatttcggtgatattattttaactctcgaagaaaataaagtagattcatgtacacgtatatcaaaagagtacagtgaaaaagggataaaggatacactccacttagaagggcgcaagatgagtggaaaatttgttcgtgcttctaaatatagacacgtctttggccaagcggccaaaaaggaactgcaatatgaaaaactcaaagtgaccaacaacgcatgggactccaacttgctaaaaacgaatggtaaatttattgcggtgaattggaatgcctctggaggtggtgcattcgctgtcattccgatcgaggaagtgggcaaggctccagatcaagtgcctttgttcagaggccacactgcgcaggtcttggataccgattttgatccgtttaatgaccacaggattgcttccggttccgatgattctaagattggtatttgggacataccggaaaactacaaatttcacgatcatgtagatgaagatggagagccaattgatatcaaaccagtaaagtttttgacaggacacgcaaggaaagttggacatgttctttatcatcccgtcgctgagaatgtattagcatcctcttcaggtgactatactgttaaattatggaatgtggaaactggaaaggacatgattactttgaaacatccagatatggtcacatccatgtcattttcgtatgatggtaattatcttgccacagtggctcgagataagaaactacgagtctggaatatcagagaagaaaaaattgttagcgaagggcctgcccatacgggtgcaaaaaaccaaagggtggtatggttaggaaactctgacagattggctactactggtttttcaaaattgagtgatcgtcaaatcggtatttgggatgccttcaacattgaaaagggagatttgggaggcttctacactgtcgaccaatcatcaggtattttgatgcccttttatgacgaagggaataagattctttacttggtggggaaaggtgatggtaatattcgatactacgaatttcaaaacgacgagctgtttgagttgtctgaattccaatccacagaagcacagagaggctttgctgtagcgcctaagcgaatggtgaacgtcaaagaaaacgaagtcttaaaaggtttcaagactgtcgttgatcagcgtatcgaaccggtatctttctttgttccaaggagatcagaggagttccaagaagatatctacccggatgcaccttccaataagccagctttaactgctgaagagtggttttctggcaagtctgttgaaggtccaattctcgttagtatgagatctatctatgacggttccgcaccaagctttcatgaggctaaaagacctcaacagccaacaactcaagaaacagctcttgaagagaaaaaggagcagcctaaagtggagaagccaatcagcgaatccgaaaaggaggtgaaacaagaagctccaaaatctccctcaccgctaaagtcggcctcctcatcttctacaatcaaccatgtattaaaggaagataattcgatcaacaagttgttgaagaaatcctccgatattgatcaagttaacaacgccgaagatccgtctagggatacctccggatgggaagaagccgatgatgagccagctcctatcaaaatcgaaaccccagtcactccaacagaaactaaaaaggatcgcacacctaaggtcgaaccttcaaaagaattgaagccagagccagtgtctatcgcaacagatagaaaacaggagcaaagcttacctcaagaagagaagtcctctgagaaaacaaagtcccctgagcaggaaaaatccgcaacacctccttcttcaattacggctgctaagacagccattactgccagcagtaaggaagagccatccgcggcaaggacatcacctaagtcattgggtttaaaaaagtctgtcgaaaaactatctacattggttctgcaattagaagatgtagttgataaattaacgaaagcaaatcttgacaaagatgagcgcctgttaaagttggaacaaaaaattggcgaactgtcaaaatgaaaattttttgtacttttaatgataaaattaagtgagtcctttttataggaaagatgtattttgattatatgtaatgtacataagacggcggcgataataatgcacttagaaagtgaatcatgttcacctgtccactaacaaaaaaggaaacaaaatgttgctttcccacaggaaaaagaatgtttttgacaaaacactaagcgttatgtgaccaatgtataattgtcctcatcatatagttttatgcaagcataaataagtctttcttttagttaaaacgcgttacatagtaaaggtaaccctgaatgaatttttatttatatttttcttcgcatattttaggatcttgaaaaattaaccacaagttagaagttgatgagatcaggaattctaacaaaaggtcattggttaggtttattttgtaggtgcacgtttgcaactttattccttttgtttcaaagttatagagctttcattttctcattcttctctagtgtaggtcatttctcctgcatattaacctactagaaaagtttacgaagcttcataggaacgaataatcgatcactttaaaggcttcccgcactttaatcttatcatctacacctacaaaaaagctctactttgtcatttattttctacttcatctctgtatggcatctatctctatatatataaaaaagcgcatctgtttattataaatgaattccaacaatcctgataataataatagcaacaacattaataataataataaggataaggatattgcccccaatagcgatgttcagctagctaccgtctataccaaggcaaagtcttacattcctcagattgaacaagtttatcaaggcacaaatccaaatattcaagaggcaaaattattaggggagttattacaagttctagcagaagttcccaagggtacgcatttattttgcgaccccatacttgaaccaatatcaattttttccctaaccattttctcattcaatgaagaagctacggccacatggctgaagaatcattttaatccaattctctctgtttgtgataaatgcattctaaattttgcgagagggaagtgcaaaatgttacaacattttgccattcaaagacatgtgccgcatgaacatgtagccaagtttaatgacatcgtatgccaatggagggtggaggctgtttttcctattcttagaaatatttccgttaacgataatacgggaattaacattacaaatgaaattgaaactgcaatgtacgagtgtctctgtaatccgcatatgttgaggcttaacaagcaacttaaggctactttcgaagcaatcttcaaatttttctacgacacaaagcatcgtttgttggacgttacgaatccattaagcataaaaacctttatatcaggtgtcatattttgctggtgtgaaggttcaaaagaggaaaatgagtggtcacgagcttttctaaaggatttatactcaagaaatttccatataaatctttctaacctgacaccggatattattgaggaagtttatatccatattttattcttacagaatccggcaaactggacagagattgtggtatctcaattctggtcgagattactaccggttttcaatttatttgataaagacgtcttcatagagtactttcaggtcccaaaaaatgtggaatctttaaaaaaaacattcaaatttccgttagagccaatttttaaaatgtggtacaatcacttaagcaaatcatatcatgataagccactagactttttgttaagaggattaacaatgttcttgaataaatttggctccgagttttggtccaaaattgaacccttcacattccatagcattttggatataattttcaatagagattcattcccaatcaaactaatcaaaattcaagacaatccaattgttgagcatcaaacagaagtttactttcaacttaccggttctgtaaccgatttactttcttggaccttaccattttatcatgcactgtcaccatccaaaagaattcaaatggttagaaaggtctcaatggcgttcctgcgtataatagccaattatccatccctaaaatccattcccaaagcttgtttaatgaattcagcaactgccttgttgagggctgtgttgactattaaggaaaatgaaagggcaatgctttataagaatgatgaatttgaaacagtactgttgactaaaacagattctagagctttgctcaacaatcctttgatccaagacataataattagatcagcttcgaatcctaacgacttttatcctgggctaggtgctgcttctgcatcggtggccacatccacgatgatggtattggcagaatgtatcgattttgatatactgttattatgtcatcgaacgtttaagctttattcaggtaaaccaattagcgaaattccaatttcaaccaacgtcttggaaaatgttacaaataaaattgacctgagatcttttcatgacggtccattgctggccaaacagctgctagtatctttaaaaaatattaatggtcttttgatagtaccgtcaaatactgccgtagctgaggcacacaacgcattgaatcagaagtttttgctgctatcaacgagattaatggaaaaatttgcggatattttgcccggtcaactgtctaaaatccttgcggatgaagatgcatcgcagggtttttggtcctgcatattctcctctgataaacacttgtatcaagcagctactaatattttatacaatacatttgacgttgagggtagactggaaggtatcttagcgattctgaatagtaatttgaccgttaacttgaagaatataaacgtgatgctacaaagattaatcaattgtgaattctatgagccttgcccccgtgctgttcgtgttttgatggacgtagtgagtgcatttgtagacccgatttctggtgtgtttgctaatttccaaactttgaagagccaaaataccgaaaaggaatttttaaaattctgggaatcatgttggttattcttggatacgatttataagtttactttgaaatgggcttctaaatatgactattctgaactggaaaatttcaccaaagatactttagatctaagtcgctctttggtggactcctttagagaattttcagatattcttcatgaccaaacgaaaaatttacttctcaacgttttagaaacctttaagaatatgttgtattggctgagattgagcgacgaagtacttttggaatcttgtgttagattaattataagcacgtctgatttagcacatgaaaagcatgtgaaagtggatgattccttggtagaaatgatggccaagtacgcctcgaaggcaaagagattttcaaataagttgacggagcaacaggcgagtgagattctacaaaaggctaaaatattcaataaagcactcacggaagaggtcgctacagaagctgaaaactacagaaaagaaaaggaattatcaagacttgggaaggtgatcgacttaacggattctgtgccggcgtcaccatccctctcgccctctctgtcttcaaccattgctagttcttctgctgaatccagggcagactatttacaaagaaaagctttatcttcttcaataactgggagaccaagagtagctcagcctaaaataacatcttttggtacgttccaatcatcagctaatgctaaactgcatcgtacaaaacctgttaagcctttatccaaaatggaattagctaggatgcaattattaaacaacagagttgttcatccacctagtgcgccagctttccatacaaagagtaggggtttgtctaacaaaaacgacgatagcagtagtgaggagagtgacaacgatatagaaagcgctcgggagctttttgctattgctaaggcaaaaggcaaaggaatacaaactgtcgatattaatggtaaggttgtcaagagacaaactgcggctgaattggctaaacaggagttagaacatatgagaaagagattaaatgttgatatgaaccctctatatgaaatcatattgcaatgggattacaccagaaatagtgaatatcctgatgatgagcctattggtaattattctgacgtaaaggatttcttcaactctcctgctgactaccaaaaagtcatgaagcctttactacttctagaatcttggcaaggtctatgttcttcacgtgatagagaggactataaacctttcagtattattgtaggaaatcgaactgctgtgtcagatttctatgatgtgtatgcctctgtcgctaaacaagtcatacaggattgtggtatttctgaatctgacttaattgtaatggcttatttacccgattttcgaccagacaaaaggttgtccagtgatgatttcaagaaagcacaacatacatgtttagcaaaggtgagaacattgaaaaataccaaaggtggtaatgttgatgtcacattacgaattcatagaaatcattctttcagtaaatttttgacactaagatcagagatatattgtgtgaaggttatgcaaatgacgactattgaaagagagtattcaacactggaagggctggaatactatgacttagttggccaaattctacaggctaaaccatcgcctcccgtaaatgtggatgcggcagaaattgaaacagttaagaaaagctataagctcaatacgtcgcaggctgaggccatcgttaattcggtatctaaagaaggtttttctttaattcagggtccacctggtacgggtaaaacaaagactatactgggtattattggttactttttgtctacaaagaatgcctcatcttcaaatgtcatcaaagtgccactagaaaagaactcatcgaatactgaacaactgttaaaaaagcaaaaaattctaatctgtgcccccagtaatgccgctgtggacgaaatctgcctcagactgaagagtggagtgtatgacaagcaggggcatcaatttaaacctcaattggtccgtgtaggtaggtcagacgttgtaaacgttgcaattaaggaccttactttagaagaacttgtggataaaaggataggtgaaaggaattacgaaatcagaacagatccggaactagaacgtaaatttaataatgctgtgactaaaagaagagaattgagaggaaaattagactctgagagtggtaatccagaaagtccaatgtcaaccgaagatatcagtaaattacaacttaagattagggagctaagtaaaataatcaatgaacttggccgtgatagggacgaaatgcgtgagaagaattccgtaaattataggaatagggatttggatagaaggaatgcacaggcccatatcttggcggttagtgacatcatatgttcgactttatctggttcagcccatgatgtactcgcaacaatgggtattaaatttgatacggtcattatagatgaagcatgtcaatgtaccgaactttcttcaattattcctctcaggtatggagggaagcgttgtattatggttggtgatcctaaccaactaccaccaactgttctttcaggtgcagcaagcaattttaaatacaatcagtcactgttcgttagaatggagaaaaatagctccccatacttgctggatgttcaataccgtatgcatccttccatcagtaaattcccctcttctgaattttatcagggacgactaaaagacggccctggtatggatatcttgaacaaaagaccctggcaccagcttgagccattagctccctacaaattttttgacatcattagtggtaggcaagaacaaaatgcgaagactatgtcttatacaaatatggaggaaatacgtgttgccattgagttagttgactaccttttcagaaaattcgataataaaattgatttcacgggaaaaatcggtataatttcaccttatagagagcaaatgcaaaaaatgcgtaaagagtttgcccgctattttggaggcatgatcaacaaatcaatcgatttcaatacaatcgacggtttccaaggtcaagaaaaagaaatcatcttgatatcgtgtgtccgtgccgatgatacgaaatctagtgtcggttttttaaaggactttcgtcgtatgaatgtggctctgactagagccaagacaagtatttgggttttgggacatcaaaggtctctggctaaaagcaagttatggagagatttgattgaagatgcaaaagatagaagttgtcttgcatatgcttgctcgggtttcctggatcccagaaataatagagctcaaagtattttaagaaagttcaatgtacccgtaccatcagagcaagaagatgattataagctacccatggaatatattacgcaaggccccgatgaggtaaaatccaataaggacacaaagaagagaagagttgtcgatgaaggtgaagaggcagataaagctgtaaagaaaaagaagaaagagaagaagaaggaaaagaaaaagtccaaggcagatgataagaaaaagaataacaagaaggcagaatcgcccagcacctcatctggtacaaagaaaaagtcatccatttttggtggaatgagtgtaccgagtgccgtagttcctaaaacttttcctgatgtggacagcaacaaaaaggcagcagcagttgttggtaaaaagaaaaataacaaacacgtttgtttttcggatgatgttagtttcataccaagaaatgacgaacctgaaattaaagtgaccagaagtttatcctctgtattgaaggaaaagcagttaggtttgaaggagacgagaacaatttctccgcctgaaatcagtaataatgaggatgatgatgacgaagatgattatacgccgtcaatctccgattcttcattaatgaaaagtgaagcaaatggtcgtaacaacagggtggcttctcataaccaaaatttcagcgctagtatatacgacgatccacaagtttcgcaagcaaagcagacgcaggtacctgctgctattacaaaacacagaagttcaaatagtgttttatccggtggttcttcgaggatcctgactgcttccgattacggtgaacccaatcaaaatggacagaatggagcaaataggaccctctctcaacatgtgggtaatgcgaatcaatactcaacggctcctgtgggtacaggcgaactgcatgaaactctgcccgcccatccgcaagacagctatcctgctgaggcagaagatccatatgatttaaacccccatccgcaaccacaatcttcagcattcaaaggacctggtagtgggcccacaggcacacgcaacagttcgagacggaatgcttcatctagcccatttatcccaaaaaaaagaaagcctagatcatgatcttgaagtaaaagtgttaggaattatacctgcatatatattggtgtatacatttatattgaatttaatagcaacattatttttcattatttttcattatttcagcaaaaagaacattttttttcaatttgacgtgaaagagtttgactattacgtgggcatacaatgtttaaatttacattatcctcatggctactctagctatttgcatttcattcaactttttttgatatggcatcatttttattagcgtttactacactttcagaaatgccaatctttggtggcgatttgctagcaaccaagaatgagggagtcgagggctgttttaaatttgaactcgcgttcgaccctttatggcttttgtgtatatcaattggtttagaaggtagtgcgcttgacccatcttgtgcagtggtactttcgctatggagttcttcacaagctttcgaaagtacgtccctttcgtttgatattaaagttgtcgtgagcttttcatcagaagagtcaagaaggttatttaggtactgtattgtagaattgatcatttctgacatttcatttggaggtattttggagttgctgctgctccgaagtttggttattaatttgctttccaaatctcctacttttttttgacaatctagccataattcacgttgcgttagtactgtagaagactcatttttatttctcattagttgctcttgtagatcttcaattttcagttctatgagatccttcatatgaacaaaatttttcatgttgatagtttgtctctcattgtaatcttcatccgcgctggacagccttaaattgaatatcttttctgatagtgatttttcctgtgtcaggggcgactcgaatcctattcttttcattaattgatgcttagattcctctatcttggacaaatgaaaatcaatattacccatttcggaacgtatccgtccagattgcctttttaactcctcttcaatgaatttattgtcctttttgaagtctcttaataaagtttccagccttattatttctgatttagcttgcttatgagataattgtaacagtttgtaattacgtatcatttgatccgcagaagattcagcgttctgtacttcctcgatcattgcatccgaatcatccgtattggatagtattgtattttctgcccccactgactcgatatatttgtttagtgatgtccggtggtgcgatgaaatggtaattatggcgtccttatcgataacatagtccgccggcgcagcatcggtttcttgcttaatatgccacgacttccgctctttccaaagaagctgctctctttcgttcagttctagtagctcttgtttgtctcgaagtaaggacccaatttctcttttcaatagaccatcatgggatactaagagatcattaattctgcatagatcgtttaagcaaatagtgatatccttccggatgcttgtcacctgggaagccgaatttacatcagacaacgctttttcgtgaagcccgaccagagtgcctaagtattgcagaatctgctcctttttttctaaaacctgattcagttccatatttacttcttcactttattttgttaccttatagaacaacgaggttaaaatgtggaacaagaaaacgaaaataatcacttgaactaaaacgtactctatccttcacttttccattccttagccggttctccaatagatatatacagacgttctctgtgttctattatttgtatatgatttacactataaaaagactatctataccttttgttaattgcgcacctaaacgccagagcttacgcccttaaattttttgaacatatgcgctgataccctacaagttgtcctagggctaggatatcgggaaaaaagagacaagggaacttgaaaaaccataattcccaatacataaacctgttacttgatggctaacaagatgtacttttttccagtgacccagtggcttctttaaccactattgtgttcatttctaactctggttaattacataaatattagccttcaaagccgcacacgtttctttttccgaaaaatgaaaaatttttcactgaaaaaaaaaaaaaaaaaaagaagaaatagaaaggtataaatagttgaataatttgcccttccgagatccaacaagatttttgagtgttgggacccttggaggtttactccagtttcgtgggcttgtgcattttcacctagtgtactgggaactttctcttttttactctatttcttttctttcttgcttctatataacttaacttagaaagactttctaaactcgcagaaaagcacgtcatctcatctgtctcacttttattctaaggaaaagaagtcatcgacaggttaacagcagtaaatattatcagtgcaattaataactccgaaagtagtaaaagcaatggccgccgttagagactacaagactgccttggaattcgccaagagcttaccaagactagatggtttgtctgtccaggagttgatggactccaagaccagaggtgggttgacttataacgactttttggttttgccaggtctggttgatttcccatcttctgaagttagcctacaaactaagttgacaaggaatatcactttgaacaccccattcgtttcctctccaatggacaccgtgacagaatcagaaatggccatcttcatggctttgttgggtggtatcggttttattcaccacaactgtaccccagaggaccaagctgacatggtcagaagagtcaagaactatgaaaatgggtttattaacaaccctatagtgatttccccaactactactgtgggtgaagctaagagtatgaaggaaagatttggattttccggtttccccgttacagaagatggtaaaagaaacggaaaattgatgggtatcgtcacttctcgtgatattcagttcgttgaagacaactctttgcttgttcaagatgttatgaccaaaaaccctgtcaccggtgcacaaggtattacattgtctgaaggtaatgaaattttaaagaagattaaaaagggtaagctattgattgttgacgacaatggtaacttagtttctatgctttccagaactgatttaatgaaaaatcagaactatccattggcttctaaatctgccaccaccaagcaactgttatgtggtgctgctatcggtactatcgatgctgataaggaaaggttaagactattagtcgaagcaggtttggatgttgttatcttagattcctctcaaggtaactctattttccaattgaacatgatcaaatggattaaagaaactttcccagatttggaaatcattgctggtaacgttgccaccagagaacaagctgctaacttgattgctgccggtgccgatggtttaagaattggtatgggttcaggctctatttgtatcactcaagaagttatggcctgtggtagaccacaaggtacagccgtctacaacgtgtgtgaatttgctaaccaattcggtattccatgtatggctgatggtggtgttcaaaacattggtcatattaccaaagctttggctcttggttcttctactgttatgatgggtggtatgttagctggtactactgaatctcctggtgaatatttctatcaagatggtaaaagattgaaggcatatcgtggtatgggttccattgacgccatgcaaaagactggtactaaaggtaatgcatctacctcccgttacttttccgaatcagacagtgttttggtcgcacaaggtgtctccggtgctgtcgttgacaaaggttctatcaagaaatttattccatatttgtacaacggtttacaacattcttgtcaagacattggttacaagtccctaactttattaaaggaaaatgtccaaagcggtaaagttagatttgaatttagaaccgcttctgctcaactagaaggtggtgttcataacttacattcttacgaaaagcgtttacataactaattggtaactagggttcattaataataaaataaaactaaaaaatatgtgtttatatttattctgctcgcagttaagtatggaaatcaagaaatagactggaaatgatctatattttcttcgtattttgttagttcatattatctcttgcggatcgtgacagtagcacaagaattcgatgttgcatctcataggaataaaaaagaataaaatgagatttatcacagttgtggctttttctccgctccctttaatattttttcgtagtatttaatcttctcttgttcaacctccgataaagatggtggtaatttttcattaataaggtcttcctttctagccttttcaaaagtgcttagcgtttcattcaaaccttcagtcccacgagctagagcaccacgaggtaagacaccggcattcatagttttcaaatattccactttttcgctctcttctcttagcaccgaaaacattcttgaaactttagcaatagctaatatcttatttctcaaagcctttcttcgggtttcatcttctaatatcgctgatgacgccttttcatcagatggggtgccggtctccttagttgcgtttgctcttgcctttacagtctcctccgcagctttgggttccgattctgggtcaagttcctgctcactacatatgtttaatatagacactaacatgctagtaactttttcgccaacaaaaggtagtgaccaggtgaaaacatccataaaatcaggcaaccagtaagggtgcggagacatgtgaaactgcctgatgttcatgacgttttcttcatattttaacacagcagctttattatgatatgtgtccaggtagtttggcgcactgaacatggttattaagctcgggaagcctgttactttattgtttttatacattctgtacccagcatcctgtgcttcgtgtgctctaataatagataacaaaccatttgccttcaaaaacttgcatgatgctttaaaagtgaaggcgaaagagcaacccctcaaactgttaggtacgaattcatcctcgctctgatcaaattcgctaccatctcttgcatcatcataattttcgacaggatcggcccatagtaggtcacacatgagaccacgagatgggatttctcgaaatctattaattttattaacatcctctactgattttaactctggagagataccaccatgcacacaaaaatattgtccgttcattaaagctgctaatggtaagacattgaatgatctgcagcaagcatcgtaaacttccatatcgtatttgtgcaacatctcattcttaaaagtaaaataagaggtcaagtgcttacactcatggttacctcttagcatccaaaatctccctaaattattcaacttcaaggagtacaaataaatcagacactcaaaagagaatgcacctctatcaacataatcccccaagaataaatagtcgatttcggcggggtcaccgccaacttcaaacagtttcaataaatcataatactgcccgtgaatatcaccacatatagtaattggcgctttgagttttagtagattgggttctttactcaatgctacagttgacatatttaagatttttatggcctgttccttagaaagtcgaccctcatgaaagaaatgctctcttaaaaaggaatgattaggtaatcccgtcttggagtcgaatacttcctcatcacttggtatctttcctgttatggcaggtacagaagcgataggtcggtccttagtagaaattactttaccgttttctaattcgtattttgttaaatcttttttccggtcaacctttatgtaagagtcattaggtttaatgattttgatgcgtgaagaattcaagtctttcgacattggcgttgagagtgttttatggcagctgagctaatacgtcaaaaaaaaaagaatctaaaaaaacttttctttgaataatacctttaataaagcaaatattaaaggctttgcttcgttcttttataataatgcctcttgattcaaaaacattaaaggatttatacatttttcccttttgtttcccagtagtacgttctttttcagaattggaaaattcatgtttcaagaggcgatgacatgaaaaattttgaaatagatatagatgaatatcaaaatgattcaaacagtttgtatttattgcaacaggaagaaaggtggagtccaaagaaatctgcgaaaaatttttatagtgataatccttacggaacaatgagcacacaatatattgatgagacagcatttgttcaggctgagcaaggtaaaaccaatctaatgttctctgacgaaaagcaacaggcacgttttgagctcggtgtttccatggttatttataagtgggatgcgttggatgttgccgtagaaaacagttggggtggtccagactcagctgagaagagagactggattacagggattgtagtagaccttttcaaaaatgaaaaagttgttgacgccgctttaatcgaagaaacgttactttatgcaatgatagatgaatttgaaactaatgttgaagacgactcggctttaccgattgccgtggaggtcatcaacatatataacgactgtttcaatttaaattataataaggtagaaaaattgtatttggaatggcaagaaaagcagagaactaaaaaatcaaaaagagttgtgcatattgagggtgatgatgatgaagacgatgaagatgtagaggactatgatgacgaagatgaagatgaagagatggacgaggttgtacctgacttagtatcgtctaaacctgaaccaattgttgacgaagacggttttgaattggttcaaccaaaaggaagaagaaagcactagtatcttcaaaatctgtatattataattgatagtgcgctgcttttttgcacttccagtaagaaatagcaacaaaattagataaatctcggtggagttatccaaaatatgtaatatatatcaagaaagttacgtattaaacattggacttctagaggagatcttcaatatagatttaaaaggtgggcaatgcatcgctacgtgaagatttttacttttcttcaacatgtgtattttttatgtttcatatttttatattttgtgtttgctaaggtctaatcgttcagctaagttaaagctaagtataagaagcaaaaaatactaaattatactaaattataaattttcgtacataaataatcatgaggtagatgtttaaatatgtaaatagtttcttttttcttctttgtgattgtcaaaatttgtgtctatctatacaaccctctagaggtatatcttaactgtgtattatcatcaaattcgttattattataattgtcattatcgctattaatgaatttaaatttcttgaaaaaagaagatgtcatttccagaaatgaaaaagattcttttctgaagtttgcgatcttaaatagtcggatgtcggttccaacccaaatgttattttcaattatgttgtttacaacgccgggactaatttcttcttcaaacatataactattcaaattatctgtaatgattgacgtgctgacatttggatctctttgactagccttggtgtcatcactgccaccattgctgttatttccaccccatttccatttgaaaaatgaaaatccgccgttactactgttgttgctattaccattagtggaattattgttattagtctcaggagcaacatgatgagaatttggtctagttcttattgaagaactattagaagtagtcttctctaaagtaatggaggacgaagacgaagacgatcttaaatgctgaaagtgattttgcgctgtgttctgaaaaaaataattcatcaagttgccacttccgttactttttgttctatttaatgccattgttggggtacttacacctgagccagcgcttattgttctttctaagcttacagaagattgacctcttgatcttcgtatgtatcccaaacgatctgttgtaggctttgaaatggtattgccttcacattcgtcaatactaatatccaaaagagattcaaattgcctcaattcatgcgaaaaagtttcctcgtatttaaacgacgtctgcgtgaaaatatttgcccatgtggcaatgtggaaccacatcaacagcttatcattagtatgcatagacaaaggctgaaaagttgtcaatcgtcgaacatccagtggtaaccggggatgaattgtggtcaatatatcagatctaagagccgacagtttcgataaagtttcgaaatattgcaccgatttaattctcggaatttcaggaaccttcgacaaaatttgcttaataacccgcaaaagaatttgtaaataaactgtaccggaccaaacttcattaaaattttcatatttgggatttttacatttgtgagtaaacgttagtggtgtaggccattgaggtctatgtggccaatactctaattgatgttgcaaattcagatttgaatctgacttgaaatcaatgaatgcaatgacttggtagttcttatcatgattcgtacttgaaaaatgcttaactgtcccaggtgtttcattttctaatgacgcaggattgaaaagcaaataaggagttggagattcgttttcttgacctgggtcctcattttgattttggcctcgattgtcattttggccttgttgctgattttgatgttgttgatttgctgaagaataaagattgacttgaggcaaatcagttatctcttcaaattgatagaaatccttccattggactttccggttgaatcccatttgcttcaaggtcatgatatgcgaatttaaatttggattcatgtctaaggccttggatatagaatttatagagtcatttatttggtgagtgatggactgatgtctcaccattgcaaatagtagattctccgcatcgtcaaaatataaggtgaaaaatattgtgattgaccttaataataacgccaacaaatccattttgaaacccggtgagatcatatacggtatatcttttgtcttgaagacaggcgtagcgtaagttgtcagataaaccttatttgatgacttagaaagaacgtaaagtagggacattgcagcattgtaggatagtttggacgaggatgtatgactagaggtggctgcacttggtgatgcggacttcttctttgctgataatagaattaaatcgtcatgtgaatcatcatttttgtgagaactggtcaaaatttcgtcattaattggcagcagattgtaaatcaattcataaaaaatcggattcggttgtaaattgaatttaatgttgtctaaaatcaaattcgataattgtatgactgtaaaatctctgaacgtcaaattatttatatcgccgttgatgttggagagtttgtagaaatttggcaaattatttgtataataattaaggttgaaagtctgtagcattttgaagagaacaagtttttttgaagtcaaaatcaggagaagatgattgagtaaaggtaacaagatctgtgaaacgctattttcgttcagttccacaatagaacgctcgttgctcgtatcgttagatgtgccgttgctcgtggtggaagaattcgagcgtgttgttgatgaagacgacgacaacgatgaataatcataatactttaaatagtagatggaaaaaatgatgaatctacttgcaaacttgtctgcaaaataattttggaaacacttattgcaatcaatcaagtttgtcatgagaatagtcataggtatcaacaaaggatgaatctctggtaattgtggctttgtttgcggtttcgtatggtatgccgccgatgatgaactaggcaacgaagcatgcgaagatgaactgttatcgtgagagctcgtcgacacggctctccttctgctggcatcaatatgtttattgtttgtgaagttaaaaatgtttgattcttgttctatggcgagatcgatggggtatttgaaaattttaatgaaactagaaagaattaattttaaatcgtactctcgctgtaattgggtgaggaaaatggtaatgacattgtcttgggccttatatgacatggagagatttaaaacgtgcagacaagactgcacaaattgaaaataaagcgtctgccaattacttgcggtggcgtcggagctgaaaaaattagccttcaagctctggaagtctttattattgttaagtataaaccgcatcgtgcaatttaatagcgaggaagtgaattgaatgcttttgtccttaggcatttgagtacaccagtagacaagaaacatgtttatgtcctgtttaccgccgctcgtgtacaagtccgaagaaaataaagctgccaaaagacgtaaaagaagcagtctattggcaaaaagatgccactgatgatgcatattcagtagtgagcggtacttgttggaattagtcaagatgccgatttcccacaattcgcttgggtgggcggtcacggcagttgtgaaattatcttggaaagccagtttcaagatcgccaacagtagtctttctcccagtgggatgttttgcaagggaagaccctcaatttcatgttgcgtggcccaaaagacatcgtaatggtcctgcgtgctagacttgacccggtcaaaataaataggtatgaggatggaaagggtctttatggcgttgataagccgcgaagaatgaagtcccgtacgggaagcgggcaaggagttcgcggaaagaataatgtagagcgaaaggaagacaatcaagttgttgaagttgggtgggttcaaactagagataatgtgcaggatttttttaaaactagagttaatgctgaagtcctgcacgtccactgatatgaagtccaagtaaaaatcgttgaagacggtatctagcgggacatttggtttgtcgctgaacaacgcttcaacgtcaggcccagaatccagcttaaaaattgacaggtttaaactcaacggatcagcatcaactgaaagggagggcgagggcgacgacgtacgtgaaggggaggacgcatctgcgtcctccggtcgaaccagagcgatgcagtggttcagcaggatcgaactggatttggagtcagtatttcccattatgcatagcctaagggagaatttttatggtttgatttgtgtgtatttctttctctattagctttttctctgatttgtttgcttatctacctgtacgtgtatgttgtgtactcaataaatagaggtctttttttttttttttctccataggtttacccgaaagaaaaaacaccgaaattaagcacgtaaaccggcggaaaagcaaggaaaaaccccctgaagccaaagcaactgcgatagtttttattatttgttatatcctctataaaaaatgtgcgaacaagagaaaagactatataaagaatctataaaagagaaagtaaagtaggaaaaagagagaaaaaaagagagagataaaaaaaattgtgcaagtctgttaaagtcttctcttggatccattaaccattgtttcgtgctccgcggcaggttccgcgacgtcccatttctcgagcgaggacgcctcggtcgacattgttctctggtttatcagcataggtggtagcgagttagcagtgggcaagggcgaccttgtaaattgcggaacaataacgctcgagtaatctctaatgacacccggctgtagtgaagcgtccgaggtgctcggcgtcctcgatgcataaccctggtcgacccgctgtctgattcgcatacccacagtcatcaactggtccttgtggaaatcctgttgctgctgctgctgctgctcctgttgttgttgttgttgttgaagctgtctctttgggacgaggctgcttgcccattccagttgtgcgtccattaagtcttgtttgttcctgtattagtgtgtgatgtaaagcgtgcgtttcttgatctgggttctcttgctgtttctttttctttgttttcttctccaatccttgcctgttgctactagataaataaataccccactggcgggaaaaagaaaaagcacacacacaaacaaacgagaagaaaaaagcgcgtggtacgagccgcgctaatgaggaatagaacccatgcaccacacgcaaatgtgcgcacggacaaattctgccctctgttaacggcaggacctggcgtcccctgccgttagcggcgctagccgacgccgtagtcgcgtgcccttgcccttagcggctgactggctgactcgattgcatatataaattgcggccaccatacgttgagtcttgttgttatatggcggttgttcgtattacagcaaaggatactacaccacaagacaccacagcagcacagaaccacaacaccaatgtccgaagctaccctctcctccaagcaaaccattgaatgggaaaacaaatactccgcccacaactaccaccccttgcccgtcgtttttcacaaggctaagggcgcacatgtgtgggacccggagggtaagctgtacctcgacttcctgagcgcttattctgccgtcaaccagggccattgccatcctcacatcatcaaggctttgacggagcaagcacaaacactaacattgtcctccagagcgttccacaacgatgtttacgcgcaattcgccaagttcgtgaccgaattcttcgggttcgaaaccgttttgcccatgaacaccggtgcagaagccgtggaaactgctttgaagttggccagaagatgggggtacatgaagaagaacatccctcaagataaagccatcattctgggtgccgagggtaacttccacgggagaaccttcggtgctatcagtttgagtaccgactacgaggactccaagttgcatttcgggcctttcgtgcctaacgttgccagtggtcactccgtgcacaagatcagatacggccacgcagaagatttcgtccctatcttggaatctcctgaaggtaagaacgttgccgccatcattctagagccaattcagggtgaagccggtatcgtcgtgccccccgcagactacttcccaaaggtctccgcattatgccgtaagcacaacgtcctattgatcgttgacgaaattcaaaccggtatcggtagaaccggtgagttgctttgctacgaccactacaaggcagaggccaagcctgatattgttttgttaggtaaggctctctcaggtggtgttcttcccgtctcatgtgttctgtcttctcacgacatcatgtcttgctttaccccaggatctcacggttctactttcggcggtaatcctttggcttcccgcgttgccatcgccgccctcgaggtcatccgcgacgagaagctgtgccaaagagccgcccaactgggtagctctttcatcgcccaattgaaagctctccaagccaaatctaacggtataatctctgaggtgcgtggtatgggactgcttaccgccatcgtaatcgacccatccaaggccaatggtaagaccgcttgggacttgtgtctattgatgaaggatcacggcctcttggctaagcccacccacgaccacatcatcagattggctcctcctttggtcatctccgaagaggacttgcaaaccggtgtcgaaaccattgccaagtgtatcgatctgttataatattaatacgcattttttttatgttttctcgtttcttttcttttttttgttttatatcttacacatttttaatatactaaaagtaaaataaaaaaatacgtactgtttccctttgttttctcctcctctttgcttatatctccactgcgccatcgtcatcttcagagggcgtgctgattagagtcactgtgtctcctctgatgaacaccatttcacatcgtctttcggactcactcaactcctcgttgtttaattggtatatggtctctactgcatcactcagcacgatgttgcagtgtgagtcgaacgcttgcagtgtgcccaccagcgtcctggccccgcgcagcttgatgtacaccctctcatcgagattgagtttcaataaatccaaaggtgtctccattttcttgagtgtgcgtgatgttgtgtgtgtgtgtgtatttatctgcgtgtctctcccctgttgtattggttgctagaatggatggaaacatcctgcctcttgtttgttcaaacctcagctttcttgctttttttcttctttcaatatcgcgacctatcacacagcacggatagccaaaagggcgcatcaggaagaagaaaaaatatcatttcagcaaactaaaagaattgccctgaaagctatcgagccctggtaagagagtaccattctatctctgcggctagaaaaaaataccataaaaatataataaaaatgtggaagagatcgttccactcccaaggagggcccctgcgtgccagaacaaagtttaccaaaccaaagccaaaacaaccggtgcttcccaaagacaaaataagaccgcccactcaattgactcatcactccaacaacctgaggattaccgaaccaatcccaccaacaacctcaaacctgcgctgtcccgacgaccacccgctgtggcagttcttctccaacaagaaattcatcaggtccgccgacgacttgccgccttccagccatatcagaccctggagcatcccagagttgaggcacaagtcctttaacgacttgcattccctttggtacaactgcctcagggagcaaaatgtgcttgctcgcgaaaaccatctcttgaaaaacattgttggctccacgcatgacgaattcagtgagctctctaactctatcagaaccaccatgtggcaaataagacatgtacttaacgaaagagagctggcctatagcgcttcacgcgaatttttacaggatgaatcggagaggaaaaagttcttggatactttggccaacgattacttcttgaacaaggatatccctgatgacgaagtcgcctccatgctcacacgattccagttggccattttcggcatatcggaaaccatccaggataatacagtcgacattaacttcatcgacgggatcaagttcttggcaaacttaaaactacagcggttcaaggactccaatgacctcatatccgaaatatcacaagaaccgatcacagacgtgggcgagtcgttcatcttattcacttccgacttcgaacctcatgccgttcaagaggcttgtgtcgccatcaaagacctgagaaagtccccagataataaagtccctaaattagacgaactccccaccgtgagaaaatacttgaaacagctaattcatgcaagctccgtggagcaagcaactgcatgattcccgtgggcttcctaccctctctcctgtaaatatatatatatatatatatccacacacactcgcacatacatacacacatacatacacctttatatagctatacgctgtatgtattcagaaattagtcacgttgtggaaaatctccctagcaatgccgcctaccttactcttattgtcgttctgtccgtccagtgcgtacttgtctttcaccaggtcacgggcgcttagctccaattctagtgtgctccattgcgatgtaacaatttcgacttcctcaagggggcaaacctccagtaagcggcccaagatgctcatctgcagaacaattatctctgtgggaatttcattatccacccaatttggatcgacaaacttccccatttgataaaatgttaaccaatgctcatcgcccaacgccttcatcatatgttggcccgcttcttgacaaatttcaaacacttgcttgcccaattcgtatgctgtgccaaaatctaaattcaccaaggcatagtcaatatgtaataccatcaaatccacttccactttacccgtttggccctctctattaatggataagctgtcgtaaatcccgaataacaagctttttgtagttggcagatccttatacaatcgcgggttcagctctaataagttggatattatatcgagggggcaatctctatattctagaatgttgcttggtttgaaagcggtatctcttgcgccattgtgcgacttatttaggtttatggaataatgcgacaatttgtctgatatctcaagcaatacttccagcttagttagatttgtgcctgcccgttgcgacatatgcttctgaattatttgtaacgtttgcgaagcttttttcatttcaggctctttacgtaatccattagaagcattattgaagaaatgccagaagaacttcaccagaagttcatatatttgggtattgttactgtagtcgaatctttctatgatggcttcaatgtacgcgaactcattcatttgtaagaggatttccaatatactgtatagcttttcatccatactaattcgggtgaaaattttatcatccttgctgatgtccaagaccgtttcatacatggcttgcaaaaaactggagatttcgttggctttgttaaattcttcatggcatagtgaagagaaatgggccaactgagccgattcttcttcctgtgttatggcaaagatttctttaaatgaaaatttcgtggaacatttgatgaagaattccataaattgtttcatctctagagcagtaatagttttctgttcttctattgtaatttcatcagggaatccactcaagatactccataattcatcaagcttatgagttaaactggataaattaaataaattctcactgttgtgaaataatatatcaaccacattactttgcaattttctggacgcttcactgttatcttttactcctttttcgagactgtaatagagctttataaataactggtaattagtatcagattttagtgagaactgctgtttattgaagaattccgtaatgaacgtttcccatttcttcccataagacaaagtgggagctaattcatcttcaataacatctgctataccaatatatccttgcatatcctctacaccgtcaaatattatcttaaataactcgctatcaggcattttttcccattcgttgattttaaatatgagatgaagccgtttatttaggtggtcgaggggttttaatactccttctacccatcctataaattttgtagataacacttttgacttggcagtctcccatagtacagaatataataaaggtgtttcaggtatcatttcattacatattaaaatcctttctctcaaccactcctcaaaattctccaaggtcttgttattgagttttttgcttatgaattcttgcagttcatgatatctgttcgatctcgttgtggtatcactttcaattaatggaatcaaactgctgtcactttctaatagttctactattacatcttcgtcggttgtttcttccccttccggactttgcacctcctcttctaattcacgaagaaacaaaaggttttttgggtcatctaattctggccacaaaacacagagaatctccaagtacttggattgtgagcccagtctagtagacaactttttgatattgcgcgtgtcagccctagatgcaaaaatgcaagctaacaaatatagttgctcttccaacatttttactgcaattttcttggcaacctatcaatactctctgatataaccagttattgtctatttacaattggtttttcttttccctagtttttctttttctctgcaccttgcctcttcctcacaatttcaataaattacagtatatttacgaaagagtaacaaaaatttcaacaggtcacacagagcagaaatacctatttgaaacgaaaggaagatcgttcatgttgctatatatgttcttaaaaatgatttaaaattatacaaatattgtatacagtagtatagttatagaattatctttttgacgaggttaatgacatcatagaatagagagttattaaagagactaaaaaaattaaaatcgaaaaagaaagatttaaaaaataagatatgcatcactcctttttcctgttcctttcctttctattttattattggttcctttacacagtttccaagacttcgtccttgaaaccggtaaccttcttacccttttcttcaccagaaccttcaccgtgcaaagccatcaaagcaccgacatcgaactttggttgtttcaacaacttaacctttctaacatggatgttttgtagtgggaaaatgtccttggtggcgttttcaatttccttgttgataacttctggaatcaacttggaggtcaattgggccaaggtagatccttgaacttccttagtcaagatttcggaaataacctttctgatagctctgatatgggaagattgagcgtaagagtgtctcttaacttggttagcttgctttctggtgaaggcgatagcaaagattctcaaaacgtaatcatcagaagtcttaacagtaacgttagcttcgatcaaagtttgccactttctaaccatggatctcaatttatcagtagtgaagtccataccgtggaagttggtcaataaattcttaccttggacttcgtcaactcttaatttgatttttctgaaagagtggtcttcagaaccctgtaagtcagccaagcaaacttcgacaactctacctttcaaagcatctgaagcactcttcaaaccagtggacttgttaactaaagtcttaccaacatttctgttttcaaaagtggatggagctttaatgtcgaaccattcctttctggtaaatgggtcaacgactctcttcttttgacctttcttacccttggatagtctcttattctttccgacagccatgattaaacgattggttattcgtgtgcttgttttgtttccttaatattaaagttcacaacgtgaacaccttcctttcttaatagaatagttgtgacatctagtcattttgggtatattatcgcgcaggtgagagagtcctggaatttccagcggatggtgacgcgaggcatccgtagtgcacaataaaaagttagtttttcattaaccgaaaaaaaaaaaaaaataaaatatattaatgtttgggtttcaacgtttccgtgggtctgggtccacaacagaaaactgtcctgaagtttgattaggttttagtaagtaaacagttatggttacattattaaggaatacagaagagactgcatgtgtacataggcatatctatggcggaagtgaaaatgaatgttggtggtcaaatgcagtccatatttttgaattcttcatccatcgaaaaggcgtaatttatttctaaaggaagttttagttctaccataatgcttgcactgggctcctcgagcaccacaacaactaatttttctcccactaaatcattcactacacttatccaagaaaattgctttagtttctctatagttattgcgggctcccaggcaccgcatatgaccttcttaatttcttttgacgccttgtaccctgggttgtcccgcaacatcttcaccatcttaatcaggacggtctccagagcaagcgtatgacgattcgtgccttcggtttcttgcgccagggtatataaaaatgttctcatcaacagagacattcctataatcttctttgaaatagtttcatccttgaatccgttaatagcttctgagaaatagcgtggtaccatctcctgtgacactaccaatttacccttttgtagaccacctttccgtacgaagtcttttttagaaatttctacggcagcttcacatattttgaatgctttttcagtactaccacttacgttggctacgttctttgcaataagttgagtgattttgttgttgatcttatgattgattactatcacattatctggtattttctggttctgtccttcgcgaatattattgtaaatagtcatttccttcttatcatttactttgacatgaaaaggtttcaataaagatttgagtcgcgtgatgatcatttgttgcaattcattcttgtccaccttattaagtttgatttcggtaaagtgtgctttgagggagggcattatatttatttgctctctaatcgtcacattatgtccgccaacgcaaatgatagacaattttgaatttttcgaagaaatccatttctcgaaatattgtaaaatcttctcactcaatagattttccggattttgtattaatattagtgtctttctcttttttgctttcgggacatttgtaatatagaagtttaaggcctctagtgatatatcaccgcatagattttctttagaaatggcgaaccatattttctcatataatgcatccattcctgccagttccaaggcatcaatatgaatgtaatcgaaaataggtagttcctttcgggccgaagaggtgatcaactcatccattacatcattcacaagctggaatttagtagaatcatctgcattggtaatataaaatagtttattttgggaagacatcaaactgtcgtaaatcggaaggaatattcttgtaaaatcctccacttgtgattttagtagttctctcttttgtaaagattctctaattgattcctctaaatttatatcagcgttaaaatttgacagaatggtttctcttccagatgaagagcatgcttttctaaacttatcctcaaggcctgcaacgtccaagcttgactgttcgtctgttaatttgttcaattgggaggaatctgttacttgattatctggtgcaaaccggtctaaaattatctgatatttttttttcaactttgacaaagtagcgaaatcaatcatctttgcattacctttttctggtgtaggattttcgttcatactatgaattttggtgttgcccctgggaattccaggttttccatttccgttcatttcgttatctgtttctgtagtgtaatttttagaaaattcttgtgtttcttgaatgtggatttttctaattttactgctcaattcgcttccgtgagcgccacgtcttttatttactggtattattgcttcatcagaactttctgaactaacttcatctgtttcctcttcaagcccaccatcatcactcacttctggattatttgcatatacaaaattctctcggccgtcaacgagttctgtagatgtcttctctggctttgacccaggtttacttgaaagcacagatgtttcattgtttggctcataatcggattcctgttctgaagagtttattggtatttcctctgaaacaattagttcctttgatatagatcttttttgtaaaattttcgaagaatctgtaggtgatgtgagcgcagaaggggacgccgatgagatgttaggggaaacagactcttcttggggagaaattgaaccatgagttgttgacgttcctcgctgagacggtatatttccattatttacgtcatcatctgcagagggctcgattttaatttttttcattgaaggtttctttgctagtctttttgaagatctttcaactcccatcttatgcatcacctgtctatttgtcttctgcccactcactggtacagatactcttttcaagtattcatcagattgtttgggttccatttcctttactcttcttatgatttgaaaaatatcaattggtacaaacttttccgcagtaggttcgcatgcataacgtactagaaaatctctatcctctattttatcgatactactatcattccattgtgactctggcagtatctgtccaactgcaatgaaatccttaagccaaatctctgatagctcagcagttaaatataactcgctcttatttacttcgttgaaaaatttatctttgtaaaattctaaaggatgatcttcctttattagatctggcctgaattgttcgtagtacagttttggtttgagttcaaaccatctcaagtaagaaaaaacccaaatctccacaacattattaagtgtattgagtctgatctcatggatcaagtagacagaatatgtttccgtcacattatcattaaatatcacgctctcacccttcccaaaactcaatccatcagaaattcttttcagaaatacgttttctcctcctctttttcttgatcttcttctattgttgtcgtcaataaccctcccctgatcatctgtaatgataacttgccaaccgtccaaatctttcaatgttttagccattttagctaatccaattgttagaacaaaacaactttcttaaacccctgtaaggaaggtgatgaaagggctgcttatgtgtttttctttttcatactatgttcattttaacttttttggaaagaatagcgttttcgcggtcatattactgatgcgatgaaaatttacaattatttctttatttagattgatacataatatggttaactttaaatacatcttttggacgccgcataaacaaacgtcccgaatactttgttcccctggattcgttgtttgcttaacactgtcaactctctacttagtttcatttacaccatttctttgtgtatcagtcattgcgaatacccttgcatatctaatggatcgaaaataaatggtgatgtcaagaatacgagatacaatagccaggccattccagaaccttacagcccttgagaaagtggtacagtggctaagattagggacgacattactcataatctctttcgggttggcgttgactgtcggacccctttcttcgccaagaacattgtacatgtcacgactggatacttactctgctgatattacgacgggtttatttaccgtgttgagagagtctatggagcagtcgacatctacagaagaaaataacggtgtaggcttaacaacatccgaactgtatatattgactgcttacaccgaaagtcagataaagaatgttcctcagtacatcacagtgtcgctttatgggaggtgcgattcaacatataccatggtggaagtattcgactctgaaggaaatatgcatagcgtaaagaattcgactactaagagtacctgcagtagcataggaacggactatctttttgattatcgtgaggttttagaaagcttgggtttagatatcattttagattatgcatacaacaaaatcggttcacaacaggcagaaagttctgcatacacgacctacatgaggagtttaaaacataaaaaggccaacgtgttacatttactctatgcagttattagtttccaggtgtgtatgttatttttcatgatatggtactactacataaagggaaggtttatgaacgccctcaaagaaagggcacttgttcatatcaactctctactatcgctagttgttttcattgggggcctgataagtagcataagccttgcctgggttaactacactattcagtctagaattaatacagaattagaggccttcgggttttcttaccatcttggagttacatggtttgcgcttctgtggtgttttgcaggtttgatttctgtgtcatgcttagcttggtctggcttagaatggtgtatttccgataatggcacgtcctatggaggtggaatcgatgataaattcttaggctaccaagccggtgtatttactgatgcagatctagacgatgaaacttcttacagtcaacgttatccgcaacgacagtctacttcgggcgaggctgaactgatgagaaacagtgatactatggcaacaataagaaaaacatctgatgttgacttaaatagtgaaaatgatgctaacaccagtttagaccatggaaatcccaccgcaaatataagcaatggcggcaaacacgaaccatttgctactagagaggaattcgaattgcaggacataagattccggtcaagcaacgacagtgaagaaagtatgcaaagggttatcaagccttcgtcagcattacagttttgaattctttcacccatcattcaaaatgcatatgcatactatatttgtctagtttttaattatataataataataacagaaacaaaaaatcgcattcatcgtttaatcttatttttcttttttcacctttttcttgtgaaattgccaagcgcttaaaaaatcgttatttcagaactaaacatcattaagcaacgaagaagagaaaagcggaactataaccatgagtgatactacggaagtccctaggcaatcatctgagaacgaccaggataataacttggaaagaaccaactcattaaaaagtccggacgtgaccaacaatataccaagtcttttcaaattagccgccgaatggcaaatcaacaatccacaggaaaccttccaaaaccatatcctggaaaatgatgtactcaagaaaattaatgaaatcactcatttgatccgggaatcgtacaaagacctctccagtcaagatgggatgatgtccaaacaacaacaggaaaagatggattgggatttgttttgtactgttcctgtaaacattattgagcaatatacaaaagacatggacgaaatatatgaaaaaatggaaaggctagcaaaagtaagtataggtcgaaactaggcatcctgtgccatctcaattttactacgttcttttactaataatgcaaatttaataacagcaacaacgtctttggtgtgaatccgcttttcaaatagacgtggaaagatgtggtgactccattctcaatgctgaaacgtggatgaagaagaaagagcgccatttagagtacaaaaatattgaaatggaaagatccgcaaatgaaattaaggaaactattcaaagactaacagatgatagatgagccatactcaaatatatctgcgatattgctaatgttagctatttctcacatttgctttttttgattttatttatttacttttacgacaactggccttatcactcggctctctaaaagaagtcatgttcccttcgttgggttaattttttttttttttttttttgtttatatgttttttttttttttgccaggtattgttagcgccagatagcaaaaaattttattcagggatactgaacaccggggaagttaactgagtatatcggttatcattataaacacaagaatgtaagccagaaagaaaaataaacgtccacccctcgaactttcacatataagcaagtaaagaaaaagttaacaaaaggaggttcagaacatgacaattgaaagcactctagctcgggaattagaaagcttgattttacccgctgattccatagtgaatgtagttgaccaattccaagaggagttgttatcacggcttcagacaaatacgatttctatgctcccgcagtgtttagtcccagataaacgatcgcgatggaaccctgaagacaaaattctgaccattgatttcggcgggacaagactgaaatttgcaattatctctctgccccaaatcgttatcgaatacaatgatgccttcgaacttacctacaacatcgttgattcgaatttctttaatcaaatcatctatacaatatgtaccaggctggctgcaaatggttatataaaaaaaaagaacgagtcatctgaggcgtctaaattttttgtttccgtgacattcagttttcctctaaatccagaaggggaggtagttgcaatgggaaaaggatttgtgatgactgacacccttcaaggatccacggtgaaacagctcatccaatcttcctttcaccggattatatcagaaaatatcgaagaatttttctgtaccatgaacgtgtgtcatgtaataaacgatgcaattgcagtttcactaacaagcaaatttatatgcgaaaacgattccatctcattaataataggaactggtacaaatgcatgttttgaggttccatacggatatttaccacctttcaagagagatgccctgagagaaacattaccgtcaagctataataaggagacattaaatttcaaacatgttctcattaattctgaaattggctttattggtaaaaatgtcattgcattgcaaccgtttgacattcatggagcaatctcatacgaaatgccactagagtgcgttacttctggtaaatggcttcccctatcattaaaaaatattctattgcaatataacataatccccaaaaacttcccagtagagttcaatggggaactggtatgccagctggcagaagactgtactaatgcttggttcgaaaacgaacattatgcactaatttgtcagatcgcacgactattaatcaagagagccgcattttatgttgctgcaattgtacaagctattgatatcatcacaggctgcaaaaactataactttattcatattggctacgttggatcctttctccacaattcaaatttttatcgagagcagataaaatattactccagcatacatattaagttgcaattcttaaatcacagtaatcttctaggcgctgcaatagccacctacttgaacaaatcagacaaccaagttcaataatatatttcatcatttcttaccatcttctcgatctatttttattattcccagaaaactttgtgatgttggtgtagaggaaatgatccggcgcactaacaccacacgcttgtaacaaactaaggatgtcctgaccttttttgattatgttaccaccccatttttgcattcttctttttttttttttttttgggtctgaaaatttttttgcttctacttaattataattttatataatcatatatggatctgattcttaaaaaaaaatgaaaaaaagacaaaacaaaccatataggtaacaatttctcttagtgacataaaagaagaaggaacgataactttttcaataaacggaaatataattgttgattctttctctttggttttgtgcgatacattctgcaatccaggtaatattcctaacttcttgttccttggatttcatccaggcccaaacagtgctgatggcaaattgttgcgtgaaagcatctctacatagttccatttccaattggtaaaagtgatcttctaagttaccagtctccaaaaatcccctatactcatagacgttagctaaagcagctctaactccttcgaaatcttgggcttgcgccaagtgaaacgttgcaagagggtacaacttacctatgttaggtaacaagtcacttttcaaatctgggtcaatatctgaactttgcaaagagttgagtgcaatattgatacttcttctgtcagcttcaaaccctagtaatgtttgcatacattctttagcaggttccggaatttcttcagtgacaaaattgtaaaagtcttctaaataagccttgtacagcttatttctaataatttcaatgttcatatcgtctagctcctctgccgtgtcaaaacagtttttgaagtaaggtgccagtggggtatccaccaatacggtttcgtatagggattcaagatcagtagcaacactcaacgtaggcaaagtatcaaaccaacctagcggatgacaacgttgtaaaatttcacccttatcacgatcatgaatagtacctgtaatcatcaatgctacattgtcgatcatgtaaccataagtgatatagtccatgaactttctcgtggatccactggattggtctcttatgtagttgaattcgtggtacaacttgctagaagcatattcttgaatcaatgacgtggtcaaagactctgaggaaacagaggaaagaaaattaccataatcagttgatgataattgtaattttagatcttccaacgtgtcacattgtgttaagttgatgtattggttattagataacaacccatttctgtagcctctcactacaccttcaataaacccattgtcaatattgaaatacacgccttccatcttcgcaagactttagcaacacgatccgaatggtatactcttttgctagctcttagcgttctttatgccataccttaaagggttaagaggtcaattgttcttttgtttttgcagtatatcgaagatattttaaaaatacgtcactttgtacgcagatatcagcgtaacaataggtgcgcggaaattacttagttccataatacaagaatctgctgactttgcgtctgtaagataagaagggtacggcccagagtatgaatcgttgggggatgaaatcactttttcatcttcctacaattcattttgtccttgaaatacataataacaaaatattaatgaaacttgcatgttaccaaataacttgaacttcagcacttctatttgtataccagtatcacagcattcagcaaatttgattatctctcatgcttcatgtcctaccttttttccttctttcttccttgtcttaatctgaaagttactaataataataaagacaaaatatcacccatgcaccaaaatgtatgggtcataattttttttcttgccttcaaaaatcgttgttagctgcaaaatggcggtgaaacacatagttgtggttatgcgtcccctccgggcggccgcagatggaggatgcccccatgtgctgattctccccgtaggcggcgagtaatatcctcgcctaacctggacttgccgtgctaagtcggccttctagctgcgcttccgttcagcatcgtttacggtagagggagcacatgggcggaaacaaacctcattctggtcctgtgcttgcccatttgcactgtatagagtgtgtgagtttcaattaatgttgtaggcgcgaggccctgtaatatggcagttgatcaaaagtcaatagataattttcaagcaaaatctcatttaggtttgactactttcttgaacttggaagagaagcaaatatattcaacgaaatgactgcccaacaagtatgtgtaaagatgagtaaattgaaggatgtgatggttatggagatggcacacgtgcctagaggaaaatagttacccaagaacaaaagcaggaagggagctaaccttttaaatatgaactggacaaaactggacaaaatgaaaataacgattttagtaaaaatgaaaatatagcatcaaatgactgagaaacatagtaacaataactcatattatagctaatctgagtaaacttcttcctacgctaagaatttttttgaggatagtaccaaaccttgtgctgaatcagcacacgccatgcccaccatcaattgtgcaagaaaaaagtaaacgagtagtatactaactatatatgtgatttacatcacgatatgtcaattataggccccaaagtggtatccttccgaagacgttgctgccccaaagaaaaccagaaaggctgttcgcccacaaaagttgcgtgcctctctagttccaggcactgttttgatcttgctagctggccgtttcagaggtaagagagttgtctacttgaaacatctagaagacaacactctattggtcactggtccattcaaggtcaatggtgttccattgagaagagtcaacgctcgttatgtcattgctacctctaccaaagtctccgtggaaggtgtcaacgttgaaaaattcaacgttgaatactttgccaaggaaaaattgaccaagaaggaaaagaaggaagctaacttgttcccagaacaacaaactaaggaaatcaagactgaacgtgttgaagatcaaaaggttgttgacaaggctttgttggctgaaatcaagaagaccccattgttgaagcaatatttgtccgcttctttctctttgaagaacggtgacaagccacacctattgaaattctaaattgaactgaaaaaattataaatgatttaaaatagaatttcaaaacaaggagaattgatagagaatgcgttgatctgaaaatactgtttgacaataacggaaaggtaagtggatatgtaatctaagtttaatcctcttctaattcatttttcctatcaacattatctgtgcttttctatatccttctttttgtatctataattttttttttctcttacatagcaaaatacaaaaaatcataaatattaatatctaagggttcaagatcaggtcatcgccgttctgggccactaggctatatctattcatttacattggaagctgcatggtctactccaaccgcactgaggcaaagtctctgtggaggaaatgctgtcctagcgagccattgcaataggtataatcagagtcgtcctcccaatgtgttaacttctctcaaaaccaccatataaattctgtaacctgccagcgataatgttatatatgtaaaaggtaaacatacaacccaatttgtccatactaagtggatgctggggaagcaactacagtgcagatgctaaagtttgctgcggcaaataatctcaacatttttgtgattaaacctgcctcagtggggtgtatgattagtgcgttgatatttaatacacgcgtaaaagttaagtctgttgtacgttttatttcgagtgacgaaagaactacgaataacttcctgcatactgttgcctttttctgtatttacgtatacttttatatcaaatagcttggccaaaagaaagtagcattgtgtatcaagtcataattctaattcttagtttaacttcagcaaaaataatattcttcgtcagacattctcatacaatcattaacccatatgaacgttaaatttctcaatttcttgccttcgatgccctatgtatatttttatctcaaacccgaggcagtgaaaattttagctggtgcatcgaaaagagaagggcattgaaaattttacagtgttaaaagaagtgcttttcatgttagaatgataagaaaaaagaaaaagacaacaaaatatacgtctctaccatgtctgatatgcttccattggctacgtatagcctgaatgttgaaccatactccccaaccccagctctgaacttcaaaattccggttaccattagaatcacaatggcggccatcgaccctgagccctttgacgatgacaaaaagccatctactttaagaataatcaaaaggaatcctgaactcactcgcggtgagtactacaaccaagataacaatgacggcctcgaagaggatgaaagtgaaagtgaacaagaagcagatgtaccaaaaaggagtgtcaaatcaaaaaaaggtaaggcagtcgagcaaagtgaatcagaagactctgaagatgaaaacgaaatcgacgatgaattcgaagaatgcgttcttttaaccttatctccaaaaggccaatatcaacaagctttggatattaccattgcaccagaggaagacgttcaattcgtcgttaccggttcatacactatctctctaaccggtaactacgtcaaacatccattcgacaattcttcagattcagacgaagatgaagaagactattacagtgacgaagaatcttccaatggagaagaagaagaagaagaagaagaagaggacgatgaggaactaagttccggtgatgacgatcttgatgatttagtagatgctagtgacatcgaaagtcgtcttgatgaattagtcaaaaaggacgaaaagaagaaaaacaacaagaaggacagtaaaaggaaacatgaggaagatgaggaagaaagtgctaaacctgccgagaaaaaacaaacgaccaagaaagacaagaaagcagagaaagttaaagactcggaagagagcaaaccaaagccaaagacgaagctactggaaggcggtattatcattgaagaccgcgtcacaggaaaaggcccacatgccaaaaagggtaccagagttggaatgagatatgttggtaagttgaagaacgggaaagtttttgacaagaatacaaagggtaagccttttgtttttaagttgggccaaggcgaagtaattaaaggatgggacatcggtgttgctggtatggcggtcggtggtgagcgtagaattgtcattcctgctccatatgcctacggtaaacaagctttgcccggtattcctgctaactctgaattgacatttgatgttaaattggtctccatgaaatagggtccttaatgcatacgtattgatatatgtatctataatactatatacaattatctatacttccattactaatattatctttcaattttacatgtttttttctgccataaaaaagcaatatttttttgcgagctatttagtgatatagccgcccagctacttgtcgatgcatatattggctgagagtactaatacaattatcggaagacctcaaagtaaaatatagaagctttgagtaaaaggagctcgagttttaaaaatgacttcgtaatatgtaaagtttatgtcatatatacttacacgataaatagaccattgatcgttagagacgagcgcattgttttgttgaatccctttcaacagcgcgacaaaagttaatcgagaacaataagatgttgcattcaagggttagtcaaacatatcagaaggccgttttctaaatcacctcaagaacctaccacacagatacatcttgaagaggtggagtaccaaagggaatattttgtacgagcaagttatagtaaggacacttcagtgagaaattaatctgacttacttttacttaattgtgttctttccaaattagttcaacaaggttcccacatacaacctcaaatgtcacttcccttaaaaacgatagtacatttggtaaagccctttgcttgcactgctaggtttagtgcgagatacccaatccacgtcattgttgttgctgttttattgagtgccgctgcttatctatccgtgacacaatcttaccttaacgaatggaagctggactctaatcagtattctacatacttaagcataaagccggatgagttgtttgaaaaatgcacacactactataggtctcctgtgtctgatacatggaagttactcagctctaaagaagccgccgatatttataccccttttcattattatttgtctaccataagttttcaaagtaaggacaattcaacgactttgccttcccttgatgacgttatttacagtgttgaccataccaggtacttattaagtgaagagccaaagataccaactgaactagtgtctgaaaacggaacgaaatggagattgagaaacaacagcaattttattttggacctgcataatatttaccgaaatatggtgaagcaattttctaacaaaacgagcgaatttgatcagttcgatttgtttatcatcctagctgcttaccttactcttttttatactctctgttgcctgtttaatgacatgaggaaaatcggatcaaagttttggttaagcttttctgctctttcaaactctgcatgcgcattatatttatcgctgtacacaactcacagtttattgaagaaaccggcttccttattaagtttggtcattggactaccatttatcgtagtaattattggctttaagcataaagttcgacttgcggcattctcgctacaaaaattccacagaattagtattgacaagaaaataacggtaagcaacattatttatgaggctatgtttcaagaaggtgcctacttaatccgcgactacttattttatattagctccttcattggatgtgctatttatgctagacatcttcccggattggtcaatttctgtattttgtctacatttatgctagttttcgacttgcttttgtctgctactttttattctgccattttatcaatgaagctggaaattaacatcattcacagatcaaccgtcatcagacagactttggaagaggacggagttgtcccaactacagcagatattatatataaggatgaaactgcctcagaaccacattttttgagatctaacgtggctatcattctgggaaaagcatcagttattggtcttttgcttctgatcaacctttatgttttcacagataagttaaatgctacaatactaaacacggtatattttgactctacaatttactcgttaccaaattttatcaattataaagatattggcaatctcagcaatcaagtgatcatttccgtgttgccaaagcaatattatactccgctgaaaaaataccatcagatcgaagattctgttctacttatcattgattccgttagcaatgctattcgggaccaatttatcagcaagttacttttttttgcatttgcagttagtatttccatcaatgtctacttactgaatgctgcaaaaattcacacaggatacatgaacttccaaccacaatcaaataagatcgatgatcttgttgttcagcaaaaatcggcaacgattgagttttcagaaactcgaagtatgcctgcttcttctggcctagaaactccagtgaccgcgaaagatataattatctctgaagaaatccagaataacgaatgcgtctatgctttgagttcccaggacgagcctatccgtcctttatcgaatttagtggaacttatggagaaagaacaattaaagaacatgaataatactgaggtttcgaatcttgtcgtcaacggtaaactgccattatattccttagagaaaaaattagaggacacaactcgtgcggttttagttaggagaaaggcactttcaactttggctgaatcgccaattttagtttccgaaaaattgcccttcagaaattatgattatgatcgcgtttttggagcttgctgtgaaaatgtcatcggctatatgccaataccagttggtgtaattggtccattaattattgatggaacatcttatcacataccaatggcaaccacggaaggttgtttagtggcttcagctatgcgtggttgcaaagccatcaatgctggtggtggtgcaacaactgttttaaccaaagatggtatgactagaggcccagtcgttcgtttccctactttaataagatctggtgcctgcaagatatggttagactcggaagagggacaaaattcaattaaaaaagcttttaattctacatcaaggtttgcacgtttgcaacatattcaaacctgtctagcaggcgatttgctttttatgagatttcggacaactaccggtgacgcaatgggtatgaacatgatatcgaaaggtgtcgaatactctttgaaacaaatggtagaagaatatggttgggaagatatggaagttgtctccgtatctggtaactattgtactgataagaaacctgccgcaatcaattggattgaaggtcgtggtaaaagtgtcgtagctgaagctactattcctggtgatgtcgtaaaaagtgttttaaagagcgatgtttccgctttagttgaattaaatatatccaagaacttggttggatccgcaatggctggatctgttggtggtttcaacgcgcacgcagctaatttggtcactgcacttttcttggcattaggccaagatcctgcgcagaacgtcgaaagttccaactgtataactttgatgaaggaagttgatggtgatttaaggatctctgtttccatgccatctattgaagttggtacgattggcgggggtactgttctggagcctcagggcgccatgcttgatcttctcggcgttcgtggtcctcaccccactgaacctggagcaaatgctaggcaattagctagaataatcgcgtgtgctgtcttggctggtgaactgtctctgtgctccgcacttgctgccggtcacctggtacaaagccatatgactcacaaccgtaaaacaaacaaagccaatgaactgccacaaccaagtaacaaagggcccccctgtaaaacctcagcattattataactcttgtagtttacatggtgatactttatatctttgtattgtctagctattctaaatcatctgcatgtaataagaagttgatcaaaatgactcgctgcgtaaaacctctcttcgatcggaggtgccgcctaatttatcgcctagcactgcgctttttcaaagtttttcagagcaaaaaatgaaaagtaatgagcacaacaatagaagagtatcatgatatataaggtcataaaactaggtttcaggggctatcggcaatttgaggaaccttcaacctgcctcaagtaaaaatcgcttcgtaacattaatacaaattctttttgcaattatggaaggaagatcagattttgtggcgacttcacagtccggaagtgaaatgagccatagtgaaactaggaatagaactgggatgaatgctaggaaaaggaaattcgcctgtgtggaatgtcgtcagcagaagtcgaaatgtgatgctcacgaaagagcaccggagccatgcactaagtgtgctaaaaagaatgtcccatgcattttaaaacgagatttcagaagaacttataaaagagcaaggaacgaagccattgaaaaaagattcaaggaactcaccagaactttgacaaatttaacttcggatgaaattttgaagaaaattgaagaggaacaggaaattgttttggataacagtaatttcacaaaagaaaaagtaaaacaactcaggaagagtgcttttgagacgacagaaatagaaccgagatcatacaaaacacttcgaggagaacctatttcttacagtaccaacagaagacatacggattcttctcctttaacgctcttaagctcgtcgacaaacttcgaccctgttcactcaacaaacgttatgacagatgatcaacttaagtgcttgccaaaaagcctgggcgacgtatatttgtcaagcagcgatattgctgagctgtttcaagaatttgcgacaaaatatcatcaatttttacccgtcgttgacctttcgaaaggagcagagcgaatttatcacttatctccttgcttattctgggtcatcctgctcattggtttaaggcggaaatttggggctacagacttaatgactcgattatcagtgctagtaaagtcagttttatcagaaatcacaatatctccaataattcgatatactccatcagataaggacgaacccgttctaaatgtagcatctgtatattccgtgcaagcatttcttttatacacgttctggcctcccttaacctcttcattaagcgccgacacttcgtggaataccataggaacagcgatgttccaagcgcttcgggtaggactaaattgtgcaggtttttcaaaagagtatgcttcggcaaattcagaattagttaacgagcaaatacgaacttggatttgctgcaatgttgtatctcaaacagttgcatcatcatttggtttcccagcttatgtttcatttgattatttagtaatcagctctattagagtaccaaattcaaaaagccaagtagatatacccaatgaactaagacaaatggctcaaattgctagatttgagaaccaaatcgtaaacacaatgaactccaccccggcgagtgttactgggatggtaagtcaggaagagaagcagcccttgttacacgttcttaatcaacaactaagtcaattggagattagtcttgaagaaaataacctagatgatatccgaaaatttttattactagtggccaaggttcacttattaacctattacttcactgatgttacctcccaaagtgctggaaaatcaaatggtaatatttatgagggatcatattccattatggaactcgatacaagttttgaaacgaaacgtggattggtgaaagtttataatgccgccgtaaactttcttatacatgccaatagtatgtgggaacatgatcctaccattattaagtactttcctggtttgtttgtcttgaatatatggcaatctgcctgtattattagtaaactcatacattcatcacttcattcaatgctagatgttaactcaggcaaaaaagcttataacaacgcaatttcattgacgtttaatgcctcagttttaaaatatgatatggcgtacagatcatccggaataatgcgaagcatatggagtttatttgctaatatgtatgatgcctggaaaaacgaccaaaaggaaggtggaggtagactaaataatgatttcaatttaggcatcaccataaaatctaggatgtcagtaaacgttttttttgactgcttatatattctaaaagagaaatgtggtatggccaaattggagagagagaccaaggtttctacagcttacaatgttgatgaagaggaagaggaagatgaagatgaggagggagaagaagaagaagaagaagaagaactaagtagtaaagttccagaaaatatggatagccagcaactaaggacaaggaaattcaccaatgtaaggcatccagaaaagaaagcaagaaaaataattgaaacaattccgctagacccaaatccaataaatgcaggctctaccagcagtggaagctcattaacgaccccaaatagtcaagtagcgaacactatatcatatagaggaatcctcaataaaatgtcacctagggaacaactgaatcatgcaaatttagattccagtgtttctacagacatcaaggacactgaagctgtcaatgaacctctgccaatagggaggaatgctgaacatccggcaaatcaaccgcctctttcaataacacaaatgcaagaaaacacactacctgcgacacaagccaactcttctctattagaaacgtatcccattgttcaatcaaaccccgttacaactacaatcaaagaatcacccaattccatcatggcaggttgggataactgggaatctgatatggtttggagggatgttgatattttaatgaatgaatttgcgttcaatcccaaggtttaaagtccttttctttttttgccgtaatgtttacttaccctcgaaaaaatgttatgtaatgactgcggtgctacaggagaggtaaatgattttctatatacgtttatatttcttccatttacgcacactattttttgtccttgaataatttaactcaaaaaaagtgtaaaaaactgtgtcattaggtatatgttcaatacttttgatcttcaaatgacgtaaaaaaaagttttcagacggacttaaaccgccaaccagccttggccacaggtgtatgatgcgaagattcgtaagcgctcacgttagtcacatctcaggattggaaattatactagataataaatggctttatttaatcatattatagttgatataacaaatcacacctccgcttaatttatacgtaatagtatttacagtccttatgggtatcaagacatattaggttaggagaactaaagaaaaaaaaaaggactgtttgtgcaattgtacctgaagatgagtaagactctcaatgaaattagcacttttcttggatttctattaaagcgctagcatctttgtatacgtctgactgggtaaatttttgaaaggaatcgttattcatcagtctatacatttcattgctaacgatctcgaagaggggatataatttcctgaggaccttcaaagttgctggaaatgattcaaccgatttggtatcattttgggtgttgtccatgccataacgaacaattgtatgtgaattttctactgatgcattaggcgaatgcgtttctgccagagttaacggggcaggtttatattcctttaactgatgtttgaatccttgcttcttaaatgaacagttttcatttgaaagattttttgaaggttttagactcacttcaggtggttcacctaacgtgtcagcctccgttgagctaattgatgaagctgctgattccgcggatgcaggtgatggatcgtatagattagtaggaaagtgttccgataatggagaatgagggtgcaacatgatgtcagaaatattctgacgcaagttatgatggatatttaattgatatggtgatcctatcatgatataggacgaataaatgtgatatgccatttcaaggcactcattggcctgtttcattaaagctgaatcaatcgtttttacgatattgttttttgaagtactggtattagattttttatcacaatgcttagaatctatcaattttttcagaattgtcattttcttcaaaaacctcttaatctcaatgaagacatccaaattttctacacaaagttccttttctaaatggcgcctgaataaatatctcatacctggatcagttagcacatagtccagtttatttaaattactcgaagagataagcatgtcttgagaaaaaccttcactatcatccaatgtctttttttcatcacgaacagtcatatgaccccttaatgtgaaatctaggtctatggtgctaccatttggtgctctaatattattgctcttacaacctgtccaagaaaccaaatcccaaccacgcttggacaaggtaaaaaaagaggacctgctaatttgaaactttttcttgtcagtgcgtgatggttgtaaaagaactggtacaatcaaccccgtttttaaaaataacgctgccaacgagaccgcttctttaacatgcataatatcagtacagtccattatccactgccatatagcctttgttgtaaaggtgtacttaatcacgatttttttggaagtgccaaacgtcttattttcaaacaacctaatacctgcattcgaaacgtagtattgcgtgtgcgactcagaatctggatttgtaaagaatcgatgagctaatggcgataccctttctaagtcatttatatcgatgtttccaatctgagcttgccatccttgttctggcttagatttctcaaaagtaaatgtatcatcattattagtgtattccaacaacgaagataggcaaggtaatgggtcatctgcgtttgttggagaccaaacatttggcttagcgcccatcattttaatgaaaagaatatggatcaaataatcactatggatgattgaatccgtgacagagcttctctcaaaagtgaaaagtttcatggagttaaacgatgacaaaagaatatcaggcattgttttcaacccaatatctctaacatacttttgtaaaacagcaactcccttaggtgttggttggaaaagaactttctcttttggctcgccacgagttctgtcctgcggtgtatgtagtagcttagaagacataaataatgtaagaaggtggcgcgccaaactaggtttaatattatatgaaacgttaatacaagttgtgttcatatccacttttagttccaattgtcccattgctttaatagcttcctgatatgtaaaagtgaagtggaaatgtttagtgaatgcagttaataagaaagacttagtgtcactactatgttttttctctttcaaatccaaacaaattagaaaaatggaatatactgtctttaaatcattggtaaagatcagtccattcggcgttctgctgaaatttttggaagataattcatgcaacgtcctatttttatccaccatcttacaactctatctttaattaccaaattgaacctataacgcctcagatagtgcgtgcaaaacctagaaggaacgtacgacagtaacacctccaaagttaaaggacgatgagaagtaaagacagagctgggattatgatttcattcaccggtataaatataacaggacagacaacaattctaacgcaccagcaaccaaatccaagtcctagtcaaaaaaaaagcagtattgggatcattgtttcaaaattgaatattatgaaacgtttaaaacccagacatcccataattattgaagatgattcagttaaaacttcgcatacttcatggcttcttcattaatagagacaacggaggtggttcaacttgaacttttccaaaggagttgccatctctttgtattgttcgaactctttcaaaagaccttggtaatttatctatcatgtacttttcgagttaacttaagtggaagacgctggtttttcttaaagttataagcactatgtgggtaattttttattgtcagtctgtttctgatcttatccaacaattcatcaaaagttctactctggactataatctcagtgtaagcgttaaacaaataggtaaaagggtgcggaaagaccttcaaaaattcgaaaaagattgctaagttggattctttattattcaactggcatgtgacaagcgagttgtaagactgtaataacttgcttccggaatcaaaggtaaactttatcatttttttcaaatattcttgttcttgagcgcatgttaatatcggcatctcaaacacagtatattttgtgttgagtttctttttgagggatgtcgataggagagacgaaatgctaacgttatttgaataaatgaggaccttaaatgcaatgttattacttttttcaagtaccgataaaacattgataaattcggtaagcttcgaaggttctattatagttgaagtagataatttatctaattgttcgaatttgaagtagacaatatgatcgatactttcgtcattatttattttcctcataaccatcatcattaggtcagacgtgtgatttgaaggtttttcactagcttcgaaatctagttgtccgctatatgaagcctgccccattgactcgatacattcttttgatttgcttgattgaataccctctttcattaagtagtcattcatttctataattacgacatttatatcgactaaagacagtgtttctgaaactgcacggtcgataccagcatattggtgtatatgttcaactttgtcgaagaaaacgatacaatttttcatactcctaagattttttgaaagaaacttacttaagctcggaacgtagcttattgacaaataattggtgcctagctcttgcaaggccattgatttgaacttctggtagaaaacatggtccactcgctccttaactggactcggcttacacacctttgggctgctaacactttttttaattggaacaaggttcaactttctcagtacagtaaaatttttttgctccaaatcatcgcttattgctttcacaatcttgtcactgtcaacaacctttttcgatctccttataggtgcaaaatcggaatctacatgctccattgtctctatatactaaccacgttcgtatttatatctatattcgtacatatattgttctaacttattgaaattgatggttaagaagatcccttctgtacatatctgtaagcgcaatgttttcttcattgaaaacagctgcaaaattagaaaactaaaataataactttcaagataactaagccgggttgccctttgacctagaagcatcccttataataacattatgtgtatgaaaaccatgtcagcaagaacggttacggatatggagtgaagcaaaatctttaaggatttatttacattgaagaggaggaggaaaaaagagccataaggtaaaattcaaatgcataaatgaaactgcccttccttttatacttcctaacctttgcaggagaaaaatatattaaggacaaaagaaaaatagccgctatcatttccaacgctccgggaaaaagagtgtcatagagaccccttatctattttatcatttttaatatgatctattctggcataagtagcttcggatcgattaagcgctattacaattgaaggagtaacaaatttttgggtgaagtttaccaatttattcaattgatcaaatttatggaagatcctcaagaaaaacataaaattaaaacctttatatccagagtttcaaatttgtcaagtttttgttcccgttcactcttgttctgcatatttttcctatttttttggcttgtaactcaaacatgaactacatcacaaatatatcacgttacacgggaaatatacttcccattgcatggaaattaagacggaaataagggagacatgaaaaagggtcttggtggtgttgcagttggacaattaagccattcaatgcgatataaactataaatcccttttaaaagggcctagacatctcagagacaaagaacggtagctattacaaaggacagtaaaagcaaacagctttaaattagatcagaacataagaatccttagaaaagccctttacctcggtatatgtagatgatgtttccgattaatgttctactgtacaagtggcttatatttgcagtgactttcttatggagctgtaaaattttactaaggaagcttttaggaataaatataacatggattaacctgtttaaactagaaatatgcggtttatccttagaagatggtaccgtcaggctaaaatccgttcgttttgctgtatttgaaagaaagcttttcatcaagggtctacgaattgattccaagaaatcatctactaatgatcttcataaagaattaccaagagaggaagaaagaacttttatagagacccccgaagataatggtgggggcttcatttctaagattctttcattatcacaatactggctcaatggggtcacgatcattttggaagatacgcaattagtcaacaacgatatcacgattgaaaaatttggcttttttctttcaattgataactctaaacatatcaagtcactaagatttgattcctttttgagaaaacttctttggaatggccagaccatcattgctgatgccatttttatagtgaatacaaacttactaattggtgaaattatgaatcctctgaaggatggacttcaagtaggattagatttaaaactaggtgatttaaatattcccatgaatttattgaatttatttatcaacaaggagaacgttgatttgatgtccaatgaaaaacttctacaaagattggcagatacaacaaaggcgaatgaagagctaaaggatgaagatatcgctaagatgaaggatgatctcgtgtatgcaatggaaaaatttgtagatcggataaagccattgaaagaaatgaacgtcaccgttgataaacttcaaatcaaagattttccactcaccaatcatccagaactgcttggaatgaacaaatatatcagttataatgttttggtttctaatataaacttcaataccaacaggttcagaaatgagatgccaggttatacgttaatttttgaggagcgtgattctcccttcaagtttagtattataatggcaagatttaatatatatttgaatctaaatcgaaaacatcaaagccacgccaaacagttgaaaattattgaaattccaaatgtttcgatatttggcgaaaccaatttgttctctcaaaaatttcgtctttctaataacctacacgcaaaggaactagagaacgctatttttaacatcaaaggtaatatatcctccttaactattgacatggatccagtaaatatttcctttatcaaatgcttcctatcaaacattaaagtctttacgtcctcttgtccgaaaaacaagattttaaaggagaattctcatgtaaagttcttaacaaggcggagagtcctatttgactattttaagtgttttttgcctctaatcaatatgaaattcaccctggatgatcccaaatttgttatcaatgataaagacgatctgatcataggcaagttttctgtcttcatgataagccatcactctaaaagatatacattgggtaacaatcttatggaagaaaaagaagagacgcaacacattttttatgaaagccattggaatgttgaattactagatatgaaattacagcatattataaaacatcaaaaatacgagcatacaatattaagggtggacagcattgccatagaagaaaaagttcaacttttaccggatatattatgttctgcaaacgctgatatcgacacgctaatgctagatttatctgaacttccaacaatggttatgttgagtgaattagtacacaacttagatagtcagttggcaaatgtcgaagagaattatttcaaagagttctatgaaaagttcgcatctaatttacaaaatatgaaagctgaatgttctaatatggctaaatgtttgagacagaaggaaattttaccaagcgacttcatgttccagcaactacctgattttttcgattatattaaaatcaatattagagacatatcatccaccctaggtgctaggtcggtttttatgccaagagatgttttctcttccgttgactctcaaagttcaaaggacctaattgatggcaaactaagaaaatactgcaatacagtcgaaaaattgcaaattgctttatttggtgacaagacacaatggcataacaaaattggctcaaatcacgctactatggttaggtctggtcagctcacaaattttagtaaagataataaacagaatcctaaccataagtccagtattgccgatttagacgatatatcgactagtgatgcgacagaggtaaatcatctttggaacatcaacttactagtaaatgatataactacgtcaataatcggagagacacccgaagtgagcgaagaattgtccactaaaactgtttccaaagtttctaatttatcaattaagctatttccagacactgagtcatttagtagcaatgaaagcgattcgaagataattttgcaaataaatcactccagaggaacatcggtagtatcactgatgagtatctttttggccgtctcaggaatacacacactgaaccaaatatttggacattgtatacaccaaaagatgcgacagtctaaaactaaacaatactttcttgccctctcagaatccaaaaaaaaatcatgtatcaaaagtataaaatggggccaactaaaggagttactcgaaataaatttctcttctgaatatatcagccaaataatcgcactcccaaatggccttagaacaaaatttgaaccaacttcgacatttatcacagtcaaaaactgtaatacaatttcagtttcaggtcagtacttcagaatgatggtagaatctccaacgcagccaaacttttgggagagaatgatctgtatcaatggatttaaagtaatgatacacattgatttattaaaacagcaaatgaaaaagttaaactctttacagaattgggaaaaattaccatccgccataaccttagaaaatgattcatggcacttttccataccgcatcatttcgagatgtttaaaataatagattctattccaactatatttaagagtattaaacaaatgttatattcgttgaaaacatcaaaagacgatttgataattttcccccacaaaatagagactcctttatcactgccaaagattaaactgaaatctaaaaggtggttatttagcatttctgatgatccactagaggcagaattgaatactatctttcagatcggtttacaagaacaacgggagagacttgcgaaattacaggaattcaataaacgcatctctgaagatttgattaaaagtcaaaagaacgctaaagaaatgaaggacgacttcgaggcaattgataacgcaatactaaagcaccgtacaggattgtgggcaaaggatgggaaaaaaagattgcgtaaatccgcaacagattctgaaatacctcttaccccagcagctttgaacattaatggaaagcgtgatgacaggcctgatagaacgcagtttatttctcccgagattgaaaatgcgtacaatactttattagcgaacttctccgattcatggattaaaagggtgaaagaatataaagttaaagaacgtcgtgagttcgataagaacttttctttcttatggggtttcattgattatactaagctccccaaagatattaacaaaaaagttttacctttctcaacaaatccttttttaatgaatttgataattgagaatatcgatattgatataataaggccttcatgtggcattgaaaatattccaaacttcattcacgatgttggaaaaggcgttccgaagaatacagaatattcgattatgattccgatgcatttagatgcgaaatttagtgaagtaagatggcatttgagagattatcccctgccttttgttagtatacctccactaagctctacacaaagtaaagaaacaatacctatgagaatttatggggattttatgataacagaggatatgcttcaatccgacagagagcttagaactttatttgttcctttaataccatcggtaactgttgaaaatacagatagatattactcgttgttcgtgcccagaacaatgactagcgctaagatattcaccgatctaaattttgaaataaactctaaccatacaacacgagtaacttggggtggttcttatcaaccagccattcaacaaacaatgcaatgtttggataacttttcaaagcctccattagatccttctgttaaactagggttttgggataaaacaagatatcttttccatggaaagatcaatatagtttggaaaaagaggggaaaattcgaaatttcccttaaaggcgcaaaaagtccctatatgcttggcggcgaatcagctggtttcatagttggttttgatggtaatgttaacttaaaatgtaacgaagataatgatcccaaaaaatttttatcctgcagcgcagacaaggtccatttcagcattcccaattattttgcaaagccgttactggtatggtctagacctagtaccaatacaatgttcattccaaaccaggacgatacgaacatgcagagatatgcttcattttactatttattgaacactacatcaagtaaaaacgaaaaagcagacaaggaaattatgggaaaatcgttcattgaaaagacaggaattaaactatctgggggtatgacactggatatgggtattctcttcgaaaggttggggcctagtttgaatgagagaacttttgagtccaaaaagcattatttgactcgtctatgtaacccaatttacgttcaagatctctcaaaacatgattcatatgctggctttagaagtgactttatacatatgtctttcgggctatcatctaactcaaactccgcatataacgctatgcaactaagtcccaacgggttcaaggcattctttgtttggtggaaatcattttcaggaaactttcccgtaaggagagggccattatttggtctccaaagtatcagtcctaaatttggtgaacatttatataccatttcttaccacgcagatgtctcaccattattcattaattacatgtaccacaacgctgatgccgatcaaattttgcgtaaaaactacttagaagttgccgaatttgctggtttaaaggctaaatcttctcattttattatggatcttcatcaaaggaaggaagtattgactgaatatcaagccggcttgaacgtcagaaggagagttatgaaattaaaatttctggctggtgatgttgtatgccaggacgtggacatccggactgtaagtggtgagttcagtaaattaaactacattgaagagaaagaggatgctgaatatgatatttttgataatgatatgtcgtggcttgatataacagattttcaagatgcatttttcattaaccctgataattatcttccaaaaattaagattatgccatttgccttttctcctcagttcgcttatcaaaaaagagctagttatggtgacaaataccaagttgatccgaaaacatgcaagccaataacgccgtttgataatcgtgtctcccatggctgtacactagggcacaatgtttctttacgtactgacctagttgagaaacgtgttacagttttgaagaagtttcgagagaaattgcaggagggtattagaaaaaacaaatcagccggtgtatcagaggagaatttgaatgatttactctcaaaagcaaattctagtgtggaaaatgcagaattactactgaaagacttccagaagatatttaaacaacatgaagccggacaaacagaacagcctttccatttcgactctttaaatctattgaaaaacaccaaaaagaccctgaaacaatttgaacatagattttttatttttaacgtactgttgaaatggaacgaggacgcaagaagtgctattttcaaatttttttactatgctaacctatccaatgaatttgcttctttagcaagtggcaagggcctaagggaatttgaagatgtaataaagcaaagagaaatgactgatgatacaacgagtatggaagcgataccagaaggaacagacaaagcaaacaccactaaacaatgtcatagctgcgatgatacagagttcaccactgagaaccttttgaatatatttgaaaaaaatattacacaactgtcttgtgacatcaaaaataagatacaccataagttttttgtccaatttataactccacaaattcagttgacatccctggaaaatccagaagcttgtgttttggtttcttcacccttttttatgctaaagacattggaatttgatgcaaacactaccagtaacacgtatatgcaagatatttttttgaaaagacatggcattctattcggaaacgccaatgcctttttatttaataaaaaggattaccaagagttttttgaactatacttcggctccagctcatatggccaagataaaaaagaacagtggccaccatggctaggcttggagttaggattcgaaccttctgcattaaaaaagaaagcagtggttaggaatatttctgctctgcttcatcatcagaaattagcaccgttttctgctaaatatgactccttaaaagataaaatagaagataatatttgcggatacgttcctcaagttaacgtacaagtgaattctgacgagtacctaatgctgacgaagatggccttgaaattattcctttatgtagaacccgaagatgaagaattgaagaaatatattgaaaaactaattattggttacgatatctatgatacagcccaaactagaaaattcgtaaatgatttacacgatagtgaacaaattctagctgttgttgaaaaggagcttttattcaaaagaagcctattggacgacattggaaaactcgatctatccaatattcacaacgaacgcatgcatcagttgttgaggttgtatatcttaaggaaggttttcacttcaaatggaaacaattacattaataggactttagtatggaatatcaaggttaatgaaactatcttgcatttattagacaaaattgacaaaccatttttagatattgccgttgcaaagctaaactttcaaagaatccaacacacgatgggattaaggaagaacactgtaaccgtaaaaatgatgcaaatatttgacttaggcgaaaatgttaattatcattgtattttagggcctttgataacatcaagtggtaatgacacagtcggtttggcgagtgatgttccgttagttcaaataacttgggatgttgataagcctgtaggtggtattaaggttgttaaaaacgttgagaccactttgtcgagtttgacgataaaattagaagaggacagactaaataaactttttgagtggttatcgttaaaggagttaatttacgatggaaacggagatgacgatgatggagcttccagtatttttgatatggtgtcatcagaatcagaggaaggaaaaattgagttttcagaagatattagttctgatttcaatgaaatgttaaagagatcaagtgattatatgatcgttgaagatcttaaattgaacagcttcaaactttgtatcagttataagggcaaaggaaagatgagattggctaacgttactaactttgttttcaatttcccgactttaagattgtccaaccaaactttgagggtcacagatctattacttgcccttaaaaaagtgttaatcaaggttttaataaaacatactgggagatttattggtaataaattgaaaagaaattctaaggagaataaaattgctgacgacacttcaccactgaagcaactcacaacttataattcctacacggagcctgaagaacttcgttaaaaacattcaaaaaaaatttatagtttttcatatctcttaatgtagcatcatacatatcaatatgttaccatgtttcagacctttattgctgtactacattgaaatacctaggattcgaagaacaaaaaacatcatataggtcttccattagtaatgcccattatttacttaaagtaaaaaaaataatggtctctagcgggatcgaaccgctgatccccgcgttattagcacggtgccttaaccaactgggccaagagaccatgaaaaggacgtcaaaacaaggtcacacgaaaaccataacctgtagtataaatataagacatctcaagcacttgttattaattagggaaatagctaacagcatttgaacgataactaaggcaaacaatcctcagtagtaatcgttggaaaaaagatctgagaactaggtgaattttgtgataattgttaaaattccatagttgataaaggcaataacattatgtatgcaggatatgctgaagttcttctcgaggacatatgaatcctcaaagtggaatcggtagtcctgcactataatattacaattatttttcctttcgttttatatgcttacttatcctattacattatcaatctttgcatttcagcttccattaagtcagatgactgtttctcaatctttatgtcgtctttttataccgcatatgataatacacttgtaacatgaacactggtcaatagatgatgatagggtttcgttccaacaccatcacgttatcaattctttcgtgtcaactcctcatttacgttatactctttacattgtgtatggcagtatactagtagtgagaatactagtcaataggttataattgatttttattttaacaagtaacatcttcggaaaagcgactactattcaactaataatcatcaatttttacttcaagaaagcataataacgtctgcatttatgtgtgagcaggactgagcgattctgagggcacttgtattcaccaatttgcaatagctgatctttacaatctgcatgttccgataacaaaaataacttgtaggataaatcctcagagttacatcggtgtgtcagggaatgaacagataaaagaaataacgtcgcactgtaaagtgagtagcagcaaaattaaactattcggacattttaaaaccctatcagtcgccttggatgataaccttatttcaaccacctatcaatgaaaatggcttaaacttccccaattaaaaaactctgcaatagcgtgttgatttcttccagattgatagtttggtacaatacggaagaaacaaggtctctctccatttacattacggtaagctgttcttaattgaactttgaaacatccaatggcgggtaataattatagtatttttcttttctattttatttatttttttttttttttttgattttctagaataatcaatcaatggtaaataaacaaaagttgcttctgttgtaaaaaatacatcaaaggggctaaaatatcaatatacgtttcgttaagttctgcagagagatttggacatatctatttttctctcagatatttgttattgcatattgtgagttgactactggtaagcttatattggaagtttcacaagcattcttttaggacctacagtcgttgctcctcctggctttttttcccttttatttttttctgtttttacttccatttcttttgtgatattagctatccctggtttggtccgcaagtttatgacaaaagatattagaacaggcgatttagtgttatgcaaagttggctcgtttccaccttggccagctgtagtatttccacagcgtttgctgcgaaacgatgtatatagaaagagaaaatccaattgtgttgctgtttgttttttcaacgatccaacttattattgggaacaacccagtagattaaaggagctagatcaagacagcattcacaatttcatattagaacatagtaaaaatgcaaaccaaagggaattggtcaatgcttataaggaagcaaaaaattttgatgatttcaacgtatttttacaagaaaagtttgaagaagaaaacaggttaagtgatctaaaagcgtttgagaaaagtgaaggttctaaaatcgttgccggagaagatccctttgtaggtcgaacaaaagtagtgaataaaagaaaaaaaaattcaatatccatcaaagaagatccggaagataaccagaaatcaaatgaagaagaaagcaaaccgaacatcaaaccgtccaaaaaaaagagacccacagctaattcgggaggaaaatcaaacagtggcaataaaaagaaagttaaattagactattccagaagagtagaaatttcacagttatttcgccgcaggattcaaagaaatctaatccagagagaaacacctcctactgagcatgagatcaaggaaactcatgaactattaaatagaatatatgagaattctgacaccaaacggcccttttttgatttgaaggccctacgcgaaagcaaattacacaagctactgaaagcaattgttaatgatcctgacttaggcgaatttcacccactttgtaaagaaattttactgtcctgggcagacctaatcacagaactgaagaaagaaaagttgcaagcgctacctacgccttgataataatacttattgaatcaattcaatatatcaacgtttcaatatccaatattgtttcatttcatttcatttcaaataaacagtgttttaccgtttgttttgtttcccttctttttttcatcaaatggtaatattaaattgatttaattatccatccataaaaattgtattaataagtcatacacgtaatgtcacaacaaaatatcaggcgtactcttgtgacgtaccaaagcgcttagaaacgataaaggcccgggacagaaatttaaacgtcacaagtgggtgcagcccagttaacactaatgttaacgcacttctagatacctcatatatataaatattatctagaatttcaaatttgatattccttttctatactgaataaacgataaatacgaagttcagagtgcgaaaattagggttgcaggcgtctgatctgaaaaacgtataattgatagtgaaaattatgcaacattctgcaaaggaaagtaaaccttaaaaaaacaaatctctcaagcctttaaagatgaaactcaatgaacaaataccaaaagacctgttacgcctgattaaaagttccaagtatgttcatgtggcgacatgctcgtcaaattgtataccatctgtttcgttgatgcattacatatttgtttcatccgcggaaactttccataaacatgagtatagtatagaaatagattgtaatgactatattatattcacagtgttcgagaaatcagtaacctttcgtaatgtcatgagcaacccaaacgttgcattgctatttcacgattggatcacagctaaaaatttaactcttcgaaaaaaaagcgtccatagtaaagatgatttttcatttgttgagtcagagtctacaaaatttaacaactttttacgagatttgaaccaaagtgaattgaatcaagtgagcgctactatcaatggtattgctgatattgtgaaccctaatagtgaagaatctacttattataggcggttgttattaacagtcaatccagacgcagatatttttatactaggagaagatacagccataataaaggtaaatatacaaaaaataaaagtctctgacatggaaaataatacttctacatacggccaaacagtacaaccagtttaacggaaatatgatgaaaactatgtgtactctaattattatataaagcatctataaaatgaatcatgaggattaggccgtgatcttcgcgctccatatatggagaatacttttaatttcacaggagaaattaagataaataacttgaaaagtccactgagattggtgaaagtgtttcatcctctttttcagtttcccttgaacgatagggtggagtgggacaggcgggagatatgttttcctgtaacggctgcatctctggtatatttccatcccgattatatgttttcatggggctggaagtgaataatgaattcgttcttcttattggagacggggaaagatcaattttcaagggcttaatctcatcgttttctctagctagattagacatggttctcctagatttggtgtatgatggatgaatgtttgaagaatctagtaaatcctccaaaatcctgtacttctcatttgagtaattcaatgcttcttgtaatgattgtagcttgctttccaaggcttttattttctcatctcttttcttaatttgccgctgtagaagaatttctctatctaagtataatgattgatttctatcttttccactcgacccgtcagaactaccacttcttagttcactgatccgttgcttattgtatttcaactccgatatctttctcttaaaggcatcactccttaggatcctagatttggctgtatctgtgtccatataagaaggtcttccctgggatctcttcttcaaaattctagtcatgtcgccacaaacattttgcatcttgctcatattttcattatcattggaaaaaacatctctgattgtctggaatatctttgttaaccttcgtttgggtgttttcctcctgttagtacgaattttttcttcagttttcctatctgtcacctttctaggtctttttagaacgcttttacccgtaggacgcatctgctttcttctgctccttaaggcagatcgttttctcacttcatcaagggacccgtattctcgtttcctgccatcatctcgtattccaaaaaaatctttccacagtccctgtacggattttagcatattaccaatgtctattattgtacctttctcttcagagtatctacttgttcatgttcagcaataatttcataattgttgatgcgcgcatcgtttctatactatgacgcgtcacgaattgtgctagagtggcctctaatgaaagtataagaggcgttggcgaaggtcaaggatagaccattggctgtttcggatgagttatttttaaagtgtaaaggtataacatcaaatgaatgaaaattaacattgatctcagctctcaatttctttcctcatttgttttcgatgtttctatatgagtatacattaaacaagtaaatctcaagctcttgtcaaaacagttatttccaacatatctatctgcattattggtagcataattctcaaaggaagctaaaacatccttcttaaagacgtctattggcaaacgatatgttacgtattccgggtaaaacaaatattccattaagtgaaatgacctttgttttcaaaactaaccagttttagaacagtaattcatataaacaacgtgatcttatatgaaaaactcaccaaaaggagaccaatggattccacagcacttaaggtagctctaggctgtattgcaattcgtttggctgtgaacagcctttttccctctctacaacaacaactggaccagtctgtagaattctcaactcccgtaacttcatttaggtcactacaggaaggtatatacctactgcggaacaacatccaagtatataatcatggggttgttcaccatcctccaattttgattttttttctttccctctttaattccgacaggttaatttccctcatatacgctttaattgatggattaattgcgtatcagctgacagaggtaacaaaggctttcaaaaacttgaaactgaaagtttggctacctggacttctttatgccgtgaatcctttgacccttttatcgtgcattagtcggtcatcaatcatattcacaaattttgctatttcatcgtcattgtattgcatattagctgaaggaaacgttcttttgtcctctgttatgatttctatatctggatatttgtcagtataccctattctcctcttaattccgctattaggtatgctgaaaagttggaggcaaagaatattatctgccattgtttccatactatctttattaattctgctattattcagctacagtatattaggcagccaaagttggtcatttttgacacaggtttatggatctattataacctttgagaaggtttttccaaatctgggtttgtggtggtacttcttcattgaaatgtttgacaccttcataccgttcttcaaggctgtattcaacatttttattgcagtattcattacaccatttactttgcgctatcataagcagccattctacgcattcattttatgcattgggtggattgtccttacaaagccatatccctcactaggtgacgctggttttttcttcagcttcctacctttcttcacgccactatttggatatttaagataccccatcatatcagcattactgtttttacacgcaattgttttggcgccaattttctatcatctttgggttgttttaggttcagggaatagtaattttttctatgctatttccctagtttatgctctggctatagcatctatattagttgacttgaactgggcgatgctgagaattgaatacgataacggtatcccaaatttcaaattgaaggtaacacaaatttaactacttcccgtctataaacgtacataaactagaataaaaagaaccatacagatgttcatcgtaagagtggataaagcgaatatgagagccatattggttattccagaggctatctattttttaagagaaactgcttggttaaaatttgcataatattgtctcggagagaaaagatagaactcagaaggacctaattaatcatgagcgttataatacgaagaattgagatagagtgtatgatctgcggattaagctcctacataataacaacattgtacttgggactatgccaatttctttcccaccaaaagtcgtatgaaaaaggttatcttcgctagggcttccattaggtgaaagccaatatattatcatagaatagcacggcataaatatatattttgtgctgtctttttgggaagggtagtttgacaacccatgtacattaacataaaaagagctttatcattaacggacgaagaaagaatgtgtatcgcgtatttttagactatcgataatcttttttaaagttatggtagatagaagatggaatcagttacgaagtgatgagttcccatacattccagcctgtttacattagctaatttaaaaaaaaaaaacataattagaatattacgtgatgactcagtttaaacggtactctgtaacacatcatttctatttgttgttctaaaacaggttctacatatttggatctgctgtgagaatgacctaaaaggtaaaactctctttgtaataatccaaggaaagtgggagttccttggggaagctctattgcaatatattgtagtttccattcagcctgcttatcgccttaggaaaaaggaatgtaagaggcagaaaagtgcggcgcaatcgttcggacagcgagccgccattataggtaagaatacttaaagagcttcgccggatattattacagtgtattaaatttcgccaagtctttgccaatggaaatgggtgcataaatttatgtgcttggtacatatgagttcaatagatatgtagtagttggatagtagatagttaggatatataatcatggaagggttactcacaacgaatcacataatgagttatgattttcactgtgctcatctgttgcccctacaaggggtgatcaataacaaacaatttcattaaaaaaaaaaaaaaaactaagtcactataactaaacgtaataactatgtatatgaaagaaaataatatctgttcgtcatctagtttaatacggcaacgagtttttcaccagagttcttaccatatttgatgtcttttaggatatgaggaacatcacaaagcccgttcttatagacccttactggaatatggcgaatttgtccatcattaatctttggattgatgaatttgataaattttattgcagctttcctagcttctgagtcggctggtaaagtaatgtttccaaatggtacttcatggccacctattgaatatagccttattatgtcaatagtaacgttttgtctcctgttctcttttttgacgttttcttctgtcaaattttttaattcaacaattgtagcatcctgtttatcggccgcacatttgtacacttgttgaagcgtatcttgattcgcgacacagtcgactaaatacgagatattgttgtacttgtgtttaatttgttctaccacgtcaatatcatgataatcaaataattcatcagcaccatattctttcaaaagtttttcgtgcttccgagaagccacaacaatgatcttggtgaagccattcaatttattggctaattggatgagcgactgacctactgcagttgcaccgccccataataagatggggccttttctttgtggggttgatggctcccacttcaggtccaagcccaagttataggtcaacaccaagccggctgtggtcagtgacactgggatagtggctacaccttccaaagacctgacagggccggcaggtagaacatcctcacccaaaaatttgagttcattgggtgatttgtaggcaaccacagttgaaatagcagaatattcagcaaaagcaccattggaaggaaaccttacggaagatccgtgaatgaacccataaatataatcaccgatagaaaagtctttaggattgacagctgggcccaatttgacaatttggccagcagcatcacatcccagaatagatccttgaggcccgatcttgtagtcaatgtgtgcccaatcagtggggttaccagcaacagcgagtgtcttaatcaatacgaatccttcttccaattcaggaatgggaatgccctctttaacaaccgctttaccgtcttcaatgacgacagccttcatggtttctggaattgcaacttgcatgtttgtaggttatctgtaattgtcgttgataatctgtattcagcttgccattttatagaatatggttagaaagatcttaagctagataaagaaaaagaaaaaaatagaaaaaagcctgcccgctttataagaacttttctcaatatctgttgaggaacacttagtaatatcgtctatcatggttgctttattcttagtgatattactctctgggattcgatgtgttctcatcatctgaagggttttctatgtgttgaaagcctatcccactagacggagccgcgcgtcagccgggcggatccgagacatcttagtcagctgagacaagaaaggcacagctctcggacaggaactgctgtcatatgaaaacctaaaaatgtttcctggaaattccatgactgcgcaaagtttgatacgtttattgttcttctccactaccgcactttctatctcggaaacctttcaactaaatgaactattgttaattgtatggcgtgtggcctttctatttcagaaaatttagagtaaagtaaactccgtcggactagtatagtaatgaaacaagccattgactctgcagcatattgcgaccaaaacctggaaattggtggctatgagttttaatttataattatatgaaaacaaagcttggaatgctgagtactttttcttcaatgctgctcactgcccagaagcgttcagaacaactctactggagccattctgcttgaaggaggataaaaatgccaagatcaagtcttttaaagattctatcccttttcatcgaagaagcactacaagtttattttacagaagttgacaaactgtggaacttgatccatactgaataagtatggaaaactgttaacttagaggatgctctgctttctaaagaagtttcacagctttagactcacatgggttctcatgagtattgctagctagtgcgagtttgatctatacttcacagacttttaacaccccgttccttaagttttccctgattatcaagggtatttccaattcttactccccactatcgctcctttcttatctgaattgtatttttgagtggcctaattgtaatcttttattttgttttctaattattgaaggcggtttctcgaagcatttcacgatttccaaaattcaagaattgaaattatgaacatagaagacaaaatactttttttatcaactattaatacacctttcctagagaacatttttaaaataaaataaaataaagtagcgctctctactacccttacacttttctccttcatatctggctagaaaagagggattacatctcggaatcaaatatttccctctgtgcaaagttttaatactgctactacgaactggttacaattttatttttatcatacacgatactttgaacatcaacttctctcaataccatccgccttcagcggctacaattacgtaattgcaccaaggcattcgccgagagttcacaaattgcagaccctaacagtatacgactcccaacacacgtttaatgttgtacgaattcaagagatagaaatgcttcttccgcggaagccgtttaaagcactgaaattaggcttagacaatagacttctgtacgagggtccaaatctaaaattcagatattctttttgaccgaaaacggaaatcacaggcgcgcaaaagggtttttcaaggtaccccggcatccctataataggcattcccacattctgcgcatacgaatacacatgagtgccataaaacaatactccacatacgaagtctatgaaagatgtatgattcgttcagaaacaagagcatttccatactgataatgagattgtgtgaaagatgagatatggaggatatgtgaggtgctaaatgagcgtctgttaacgaatcgtttaaatagtgatgactgatgaaggcatgggtataaatagagctgcttcaactgtatgcctttgagaatatgtctttattcctttctttcctgttaagcttatatcagcactaacaaacaaaacaaatacaatggtcaaattaacttcaatcgccgctggtgtcgctgccatcgctgctactgcttccgcaaccaccactatagctcaatctgacgaaagagtcaacttggttgaattgggtgtctacgtctctgatatcagagctcacttggcccaatactacatgttccaagccgcccacccaactgaaacctacccagttgaagttgctgaagccgttttcaactacggtgacttcaccaccatgttgactggtattgccccagaccaagtgaccagaatgatcaccggtgttccatggtactccagcagattaaagccagctatctccaaggctctatccaaagatggtatctacactatcgcaaactagggacgagtgcctctacgaatgaaaattcatagacagtaaaaagtaatgaaaaataaaataaaaactacttttttttgatgatataaataccgtagattatataaatgtatattaatattataaacctatttgatcaatgacagtgttcgtgaagcattttatgaatacgataaacataaaaagaaacttttacactattctagaaaaagggtggatggtaataaagctaatagagtatgtccaataaacaataatgaaattggaagcgcatgacttctcagcactttgtctttccataaaaatgagtcgctgcttcttttttcattttttggcgcgtcgcgtcgggccgtatagaatatgcgtcacttctaagaacaagattgcagatcagggcagtgcgagttacggagtcatggtatcaaactctcatttagagaccctcattttttgacactgaaaatatcaaaatttctgggttgcgatagtttttgtgtaaccgtaaccagaaataaagctgaagggttagtgttctatcaacaataagatagagggtggtaagatgaagtgagacaatatcgtaacgtccgtttcagtatacgccgctgataagttatattaccgtaaaattatttgacatttcgttatagatcctattaaataacgtacctatcacagtatcgtcttgttcagatatagtctcttcgtatgagtagtgtcacatacaagattaaagatgcatcagttatgcttttaggatattgcggatagcatatgggaatggaaataggatacaattttatcatagcacccgcatgagtgtcaacacagtaccatattatagcacagtgaatggagagtgttacgacagtgaggtagcatattattctaatgtatggtctgcataagtacgaaatattctgaaatggcatccgttcaagcaaactgcaatattaaggaacttttacgttaatgacgtcatggtagtgttcatactccaagtcaatatgtttttgtattattgttgaagaatagaatatttttatgtttaggtgattttagtggtgatttttctgtaatattggcataagtgtatttaaattgagtggttagtatatggtgcaaaagtaatataacgtatgtattaagagcatttttacaatattcgaggccactgaatgagatatagatattaaaatgtggataatcatgggatttatgggtaaatggcacagagtatagaccgctgaggcaagtgccgtgcataatgatgtgagtgcatttggcactgatttagtgagagatgggccatggagtggagtggaatatgagagtagggtaagttgagatggtatatactgtagtatccgtgtgcgtatgacatatcagtatacaagtgaaggtgagtgtggcaagtggtggtgatggtatagagtgatagggtaagtatatgtgtattgtttacgatcatttgttaacgtttcaatatggtgggtagaacaacagtatggtgagtagtagatgggagatggtagaggaatggcagggtaagtggtggcggagttggatatgggtaattggagggtaacggttatggtggacggtgggttggtggtaggaagtagagaggtggatggtagttgggagtggtatagttgaatgagacagggtaacgagtggggagtagggtaatggagggtaagttgagagacaggttgatcagggttagagtagggtagtgttagggttaggtgtgtgtgtgtgtgtgggtgtggtgtgtgggtgtgtgggtgtggtgtggtgtgtgtgtgtgtggtgtgtgggtgtggtgggtgtggtgtgggtgtgggtgtgggtgtgggtgtgggtgtggtgtgtatatctatgtcaccttattgcatgctggatggtgttagacaaggccgtagggacatatagcatctaggaagtaaccttgtacgaaaataggcaatatttcctgtttgacgcagattttagcccaaagatctagcgtcaaggaatttttttatagtgggacattgcaaaccaaggaagtaacttgatacgtcgttggtgaatgggtctgttttcttattcggcggggtaatacatttttgggggaagtttgtctgtctgacgcgccatatgtaggtacgccaaaaagggctcctctacttcgaagcgcgaggtcgtatacctaataaggaaatgtaatttataactttttattatattggtcttttcgagagcggaacgtaggtccatgtttaaagtatccaagagaatatccacgaagcggctgagcaacgaacagaatcctggttctcctcgactaagcagatagttaagatactgtgcaccatggaaattgaaaacgaaagtacgtaccgactactttatttttgcaggccggaaatcaagcgatgaatgagacatccttctgttttctatgttgtgcttgaaggggacagacagtcgcttatcttagtgagattttgtttgcttttgctgcacctgcatagcgcagattctgcatcttctcaatagcttaattattacattcttagatgatgataagacgaaaactggacaatcttttgtttatattgatggatttcttgtcaaaaagcataaaaatcaacatactattgttaatttcgaaacttacaaaaataaaatgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaagttgtcatttccgtcatggtcgggaaaaatgtaaaaaagttcctgacgtttgttgaagacgaaccagatttccagggcggaccaatcccttcaaagtatcttgttcccaagaaaatcaacttgatggtctacacgttgtttcaagtgcatactttgaaattcaatagaaaggattacgataccctttctcttttttacctcaacagaggatactataatgagttgagtttccgtgtcctggaacgttgtcacgaaatagcgagtgctaggccgaacgacagctctacgatgcgtactttcactgactttgtttccggcgcacctattgtaaggagtcttcagaaaagcaccataaggaaatatgggtacaatttggcagcctacacgtagatgagctatgcaagcaagtttacctggcgaaaagaaagtcgacacagagcggctgaagcgtgatctatgcccacgtaaacccattgagataaagtacttttcacagatatgtaacgatatgatgaacaaaaaggaccgattgggtgatattttgcatattatcttgcgagcatgtgcactcaatttcggggcgggtccccgtggtggcgctggtgacgaagaggatcgatctattacgaatgaagaacccattattccctctgtggacgagcatggcctgaaagtatgtaagttgcgcagtcctaacactccacgaagactcagaaaaacactagatgccgtgaaagctttattggtgtcgtcttgtgcttgtaccgcaagggatttagatatatttgatgacaacaacggcgttgcaatgtggaaatggatcaaaattctgtaccacgaagtagcgcaggaaaccacgctgaaggactcttatagaataactttggtaccttcttctgatggtatatcagtatgtggaaaactttggggagagttgaacaactgcttccatatgccagcctcattttgcgtaatcgagaagttttgttcagagaaccgaagcgaggaattgacgagtatctggaaaacgattctttttttcaaatgatacctgttaaatatcgtgaaattgtgctgcccaagttgagaagagatactaacaaaatgaccgcggctcttaaaaataaagtcgctgttgcaattgacgagcttacggtgccacttatgtggatgatccattttgccgtaggatacccttaccgttatccagagcttcagctactcgcttttgccggtcctcagcgcaacgtatacgtcgatgatacaacaagacgcatccaactgtacactgattacaacaagaacggttcatcggagcctcgactaaagacgcttgacggactcacttcagattacgtgttttattttgtcactgtgctaaggcaaatgcaaatatgtgcgcttggtaacagttatgacgcttttaatcatgatccttggatggatgtggtgggatttgaggatccagatcaagtaacaaatcgagacatttcgaggatagttttgtattcctacatgtttctgaataccgcgaagggctgtctggttgaatacgcaacttttcggcagtacatgagggaacttccgaagaatgcacctcagaagctgaattttcgggagatgcgtcaggggttgattgccctaggacggcactgcgtaggtagcagatttgaaacagatttgtacgagtcggcgacgagtgaactcatggccaatcattccgttcaaacagggcgaaatatttacggtgtggattccttttcgttaactagtgtcagtgggacgaccgccactttattgcaggaacgagcttccgagcgctggattcaatggttaggccttgaaagcgactaccattgttcattctctagtactcggaatgcggaagacgtagtggcaggtgaggcggcgagttcagatcatcatcaaaaaatttcaagagtaacgcgaaaaaggccccgagagcccaagagtacaaacgatatcctcgtcgcaggccggaaactctttggcagctcctttgaattcagggacttgcatcagttgcgcttatgtcatgaaatatacatggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgagccgatgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcacctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcgagttctcatcggaacgaaattagtgactgaaggaattgacattaagcaattgatgatggtgatcatgcttgataatagacttaatattattgagctcattcaaggcgtagggagactaagagatgggggcctctgttatctattatctagaaaaaacagttgggcggcaaggaatcgtaagggtgaattaccaccgattaaggaaggctgtataaccgaacaggtacgcgagttctatggacttgaatcaaagaaaggaaaaaagggccagcatgttggatgctgtggctccaggacagacctgtctgctgacacagtggaactgatagaaagaatggacagattggctgaaaaacaggcgacagcttccatgtcgatcattgcgttaccgtctagcttccaggagagcaatagcagtgacaggtgcagaaagtattgcagcagtgatgaggacagcgacacgtgcattcatggtagtgctaatgccagtaccaatgcgactaccaactccagcactaatgctactaccactgccagcaccaacgtcaggactagtgctactaccactgccagcatcaacgtcaggactagtgcgattaccactgaaagtaccaactccagcactaatgctactaccactgccagcaccaacgtcaggactagtgctactaccactgccagcatcaacgtcaggactagtgcgactaccactgaaagtaccaactccaacactagtgctactaccaccgaaagtaccgactccaacactagtgctactaccaccgaaagtaccgactccaacactagtgctactaccactgctagcaccaactccagcactaatgccactaccactgctagcaccaactccagcactaatgccactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacgtatacttctgcccagagggagtattcacacaatacggattatgcaagggctgtcaaaagatgttcgagctctgtgtctgttgggctggccagaaagtatcgtatcggaggatggcttgggaagcactagctgtggagagaatgctgcgaaatgacgaggaatacaaagaatacttggaagacatcgagccatatcatggggaccctgtaggatatttgaaatattttagcgtaaaaaggggagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgagaaaaagtgccgggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctacaataaaacatttcggcagaaactggaatatcttttggagcagatttcggaggtgtggttgttaccacattggcttgatttggcaaacgttgaagttctcgctgcagataacacgagggtaccgctgtacatgctgatggtagcggttcacaaagagctggatagcgatgatgttccagacggtagatttgatataatattactatgtagagattcgagcagagaagttggagagtgaaggaaattgttgttacgaaagtcagtgattatgtattgtgtagtatagtatattgtaagaaatttttttttctagggaatatgcgttttgatgtagtagtatttcactgttttgatttagtgtttgttgcacggcagtagcgagagacaagtgggaaagagtaggataaaaagacaatctataaaaagtaaacataaaataaaggtagtaagtagcttttggttgaacatccgggtaagagacaacagggcttggaggagacgtacatgagggctatttagggctatttagggctatgtagaagtgctgtagggctaaagaacagggtttcattttcattttttttttttaatttcggtcagaaagccgggtaaggtatgacagcgagagtagaggtagatgtgagagagtgtgtgggtatatatatgtcactgtattgcatgctggatggtgttagacaaggccgtagggacatatagcatctaggaagtaaccttgtacgaaaataggcaatatttcctgtttaggcgattgtgacgcagattttagtccaacgatctagcgtcaaggaatttttttatagtgggacattgcaccaaggaagtaacttgatacgtcgtgggtgaatgggtctgttttcttattcggcggggtaatacatttttgggggaagtttgtctgtctgacgcgccatatgtaggtacgccaaaaagggctcctctacttcgaagcgcgaggtcgtatacctaataaggaaatgtaatttataactttctattatattggtcttttcgagagcggaagaagttgtaggctaagcgcaggctaagcgtaggtccatatttaaagtatccaagagaatatccacgaagcggctgagcaacgaacagaatcctggttctcctcgactaagcagatagttaagatactgtgcaccatggaaattgaaaacgaaagtacgtaccgactactttatttttgcaggccggaaatcaagcgatgaatgagacatccttctgttttctatgttgggacagacagtcgcttatcttagtgagatttcttattaactgaattttctttgctgctgctggagatttgcacctgcatagcgcagattctgcttcttctcaatagagtagcttaattattacattcttagatgatgataagacggaaactggacaatcttttgtttatattgatggatttcttgtcaaaaagcataacaatcaacatactattgttaatttcgaaacttacaaaaataaaatgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaaattgtcatttccgtcatggtcgggaaaaatgtacaaaagttcctgacatttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttccgtgtcctggaacgttgtcacgaaatagcgagtgccaggccgaacgacagctctacgatgcgtactttcactgactttgtttctggcgcacctattgtaaggagtcttcagaaaagcaccataaggaaatatgggtacaatttggcaccctacatgttcttgttactacacgtagatgagctatcgattttttctgcataccaagcaagtttacctggcgaaaagaaagtcgacacagagcggctgaagcgtgatctatgcccacgtaaacccattgagataaagtacttttcacagatatgtaacgatatgatgaacaaaaaagaccgattgggtgatattttgcatattatcttgcgagcatgtgcgctcaatttcggggcgggtccccgtggtggcgctggtgacgaagaggatcgatctattacgaatgaagaacccattattccctctgtggacgagcatggcttgaaagtatgtaagttgcgtagtcctaacactccacgaagactcagaaaaacactagatgccgtgaaagctttattggtgtcgtcttgtgcttgtactgcaagggatttagatatatttgatgacaccaacggcgttgcaatgtggaaatggatcaaaattctgtaccacgaagtagcgcaggaaaccacgctgaaggactcttatagaataactttggtaccttcttctgatggtatatcagtatgtggaaaactttttaatcgcgagtatgtccgcggcttttactttgcatgcaaggctcagttcgataacctttggggagagttgaacaactgcttttatatgcctacagtggttgatattgccagcctcattttgcgtaatcgagaagttttgttcagagagccaaagcgaggaattgacgagtatctggaaaacgattcttttcttcaaatgatacctgttaaatatcgtgaaattgtgctgcccaagttgagaagagatactaacaaaatgaccgcggctcttaaaaataaagtcactgttgcaattgacgagcttacggtgccacttatgtggatggtccattttgccgtaggatacccttaccgttatccagagcttcagctactcgcttttgccggtcctcagcgcaacgtatacgtcgatgatacaacaagacgcatccaactgtacactgattacaacaagaacggttcatcggagcctcgacttaagacgcttgacggactcacttcagattacgtgttttattttgtcactgtgctaaggcaaatgcaaatatgtgcgcttggtaacagttatgacgcttttaatcatgatccttggatggatgtggtgggatttgaggatccagatcaagtaacaaatcgagacatttcgaggatagttttgtattcctacatgtttctgaataccgcgaagggctgtctggttgaatacgcaacttttcggcagtacatgagggaacttccgaagaatgcacctcagaagctgaattttcgggagatgcgtcaggggttgattgccctaggacggcactgcgtaggtagcagatttgaaacagatttgtacgagtcggcgacgagtgaactcatggccaatcattccgttcaaacagggcgaaatatttacggtgtggattccttttcgttaactagtgtcagtgggacgaccgccactttattgcaggaacgagcttccgagcgctggattcaatggttaggccttgaaagcgactaccattgttcattctctagtactcggaatgcggaagacgtagtggcaggtgaggcggcgagttcagatcatgatcaaaaaatttcaagagtaacgcgaaaaaggccccgagagcccaagagtacaaacgatatcctcgtcgcaggccagaaactctttggcagctcctttgaattcagggacttgcatcagttgcgcttatgtcatgaaatatacatggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgagccgatgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcacctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcgagttctcatcggaacgaaattagtgactgaaggaattgacattaagcaattgatgatggtgatcatgcttgataatagacttaatattattgagctcattcaaggcgtagggagactaagagatgggggcctctgttatctattatctagaaaaaacagttgggcggcaaggaatcgtaagggtgaattaccaccgattaaggaaggctgtataaccgaacaggtacgcgagttctatggacttgaatcaaagaaaggaaaaaagggccagcatgttggatgctgtggctccaggacagacctgtctgctgacacagtggaactgatagaaagaatggacagattggctgaaaaacaggcgacagcttccatgtcgatcattgcgttaccgtctagcttccaggagagcaatagcagtgacaggtgcagaaagtattgcagcagtgatgaggacagcgacacgtgcattcatggtagtgctaatgccagtaccaatgcgactaccaactccagcactaatgctactaccactgccagcaccaacgtcaggactagtgctactaccactgccagcatcaacgtcaggactagtgcgattaccactgaaagtaccaactccagcactaatgctactaccactgccagcaccaacgtcaggactagtgctactaccactgccagcatcaacgtcaggactagtgcgactaccactgaaagtaccaactccaacactagtgctactaccaccgaaagtaccgactccaacactagtgctactaccaccgaaagtaccgactccaacactagtgctactaccactgctagcaccaactccagcactaatgccactaccactgctagcaccaactccagcactaatgccactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacgtatacttctgcccagagggagtattcacacaatacggattatgcaagggctgtcaaaagatgttcgagctctgtgtctgttgggctggccagaaagtatcgtatcggaggatggcttgggaagcactagctgtggagagaatgctgcgaaatgacgaggaatacaaagaatacttggaagacatcgagccatatcatggggaccctgtaggatatttgaaatattttagcgtaaaaaggggagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgagaaaaagtgccgggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctacaataaaacatttcggcagaaactggaatatcttttggagcagatttcggaggtgtggttgttaccacattggcttgatttggcaaacgttgaagttctcgctgcagataacacgagggtaccgctgtacatgctgatggtagcggttcacaaagagctggatagcgatgatgttccagacggtagatttgatataatattactatgtagagattcgagcagagaagttggagagtgaaggaaattgttgttacgaaagtcagtgattatgtattgtgtagtatagtatattgtaagaaatttttttttctagggaatatgcgttttgatgtagtagtatttcactgttttgatttagtgtttgttgcacggcagtagcgagagacaagtgggaaagagtaggataaaaagacaatctataaaaagtaaacataaaataaaggtagtaagtagcttttggttgaacatccgggtaagagacaacagggcttggaggagacgtacatgagggctattt

SEQ ID NO: 12216 - DNA, 924430 bp, Saccharomyces cerevisiae
ccacacacacaccacacccacaccacacccacacccacacccacacccacacttttcacatctatctttactctcgctgtcactccttacccggctttctgaccgaaattaaaaaaaaaaaatgaaaatgaaaccctgttctttagccctacagcacttctacatagccctaaatagccctaaatagccctcatgtacgtctcctccaagccctgttgtctcttacccggatgttcaaccaaaagctacttactacctttattttatgtttactttttatagattgtctttttatcctactctttcccacttgtctctcgctactgccgtgcaacaaacactaaatcaaaacagtgaaatactactacatcaaaacgcatattccctagaaaaaaaaatttcttacaatatactatactacacaatacataatcactgactttcgtaacaacaatttccttcactctccaacttctctgctcgaatctctacatagtaatattatatcaaatctaccgtctggaacatcatcgctatccagctctttgtgaaccgctaccatcagcatgtacagcggtaccctcgtgttatctgcagcgagaacttcaacgtttgccaaatcaacccaatgtggtaacaaccacacctccgaaatctgctccaaaagatattccagtttctgccgaaatgttttattgtagaacagccctatcagcatcgacaggaatgccgtccaatgcggcactttagatggggtaactcccagcgcaagctgatctcgcaagtgcattcctagacttaattcatatctgctcctcaactgtcgatgatgcctgctaaactgcagcttgacgtactgcggaccctgcagtccagcgctcgtcatggaacgcaaacgctgaaaaactccaactttctcgagcgcttccacaaagaccgtatcgtcttttgcctcccattcttcccggcactttttttcgtcccagttcaaaaagtactgcagcacctctgtcttcgattcacgcaagttgctccatactttataatacaactctttgatctgccttccagacatgcggaaaacttggctcccttgcttgcctcttgtcgaatccaatacactaattgtttctcttcttctagtaatggccaggtaccaagcataatttctctgtatctgagagtagatctctcccctttttacgctaaaaaatttcaaataccctacagggtccccatgatatggctcgatgtcttccaagtattctttgtattcctcgtcatttcgcagcattctctccacagctagtgcttcccaagccatcctccgatacgatactttctggccagcccaacagacacagagctcgaacatcttttgacagcccttgcataatccgtattgtgtgaatactccctctgggcagaagtatatgtcaataccatagaggaaaagatgtttaatttcgtcagaccgaaatccaagaaactgtaagacattcatattctcggaagtattgggaaattgtgctttcagtttctttctctctagcaaaaccatttgactccctttccgcttatacgactctttgttaatgtcggtgactggatggaatctattatcctcagcattgccatctttattggcgtcctccttggcactagcgttggtactttcagtggtagtggcattagtgctggagttggtgctagcagtggtagtggcattagtgctggagttggtgctagcagtggtagtagcactagtgttggagtcggtactttcggtggtagtagcactagtgttggagtcggtactttcggtggtagtagcactagtgttggagttggtactttcagtggtagtcgcactagtcctgacgttgatgctggcagtggtagtagcactagtcctgacgttggtgctggcagtggtagtagcattagtgctggagttggtactttcagtggtagtcgcactagtcctgacgttgatgctggcagtggtagtagcactagtcctgacgttggtgctggcagtggtagtagcattagtgctggagttggtagtcgcattggtactggcattagcactaccatgaatgcacgtgtcgctgtcctcatcactgctgcaatactttctgcacctgtcactgctattgctctcctggaagctagacggtaacgcaacgatcgacatggaagctgtcgcctgtttttcagccaatctgtccattctttctatcagttccactgtgtcagcagacaggtctgtcctggagccacagcatccaacatgctggcccttttttcctttctttgattcaagtccatagaactcgcgtacctgttcggttatacagccttccttaattggtggtaattcacccttacgattccttgccgcccaactgttttttctagataatagataacagaggcccccatctcttagtctccctacgccttgaatgagctcaataatattaagtctattatcaagcatgatcaccatcatcaattgcttaatgtcaattccttcagtcactaatttcgttccgatgagaactcgcatgctaccgtcagtgacaaactcctttgtgcgagacaccttttctgcagcacccagcttcccgtgtatccataccaccctaaaatactttctccaagagcaggccaattcttccacttcgttggttgtgcttgcaactacaatggccttcgactctggttcaatttcaaagagggctaaaagaagcttcagtgcttcttcgggctgtgattccactttcttccaaattttatgaacatgccctaaaggcacctcggatttctccttgattagattaaacatccgtgttggatagctggatagacctctgctgagatcttccgaccgtttgagctcgttgatgtccatcgacttcttggccagtcccgtaagcccaatacgctgcaacgcagcatcagctacagcctcaggtgctgtgccgctcaaaaagattgctttctcaaaagcgtcaaaatcaaggttagttatgcccccaaattgcgactgccggtagacctccgtttcaaagttgtgaaactcatctacaatgaggtaacccaattttacgttgttggtcctaaaggtgcactcaacaatattctcccacgcagctatcctgtctgtgaaattagtgctagcaagatcatcgtagatccccacgtataaatcagtaacgccatcgcaaccttcttcaataaagtttcttacaggggccacattcaagcaaccgcatcggctcaacctgatcatgcaattagcaagcaacactgtgtacggtacaaacagaaacgacacatatttcacgtcgcccttagacgccagtgctatcaaggggagatgaaataactccgtcttaccatagcccggtggggcctgtactgccacagagggtgtgtctgccatgtatatttcatgacataagcgcaactgatgcaagtccctgaattcaaaggagctgccaaagagtttctggcctgcgacgaggatatcgtttgtactcttgggctctcggggcctttttcgcgttactcttgaaattttttgatgatgatctgaactcgccgcctcacctgccactacgtcttccgcattccgagtactagagaatgaacaatggtagtcgctttcaaggcctaaccattgaatccagcgctcggaagtgagtccgtcaagcgtctttagtcgaggctccgatgaactgttcttgttgtatcgtcgacgtatacgttgcgctgtagctctggataacggtaagcgtatcaccgtaagctcgtcaattatttttgagagccgcggtcattttgttagtatctcttctcaacttgggcagcacacatgcaaaacatcacccaatcggtcctttttgttcatcatatcgttacatatctgtgaaaagtactttatctcaatgggtttacgtgggcatagatcacgcttcagccgctctgtgtcgactttcttttcgccaggtaaacttgcttggtatgcagaaaaaatcgatagctcatctacgtgtagtaacaaaaacatgtggggtgccaaattgtacccatatctccttatggtgcttttctgaagactccttacaataggtgcgccagaaacaaagtcagtgaaagtacgcatcgtagagctgtcgttcggcctggcactcgctatttcgtgacaacgttccaggacacggaaactcaactcattatagtatcctctgttgaggtaaaaaagagaaagggtatcgtaatcctttctattgaatttcaaagtatgcacttgaaacaacgtgtagaccatcaagttgattttcttgggaataagatactttgaagggattggtccgccctggaaatctggttcgtcttcaacaaacgtcaggaacttttgtacatttttcccgaccatgacggaaacgacaattttttcaaaagaccttttcctatccattgcaccagttctgaattttaccactttgattaggccagacttttcgtcttcgtagaatgaccgcacttccgtggggatcgattcaaataaagttattgagggacaatgtaccaagtcgtttttgttatttagagccgactcaaactcgtcaaagtttgctttttcaaacttacgcctatcggaaactttcattttatttttgtaagtttcgaaattaacaatagtatgttgattgttatgctttttgacaagaaatccatcaatataaacaaaagattgtccagtttccgtcttatcatcatctaagaatgtaataattaagctactctattgagaagaagcagaatctgcgctatgcaggtgcaaatctccagcagcagcaaagaaaattcagttaataagaaatctcactaagataagcgactgtctgtcccaacatagaaaacagaaggatgtctcattcatccttgatttccggcctgcaaaaataaagtagtcggtacgtacgttcgttttcaatttccatggtgcacagtatcttaactatctgcttagtcgaggagaaccaggattctgttcgttgctcagccgcttcgtggatattctcttggatactttaaatatggacctacgcttagcctgcgcttagcctacaacttcttccgctctcgaaaagaccaatataatagaaagttataaattacatttccttattaggtatacgacctcgcgcttcgaagtagaggagccctttttggcgtacctacatatggcgcgtcagacagacaaacttcccccaaaaatgtattaccctgccgaataagaaaacagacccattcacccacgacgtatcaagttacttccttggtgcaatgtcccactataaaaaaattccttgacgctagatcgttggactaaaatctgcgtcacaatcgcctaaacaggaaatattgcctattttcgtacaaggttacttcctagatgctatatgtccctacggccttgtctaacaccatccagcatgcaatacagtgacatatatatacacccacacccacacaccacacccacacccacacaccacacccacacaccctaacacaatcctaacagtaccctattctaaccctgatgaacctgtctccaaacctaccctccattaccctacctccccactcgttaccctgtctcattcaaccataccactcccaaccaccatccatcatctctctacttaccactaaccaccgtccaccataaccgttaccctccaattacccatatccaactccactaccacttaccctactattaccctaccatccaccatgtcctactcactgtactgttgttctaccctccatattgaaacgttaacaaatgatcgtaaataatacatacatacttaccctaccactctataccaccactaccaccaccgccacttgccacactcaccttcacttctactgatatgtcatacgcacacggatgctacagtatataccatctcaaacttaccctactttcatattccacaccatggccccattctcactaaatcagtaccaaatgcactcacatcattattcacggcacttgcctcagcggtctataccctgtgccatttacgcataactcccacgattatccacattttaatatctatatctcattcggcggccccaagtattgtataacagctcttaatacatacgttataccacttttacaccgtatactaaccactcaatttatatacacttatgccaatattacaaaaaaatcaccactaaaatcacctaaacataaaaatattctatccttcaaccataatacataaacacacttaattgcgtcttaatactatcatggtatcattaacttaaagttccttaatatcgtcataccactatgctctattccatatattgtaatataactgtactctatagtcatacagacgcttttacttcaccccatcttatactattgtcatagaatctcacactgacgcatgattaaaacgaataatttttactgtaagggctgccatccgcgctctatccttttgtttgcaatatttatatacagaatctcaaaacaagcgggagaagtgctaattacccagaggtcatgcatgatctgagtaccaccgtacctctaggttttgctttgatccgttttacagtgacaccgaacataaggggaagctattgacatggtatcgaaaggttgtccacattgggaagtaacttggttctatgaatcttcatgtcagatacgtaggacagactctttcctgtgtaaatatttgtgacagctacgtctattttctactagatgtttacacagttttgtcacaggaaatctacgcttaaaatatgtatttcattcaagcggtaaccgctgtacgagcagtgacattgctggtcgcaccctaaatgtgaaccaacgttacggcacaccgtgatgtacccgcattaaagttttgtaaattcgttattacgattatcgagttggctagatagaaaaccggaaatgtaatggatgcccttttcgaatagctgagtttctttgcctaaaatagcccaatattgttgccctttttctatcacgaggttactgagccattgcatgaacgcgcgcgcctcggcggctttttttttctgctgtgctgtataaaagcgaaaagccagaagttactatctcgaataaaaaacccctcgaactgccatctcactaccgaaaatgaaagagaatgaacttaaaaatgagaagagtgtagatgtattatccttcaaacagctcgaatcccaaaagattgttctacctcaagatcttttcagaagcagctttacctggttttgttatgaaatttacaagtccttagcgtttcgcatctggatgctattatggctaccacttagcgtctggtggaaactttccaacaattgtatttacccacttatagtttcacttctggtcctgtttctgggaccaatatttgtccttgttatttgtggactttctcgtaagcgttccttatcgaaacaactcattcagttttgcaaagagattactgaaaacacaccaagttctgatcctcatgattgggaagttgttgcagcaaatctaaattcgtacttatatgaaaataacgtttggaatactaagtacttttttttcaatgccatggtctgtcaagaagcgttcagaacaacccttctcgaaccattttctttgaaaaaagataaagctgccaaggttaagtcatttaaggattccgtcccttacattgaagaagcattgggagtttattttacagaagttgaaaaacaatggaaattgtttaatactgaaaaatcatggagccctgttggcctggaagatgctaaacttcccaaggaagcttaccgatttaagcttacttggtttttaaagaggatttccaatatttttatgttgataccattccttaattttttgtgctgcatatatgtgtcacggggaatgtgccttctattacgcaccttgtatctcgggtggattcttttcatgttggtacaaggtttccaaaatataagggttttgattatgagcatggaacacaagatgcagttcttgtcgactattataaatgagcaagaaagtggtgcgaatggatgggacgaaattgcaaggaaaatgaataggtacttgtttgagaaaaaagcctggaagaatgaagagtttttcttcgacgggattgactgtgaatggttttttaaccacttcttctaccgcgttctatctgcgaagaaatctatgtggcctttaccattgaatgtggaactatggccatacattaaagaagcgcaattatcccgcagtgaggtgctcttagtgtagagataaatacaactttttcaatttatatattttgtagtttgtcagctgcgaataaccaaaacgagactactttttacaattattttactgtattgattacaatccagcagtttcaaacgaggcttctgttgttaatcagacaatatgttgaaaactttatgaaattctgtattgcaaaccccaacaaacgtaccgccgctattcaaagttccaattacattatgagttttatggtctcattttgccacattgtaaaaatattttttacagttcccactagtaatggattccctctaagacagtacactgctgttcttgtcacaaatccagctttataataacgtactagaagatatcatgactatagatgtacttcttaaaaatcaatacgtagaaatatttagacaaaccatctgaaagcgtttgtcgagttatgagagctttgttttaaagaatcattgaggcattttatattaaatttgcagtcccaggtagagctttataggaaaatgcgaatccaaaaatttgttcactctagagggtctaagcatggacacaagatggtatcgtcgctggaaagtttaatgatgtcgtgagcacgcctttttaaacatatttttatgatttaaagtgtatctatcctttcctacaatgtccccgcgcctcacttaatccgaaggtattacagtacacttgttatcatacgaaaacttttgaatcttctcatatacctactgaacttactataagaaaaaatcaacttttaaattattgctttaagatacgcgagagagaaacagagttcgagtgtagaagatcacacttaaaatttgtatgtaatgcaaaaaactcttcaattatagtattcaaaaataaactatttcctcactttgcctgctatttattcttggcagatcttgtactcatttcatacactttgaatcctctaatttgtggcattgcccctattataacaacttcgttcacactttggcccaaatatttctattaccagttctgaaaaaagttttatatattatttcacaacattaccagtcacttccatgcgtgccttccctctttgaagaattaaattactggcataaacgaagaatatcataattttacttgtaacttctatacaattttttttttttttgccttcttcatacttttactcctgcttttattactctaaatttcatttttatttattctcttctaccgtgtcaattggacaaaaaattcaagttctgatatctatgcaggtcaccctttatcagaaataaatcttcagtcctccttcttttagtcatatcttagtagttacataacatacatgaaatgtaagaaaaaatgataactgaaggcccccaattttcatatcaggggttatgaaaaagcttgtttttattagtcgtttgcatacttgaattttttttggtttacaccaatttgaaaatttcagtcatcattttagcaaatttatcatgagagcgcttcagtgccacctctttaatacggtggtgattaacacttcgcttttcagtttggagaaaattaattgtctccgcttttcgtacttctattttcctctttcgcttaataataatcttggcgcacattacgtaatagccaaaccctatttctctcctctttgaactcgaattgaaggagttctttcggaatgaaagaatataaaaatgaagggttacctacttaactttttgttagcggcacctctttcattaaaggaatcttcaaataaaaaaaataaaggcataggtctaagactagaaaagatcgcataacgatatggtattggctaaacaatgggttttgaaaaacctaccaactcctggtgaaccatttaactttcattttcacgatcctgcatgtactttcgagctcattgaaaaggaactctcttcagaacaattaaaggacggtgaattactactggaaacaacttatttatctaatgatcctgcccaaaaattttggatatcatcaatggacaaaaattacgccaaaggtgtccagcctggtgaaattattcctgcaagaggaattggtaaagtcttggcctctagaaataaagcattctctcctggcgattatgtctctgcagtgaccggctggactacacatgccataatttcgcaagaaaatgttcaagggctgagaaagcttgacaaaaacaaagttggtaaattatggtggtatctctctgtcttaggtggtacgtctttaacagcttattttattttctttacttatgctcaattgcaagaaagagaagaggactatggaaaagtttacctaatctccggtgcagctggtgccgtcggtaccgtttgcattcagctggccctaaacgtttttaaggcttcaaaggttattgctatcgcaggtggaccagaaaaggttgcttttgttgaatcctttggtgataatgtagtcggtgttgattataaagatccaagtttcaagcagaaacttatcgaggccgctggaggtgagaataccgtggattactttatcgataatgttggcagtaatgtgttggaagcaggtgttctacttctaaagcaaagggctatgttgatagcctgtggtgctataagtgcctataatgatccatctaaatttgtctttaaggggtatagctttattctgactaaacgattggtcgttaaaggagtactagtgacagataatattgatgattttccaaaggcattagataaattgggttctctggttaagcatggtaagattgacctcttgaaatccgctacccttgaagatggtaccggtgataagttcaagaatgttccattgatatggaagggtctatttagcggtgttaataaaggtaaacttattaccaaggttaacaatgaggagtgattttacacaaaaagtttaagatatgactatattatttttattattgtatctacttcgttttggctcttataattttttagtggcctaaattttcaaaggaaaaatttattgaatattttgaatgatatttaaactctatattttgaaatctatacattgaatacatataagataaactgtgttgctcttattgtatatctagcttataggaaataggctctcgtgtctcctcactaacgtaatcagcaacaccgatgaatttattccaaaatttgtataccttcatcaaagataattcccagatgttcctgggtaaatccaaatagcttctataaataaatctgaatgcttctaaaacgttgttaacttcagtattccaagctttcttccatttatttactgtaccgttagagggccttggaactatttctgctttgggcatttttaaatcatcaaatacatgtgattgagaattgttagtctttttctttccttctttagtggaattgatgttctctatggtgtaacgaatcgatttgcctgcctccttcaaaatgttgaagaagttattttggaagaatgagcttaacctgttttcagaaccgtttaaccttttcccgtacattttttcgaacatgttaacagattcaatagattcagataatctaccgaaagtctgtaatagtgcaatcaactcatatttggttaacttaccaacaatatgttgtttggtgaattcatcagcgtcgttgatttcaaacaaaattttcaaggcagttgcgtaaccggtagtttgaattttgccccacaatctacatctatcacattgcacacaatccataatcttcgtgacattcttgaagcgagatctgaattcgtccttcaaagtcaaacttaggtcgttggcaaaaactaagtcttcgttaaaaatttttgtgtccagctgggaaataacgttatccattttgtttttgatttctttattgactagatcacagaatgaaaattctggtaaatatggttgaattttccagagagccttagctacaacagcataattgaaatacatgtttgtcactctatcaggaaagttcccgattcttgccataaacaaatccagattgggctcccatttaccagttttcgtgttcaaatattcctttgataagtgagtaccgatagaggcatggaaaccggatacaagtctataaaatgcatctttggccaatgattcaccagtttcgccaattgtaaaacagttgtcttggtagatagtagaccaaatttgaccagcttgcttaccaccataacctgtaaatcgttccggatttgctgttaaatcaatcagaacggcgtttttaccgttaaagtcatttacatcacagtagttgatggtgtcttcgatatctacaggttttttactggtttgacatagttgatctaagaacttacattcgtcatcgctatcatccgcttccttcattgtatcattattgaaactacccaagatctcaggctgccagtactcaggcagtgtatcccagtcctctacgacatcaacagagcaagcgcggtttaagcacagaccatcgttggcgtcccaaaatgaacattgcttgtataaatccagccgaaagtatttgaagaaatcagattttaataacgccgaaagatcatctctaatgttttcatttatggcatttaattcattgaatgttacgttacaactgggactaacgtgatcattcctgtcgaccttacaaaagtgagtgtcattaaaggcattttgtgtttggtcggtggcgatgtagctattgtttgaagttgcagatgtaaaagccgtgaggcacagtgtggcaatggcggttcttaatctcatgttttacctgcacgttactgtggtatatgcaataaaatgtttacactcttgaaatagtataaccagtttaagtggtaaaccttttcaagctctttatacttagcttcaaggatgattgaacaagtttttatgacacgtactccgtatcgtttcttttttgttctcttcttttctttttgttcttactaacgcccaaagccggaaaaatgcgaaaaatttccagggtcttctataagagaaaccaaaggacaaagggaaaaggacatacttagcaggtagctcaatattatttgtttaattagaacagtcttctctttgtgtatgtcttgtaccattgtctgtggtattctcgatttgtgtagaatacatttgccataaaatgtcagtagaccttttctctgatacgcagtgaatatatcaattctcctacatatcctattgttcattgaaaatatgaaaagtaagcattactcaatagatagataagaaaatgatctcgtttcagttgtgaatatgtttcagaagaaatgtcttgatagtattggtaatgtaggatgggcaaaccatatgtaaggtaggtggttggcaatttactttttttgtgttgccagtatgtatatatgcttttggggggccttaatgtttaccttcaaggtacgatatttagcaagcatttctagttctttatgtggtgaataagtaatgtgtgtgtgaactatggctactggatgactatattcggcattagtatttaataagggtacgactctgaagtatcagagttgcatcatttcagacacactggagggatcctgttatatattttgaaataaataatgtacaattttacgggtgtacacagcacaaaaaggaacgtattcttaccgccgtgttctttccatcacgaaagtgacttcattgcgatgtatttttcagcaagaattaaggtaataagatctcttcacaaagctgactcaaaaggcctacataatggcagtaagaaaaagtaaacagcgagaaatagtcagataaaaaactagatggcgaatagacgacattttagaagaaaagtgtttcagcctttggcctcaaacctcagtggcagtctttcccctgataaggaataggaaggcatgcagcgatatatatgttagttttgcctacgggaatccggcagcaatgttatttatttttgttgtttcttatgatttaattattatatacaggttcgtaaatattggcatgataatgaggagaaggtggaaccagcacactacgtcgatggaggcccttagaatatagtgcaacacttaaaaatgtaatctagtactttttcttcattttattagcactgggttctcgcagtttactcggtaggaggtgcagtaggactttgcagttgttgattgtcttcttcaagtgccttttgttgggtcacttgttgttcgtacttcttaccgttcatgtataaagtgtaagctaagccacccgacatgtataacgtaccaccaaccaacgtcagtaccgttagacgatgtaatgtatctgtaactctggtataccaagcgtatttggacatgactatctgcgttctattttttgttctcttcctctcaccattgccaaaccgctgtatagatttatgctcctttcaatgcatttattctgatcctctccgatttcgtataccgggtaacattaatcgcaaggaaggagaagcaaagctcagaagtaaggaagaacttcgaaatctgcttccgagagtgaggaaatagtgttttctaaagagtgtatttcacagtatgtaacattataaagacaaaatacttacttaagcaaagttatatagaagtgacaacgtgttttttcgttttgctattagcttgtccattttacggtaaaatatacggatgaaaagaaaaattggggagaaaagtacattacgttgacaccccaatcattagttgaaccctaatatgcttttcgaccagtttttaacgttatgtaggtacctcttgtaagcaggctccttaacagtgccgaacaaccattgcgtattctgcttggccaagttgattaagtcgtccttcgtagaagtctgtttaaccggaacaccgaatgattttaggtactgcaataggtcttcttgagaccagctctgaaaggtatttgaccaggtcttagcgatttggtccttagcatcatttgtgtttttggaaaccttgtcaaaatcctgcataattgtggagtaagtctgagaatcttggaagtcgtcctttttgtcagcaaaccaaccctttatgtcatccaaagaccagttactgttgtcaaagtatttttggtagtcttttggcaggatcttgagtttttcgtttctggattttttgactaattctctcaattgatgttcagtagacagcattgagtacttaataccacgagcatctaaaaacattttcaatttgtcctttggccaagagtctaggccaaccaaaaaagtatcattgatcacattgtcagtcttacctctgaacttggagtacaaatttgtgaggaaatttttagaagagtcccaaacggaaccaacgtattctggggtcttggtcaaaaatggagaagactctcttttcatatagtccaggtaccagtagatatcatctttcaaattggcagaattttctttggccattctaaccaaatagtcgtgtttcttggccatgttcttgtcaatattgaccttgtggctctccaaccaattggttaactgatcactagaccacttgtcaaatacagtgtcttttatttgtcccgatgtgtctaatatttgttggtgagccaaatccaagctttctagcaaacccagacgctgctgttctgccttttctgaagttcggtagatgttttccttgactttctgaactagctcgtccttgctttgaactgccttgtcgtagtcgataccattgtcattcaaccagttttgcaaatctttggttgaccagctatcaaagtaagagctagaaggatagtatcccgacgacttcaaagatttggaaatcttgttgaagttctccttagcagtcttcaccagcgagtccttggaagccttagcgtcgtcaacatccacgccgtttttcttcaagaagttacgtagactgtctgtggaccaggtgtcaaagagccagtcagaaactgggtgatccgaagaaccagtataaccaaaccatccggggttactgttgctcacgctactgctgtcactagaccacacctgccaccatggtttgggctgcgcgtgtttgtcccatacctgcgatgcctccgttttcaagtcctcaatggagtctgtagcgtacttttccaagctcttcttattatcacgtaaataatcggccaggtcttcctgcgtccacttgtcgaacactgaatctgaattggccaacactaagccaataagcacaaatgatgcggaaaccgcattaaccaacttgaattgcttcatcttcttctcttaattaacagttcttttgtagttgtctcctcttctattgcagatcctcttctaaactccggtaatctaatcatgctaggaatacgactccatgagtggctttaaataccctgtcgatcccctttcaccgcctccttgtttcctccctctcccttattttccttcagttccaaagatcccttattcttcccctctaaggtgaggccggcgtaatgctgttgcttaccgacgtaatggtggaaaaggtgaaaaaagtgaaaatagtgatattcttagagaaaaacgaaaacaacaagtcgtgtcaagaggtagtgttttgggaaagacgtcatagagaaaggcagaaagcttgtaaagaagtggaaataaagattgaagatgaactcgttagcttcaaacacaccgctaaatggtactccagtaagcgaggcacccgccacaagctccgagcctgtgaacatgttcgagacaatggtggctaaccctattaaagtgtctcgattacagtctaatggagttctgacgggacctgcagccaatactaagtccatccactattcgctggccaattttaatgtgttccagtcgctacccaaggaaacggccagaggtgtagacgatttgacgaggatggagatggcgttactgagtgggataccggaggagattaagtggtctttaaaaaaatatcttacgtatagtaacaaggcgccatatatgatcagcttacggacattgccggacctgttgccacttttcaagactttcatattgcctttggagcgcatcgtggaaggtcttaacaaatcgtctatatgtgattcaaaggcgatggattctctacaaatgggtctaaatgccttgctgatcctaaggaatctggctcaagatactgattcggtgcagatactagtcaaggatcgagaaatcaaatctttcattcttttcattttgaagaagtttcagtgcgtcgctacaggcgataacaagtggcaattgtacgaaggaaatgcaactttttttaacgagttgacccattatactctggacttgatggaggccatttcgtcctatattgctcctgcaatgaaggatgatcattatttccaaacgctggtgtccatcttgaactacactaaggacagatacatggttatttctatattgaggtctctttcaagattactggttaggtccaaagctaacgaggaaagtgcagcggacaatttggaccataagactctttcgttgatcgtttcctttttactgttagaatgcgatagtgagctgattattgcttcgttggatttcctctatcaatacattttgcccggttctcaaagaatcactgagttattcaagagtaaggagtgctctttgatactggaagccacgctgcctaatttattatcatataatatcgccacaccagattaccatcttttgcaaaagcacaaaattaggttgattaaaaggttgaagcctcccgctccaaaggagcctcccaatttatctgaggatctgtttcaacaacttttcaaacttaacgagcccttgaggtcaaccgcttggttgagatgttgctttgagcctgtacaagaagcagaatttacacaaatatcgctttggagatcctacgaatccaaatttggtcagcctgttcgcgaatccggacgcaaattgttacctgccgtggaattcatcaagaatgtctcgaatgctttcaataacgccgctgctatcgtaatcactgacccggtaaccggcaagaaaaggtttgttatcaagggcattcaaccaagatttaaagctttgggtattgcagacggggaaagagaatcccaggtacccatttcggcactaaaatccaaatttttgaatgactctaaggaaattacacctgcaagacaaaacagcataccagaggtcaaattccctcaagaactctcagatgtttctaaagtggcctgtacgtttttgtgccttttatccaacgacacggatgatggtgctggttccgcattttgtcaacgcatcaggccactggttctacataaattggctgatattccacctttaacattagcattgtctgaatacatggaaaacacgtcggggttatgaatgagaaaaaaaatcggttgggcttaactttaaagaaaaaagttgagattagatttattgtgttataaatatagatatacaattctttataaaaaaaatatatatatatatcattgttattaaataaagagttttcctagtatatagattaaaaaactactctattaaatgagagctaaaaaaagcaggctgccaaaaaaataaagcatttatgaagggggttcagcaagatgcaatcgatgggggaagattattttttaacatcgtaagatcttctaaatttgtcatcgatgttggtcaagtagtaaacaccactttgcaaatgctcaatggaaccttgaggtttgaagttcttcttcaaatgggcattttctctcaattcgatggcagcttcgtaatcctttggagtttcggtgattctcttggctaatttgttagtaatatctaattccttgataatatgttggacgtcaccaacaattttgcaagaatatagagatgcagctaaaccggaaccgtaagaaaataaaccaacacgcttgccttgtaagtcgtcagatccaacatagtttaatagagatgcaaaggcggcataaacagatgcggtgtacatgttacctgtgtttgttggaacaatcaaagattgggcaactctctctttgtggaatggcttagcaacattaacaaaagttttttcaatgttcttatcggttaaagattcgtcataatcgcgagtagctaattcggcgtcaacttctgggaacaattgaggattggctctgaaatcgttatatagtaatctaccgtatgattttgtgaccaatttacaggttggaacatggaaaacgttgtagtcgaaatatttcaaaacgttcaaagcatccgaaccagcgggatcgctaaccaaccctttagaaatagccttcttggaataactcttgtaaacttgatcaagagccttgacgtaacaagttaatgaaaaatgaccatcgacgtaaggatattcgctggtgaaatctggcttgtaaaaatcgtaggcgtgttccatgtaagaagctcttacagagtcaaatacaattggagcatcaggaccgatccacatagcaacagtaccggcaccaccggttggtcttgcggcacccttatcgtagatggcaatatcaccgcaaactacaatggcgtctctaccatcccatgcgttagattcaatccagttcaaagagttgaacaacgcgttggtaccaccgtaacaggcattaagcgtgtcaataccttcgacgtcagtgttttcaccaaacaattgcatcaagacagacttgacagacttggacttgtcaatcagagtttcagtaccgacttctaatctaccaattttgttggtgtcgatgttgtaactcttgatcaacttagacaaaacagttagggacatcgagtagatatcttctctgtcattgacaaaagacatgttggtttggcccagaccaattgtgtatttaccttgagaaacgccatcaaatttctctagctcagattggttgacacattgagttgggatgtaaatttggatacctttaataccgacattttgaggtctggttttttgttcagcggtcttttgtttttttagttcagtcatttgcaagtttgtattgtgtaattgttgttgcttttgcggcctaagtcttcctttaataccacaccaacaaagtttagttgagagtttcatgctgcaccttttatagtaatttggctacgaaaattggcgaggcacccaaacagttccgcccgatgaggccgaatggagcctactttcaacacactcgtataattaatagcccggttcattttcgacacgataccgcagccatggagattgtgggtatgattactctatagtattatgtaatattgtatggaaaatttttctattgtatatacgaagcttattccgttaaaagacgaagacttgatcgtcgccagaacttctcgttgaattgaccttccagcccagttctttagcgtattgaagggccaagttgttcattccatcaggtccacagatcaagagtctgttatcctccgaatattccggcagatacctgttcatctggtccttggtgatgtagccgacatctccggtccatctgtcggatggatagtgtaccacgtaatggacctggaaatgtgggtatttttcggccatctcatccagttcgtccttcaatagaatgtcattttcagtctcattggcatatagcagggagactttcgtcaaatcttcaggaacggtgatgatttcattcaagatctgtaggactggcgtgataccagaaccaccggctacgatacctaaatgcttggaggaatttggttcgtagttcaaagtacctattggccccttgaaatccacggtgtcaccagaatttaagccagcgaaatatttggagactttaccatcaacgtatgctttcaccaccaaatccaagtatccactttctagtttagaactgatcggattatagtatctgacctcttgtttgccgtcaattggaacgcgtacagcaacatgatgaccagcgggaatgtccaagctttccagtcttgtcttcaacttaaaacgatacagggcggtattcttggaaattatggtttgatcttccaattctaacgaagtccacctatctggatacagtgatcttcttcttttgtaggcagagtatgctctgacgaagatgatcatgaagagaatgggtaaactccacaggattttcaattcaccagacatatacgtggtgattgcaacaccaacaacgaatagcgcggcaggaatatagatcccgtggacaggttcgtctagaatgttagttccttctatgtcttcttttgacattttcttcacgcggttcttggagtgcttccttttttgtgataagtttgggtggcaacgagatgagctcaaaactctttgttttttatgggtatttttgtcttagaatattttcaaatttttcaatattccgcggaacatagggaaaaaaataaatttaataagctattgttctaactgtacacctaaaggtaagtgaaaaataattcgataattagaggtatctttatttggatagaatatgcatatatatatataagcgtatatatatatatatatatatatgtatatacatatggacattaagtaaatataaatctataagtgggtatcgggatcagagccactttcttagaactcctcagcgtaagaatcggcacccacttcaatataatctctttctaaggcagctaaatcttctctagcttcggtgaactcaccttcttccataccttcaccgacataccaatggacgaaagcacgtttggcatacatcaggtcgaatttctgatcgattctcttccaagcgtccgcgatggcagtggtgttggatagcatgcagacagctctatccacattggctaattcggaacttggtatcacacttggtggctcataacaaataccaatcttaaatcctgttggacaccaatccaccatttgtactgtttttttattcttcacctgttcgacggctctttggacatctctggtcaccacgtcacctctgtataacaaacagttagccatgtacttcccctttgttgggtcacacttaaccatttgattgcccggttcgaaacaagcgtttgtgatttctgacacggagttggattcatgggtggccctcttcttggacaagatgggtgcgtaggaaaccaaagggaaatgaattcttggatatggtaccaagttggtctgaaattcgttcaaatccacgtttaatgaaccatcgaacctcaaagaggctgtaacagatgatatcacttgggcaatcaacccgttcaagttgctgaagcttggtctagaaattcccaagttcctcttgcatatatcgtaaatggcttcgttatcgaccataaacgtacagtctgcgtgttccagggtggtatgcgtggttaaaaccgtgttgtaaggttccacgacggaagtagacaattgaggcgcaggataaacggcgaattccaatttggatttcttcccgtattcatacgataagttttctaataacagggaacctaaaccggaaccagttccaccaccgagggagtgggtgaacaagaacccttgtaaaccgtcacattggtcggccatctttctaattctttcttcaacttcatccactatttctctacccactgtataatggcctcttgcgtagttattggcggcatcttccttaccgttaatcaattgttctggatggaaaagctccttgaaacgtcctgtacgtacttcatcgataacattgggctctaaatccacgtagattgctcttgggacgaattttccgtaccccgtttcatggaagaatgtagaaaatccttcttcacctcccttaggttttgacaagccatcctccaaatggccgtcttccttgatgccatgctctagggagtacaattcccagcatgcattacctatttgacaacctgcttgaccaactgttgtaaaaaagaaaaataacaaaagttccagcaatcctccgaagaagaagacacaaaaatcactccccatgtaatgaggtcaattatgagctttttcgtccgagtatgcccagaaaaaatggagaaaaagaaactgttagtaaactgtgctggtacaagtcaaattatttgccgtaaatcaaccagatggtgaccaattgggaatgaatcaaaccagatcagatcaaacttctttccctgtcccacaggtgccattggttgcgaatattgaacaaaaaaaggaacgcatacataccattaatactaatgacctctctcattgtctcaagtcgcttgcttagtcgattaatgtactttatgagatacctgatctgtgtttatatttcttttagatgtgcaatttgtaaaacgtttcgtggtttccagaggctcgagaaatgatatgtcgggtaacgtctggaactaaaaaagaaaggacgatatgctctgctctggcaccagccaacaggatggcagagagatgtgaggaaataatgaaattaaaagaaattatcgaataaatatgtaacctgacagtatttatagattatgtaaggggtttgataataagtttataaaaatgtttttgtattatttgttctagtttacaagttttagtgcatctttgaggcttttatgcttcatgttgaagttgagatgggctggaagattcaatgtcattattcttgtttctgaagtttagcgtagcaggatcgatttcatcgtggtatagctcgttaatttcttctagagtctttctcttagtttctgggatcaacaaggttgtgaagatacccaacaacatgaataaggcgaaaatttccatgacgtgaggtaaccaacagttggttggcttaccgtctctagcacagttatggtcgattagagtacccaaagcggtttgtgcaataatggcaccgaccttaccagatgcagcagaaataccatgagcagtagatctgtaacgagttgggaaacactcaccaggaacaataaaggtggttgtgtttggaccgaagttttggaagaattgacaaatgacgtaaagagccaacagaccatggtcaccaagtttatggtatgcgaaaccgatgacacagaacaaagcggtcaagatgatgaaaccggctaattgaattggttttctaccgattatatcgacagtgaagacggatacccagtaaccaggtaatgaaccagcacaaatcaaaatcagattaccgacagcagtatcatacagtttcttgtaaacgtttttggaaccggcataaccgatggtttgcagaataacagcactgtttaaactcaacccgtagaaagcaacatctaaggtaaaccatgaaccagcagtacctagcaaaatcttaccgtacttccattgaccaaaatgtctgcagaaatctttgaacgaagcctttggaggatgattgtcaagagattcgacggcagtagaagctctttccaaaccgttaattgccatgtcttcatcactggtgtcgtgaattttcttttcgccatcttgttcttgtgcggcagcagcaagttccaacttagcgttaacatccaattgatatctaggagattctggaatagttaatctgaaatacaaacatgccaaccctagaacggtacccaacccaataaggattctccacatttggtcacaagccttttgacatctagcatcacattcagcaccagagtttgcgtattctagttcgcccttgtaagcagcaaccaagataagagcgatgataccaccggagatttgaccccaagcttggttagcaaagacagcacccatgatggcacctctccatttggtagtggcaaattcagaagtaataatagaagatagtgggtagtcaccaccgataccaatacccatgacaatacggtagaatgttaaaacagcaacgaagttaatagcaggagaatgagcaacagtggtttgcagaatggtacagacaatcatgataataagttccataccataaattctcttacgaccaacaatatcagctaaagtaccaaaaccaaattgaccaataacagtaccaacagaagtggaaaccttcaacaaggtttgacttggacctggcatactaccgtgccagtaaacgtaggacatcatagtgatacccaaattaatggcaaaaatatcataagaatctgtcaagaaaccaacaccagcaatggagatggtcttaacttgttgccaaccgaaaccttcgtcatcgatggactccaaagccaatcttcttctttccagaggatcttcaatatgagcaaaatcattcaaatggttgtggaaggccatgttaccaccttcggtaaggtgttctttatgaagacttctttcagcaacatgaatagtatctttattgacggaactcatttggattgtattcgtggagttttgtttgttgtgtgccctggtgatctacgagatgaggaaagataaaatttagaagtgaacttagaactttactttatacaagagatgaggatgagcttatatatatacgtatacgagccacaatagtaagtggatctaagttggcattaccggtgtgcaatgtggttgcatcatgctgccaaaaaggaataataattagctcatagatgaggtcggttaattaatgagtaatacgcacgtttttaatctagctaataagcaggcaaaacgggagaagagggataaggaaagcctttcacacgacatttggtgcataactgcaccgatctcactgatttcgatggactgcggcgaaccataatcaattgccgtcgctaatttccgccccacgtgctggaaataacacgtccacgtggaactattaaattggcatcgggcggtgcggcagtgagaggaacgggtgtttttcagccgggcaacattttcttcatagccgctagatgagttgaaagggcccttacgagcaaatgctgcacgtatagggcgcctataacagcaccaacgtgcgtaatactgattgctgtcatttcttggcatgttttcttggtcaaggtctgtgatctccccttccggttgtgtcttttcataataatatggtttttttattcataatttggtaataacggttgataaacgagcggctgataaattagtttctttttttttttaattttttttttttttgatctcatttctttttttattgaatcttttttttttgtaagaaaattaaggtttattaggcagagtataccgagtcgtttgaagtcatctccgggtagtgatttttatcacgtgacacttttttattccttttctcttttcttttttaaatttttttttttttttttcattgattaaccgcctcttctttatcactctcgcattctgtctactaaacggtaaaaaaacgaagtgaaaagttcaatgtgggaccctaccctaaattgtgattatggtaataatttctttttgaataaatacaataggtatcttacacaggagtgaaggccatcaaaatcacgtttatcaatcgacaatttagtaatgtcgtcaaataataggaagaaactgcttctgatgggccggtccggctccggtaaatcgtcaatgaggtcgatcatctttagtaactactccgcttttgacactaggagattgggtgccaccattgatgtagagcactcccatttgagatttcttgggaatatgactctaaatctgtgggactgtggtgggcaggacgtgtttatggagaattatttcaccaagcaaaaagaccacattttccagatggtgcaggtgttaattcacgtttttgatgtagagtcaactgaagttctcaaggatattgaaatatttgcaaaagctttgaagcaattaaggaagtactctcccgacgccaaaatttttgttcttctgcataagatggatcttgttcagttggataagagagaggagctgttccaaatcatgatgaaaaacctgagtgaaacgtcttcggaatttgggtttcccaatctgataggttttcctacttcgatttgggatgagagtttatacaaggcatggtcgcagattgtatgctcgctaatacccaatatgtccaaccatcaaagtaatttgaagaagtttaaggagattatgaacgcccttgaaattattcttttcgaaagaacaactttcttagtgatatgctccagtaatggcgaaaatagtaatgaaaatcatgatagttcggataataataatgtcttgctagacccgaagcgattcgaaaagatatccaatataatgaaaaacttcaagcagagttgcacgaaattgaagagcggattcaagactttaatattgaacaacaacatctacgtcagcgagttatcgtccaatatggtgtgttttatagtgttgaaagatatgaatattccacaagaattagtattggaaaacatcaaaaaagccaaagagtttttccaatgactgaggtgagtagacgaaacattcggcaattgagtgtttgcggggcataagaattataaagctttcgttacgtatatacaaatgggatttggcgtataaaataaatagagaaacataagaggaagaaataaataatcacagatatatatataggacaatgggaggaaaaagctgaagtgatcaaccaatcttgtcggggttttttgcttgtgcattagtcaagcatcatttcgaaaaaagtgggaatatataaataataaaacatcatgtgcatttttttgtgcgtgtgtgtgtgtgttaggttttgtttagagggttttagaaaaaaaaggatgcaaactcaggaaaaaacggtgcctaccaccttttttcctttttccagaaaagggcatgttaatttcatctataatcctttaaaaaagtctcttttgaaaaatgctaatttaatccagtcgaaaaagacctttaatctcgatcttgcagatagaatcatggacaagtacaaaattctccataagtagaaggtcattaagccaccaccggtgtaaaatgttctcttaccggaacgtatggttgcaatggccctttcggatcccaggtatgctaaggcacctaaatcgttgtatttgaaaggtttaaagttgttctcctcgaacaagagatcaattttatcctttcttgaagatagattcttttggaaatttggtatttgagccattttatcaaaattcttggccaaatattcggcctcttggtgcgctacttgggcggttggtggcaacccagcaaatgcattgtcaccaatggcgaaaatgttgttgctgcctttcacctgcaaaaagtcattcactgccaatcctctcttggacgagttttgctcaggaattttcttgaaaaggtcagtgattaccggtcttgccttgttacccgtggcccaaatcaaagtaccgtatggaatagtttcttcggttattttaccgtcttcgtgtttggtctttgccaacaattgcttttcttcaactttggcgacagccgttctcagatgtactttgatcgaagtgttttctaaatgtgattgcgcgtatgatgaaagctttttctcaaacatattcaaaacgatgggcagagcttcgaccaagtgaatttggacttcttcggccaatgcagggagaaactttctcaggtcctggtgaacataatcctgtagttcaccagcggcctctacaccagtaggcccaccaccaaccacgacaatggacagtagtcttcttctttcgggatcaccctttggcaataagttagccttctctagattggcggcaaaagttcttcttatttccaaagagttgggaatttccttcaggaaatgaccgtaatcagtgaccccaggaataccaaatgtgttaggttccgcacctacagcactgattaaataatcgtacttaatttcagcaggttctgcttgatgcagccctagatggttttcaggttggtatagctggctaacggcagataatgattttatggtaacggtattcctgtcgggattgatagaggtggcttctgcctcatagtaggtaacgttcccctttttcttgagagcaaaattaacgatgggctcaataattgacttttcgtctactgtcccaactggtgcagaaggtaacaaaggcgtaaataagaaatagcttctaggagagatgatggaaacgttgtacttcttggtgtcaatgtgctttaaaaacgaaatagctccccaccccgaacccagtatcagcacgtttggtttgtcgctgtgctgagggtcaatgactttcatggtcttaaaagatgtaggacctgctccggagttttccacccctgtggatctggtggaagcgaatctgactagcgtattcgtcgaggtgagcaacctcttgttactatacaaattcttcgatagcatagtggtttttagtttcttctcttgggtaaacgtgtaattcgatgatgtgatgaaactgacaccctacctgaaactcctcaattggtagttaaaactccttccccactatgccctatacatcttatatataccctgtcgacgttgcaaataccggcaataaccaagagcgctaagggggagcactcttattgtggttacccggacgttcaatgccttcatatgattggtccgaatgaataggtcatgagaaaatgcatatttttgaggcatttcagcaatgatcggcaatctgcacatattcgtattgtttccctgagtaagttatttgcggaaagagacattctattgctttggagtattttgtggtcttcgacaataaagcgaaggaataataggttcgttgctagcgacaagcaacacatagttgtagtgatgctatagcaaagaaaggtcacagattcattattgaccttttaaatggtgcccagtggcaattgccgttttagcattctttaaatgcgtagtatatgagttttaaagtgctttgttgttcacgtgcttttcacgtgtatgattacttaaccgggtagcgccggtctttaatatgctttccagattaggaaagaacataaataaaaacacaaaataagaaagtgtcaatcatccgcattgaaagaaagaaaagatttttttatccctcaattgtacatgaaaacagagacctttcaaaacgtattttaacattcttttactcttttcttgcacctgcagccttaggtcagtaagaaaaaaagtaggtagcaatgagcccaagtccatcagtgtcgccaagaaggacgctcaataacaaatcatcttacatcaataacagcggtgggctggtcctgcctcctacgcagtttaatttgaatcagcagccagtcctgagcttccaacaaaaagcgactttcgattccaaccagcagtttttctattatccagagtcacccacaaaaaacctgagaccaaggtttaacagtatttcgcaggttaataaaggagttaatgaagaccattataccgggggcggtagcagtaataataacaggccatctagatatacaaataccatgggcgctgcaaacaccaatgtaaattcccatccgcatcatcagtcggtgtcgcatttaaattctaaatctcttaaattcaatcaaacgaaggaagtgagcagcataaatgaaattatttttccttccagaacgtgtacaaagaaacggtattttaccaagccaattgatttgtatggtacaagaagtagcactagtgtggcacctaagttgacgaattctcccacgaaatcaaaaacaaatttcaacatcaagaagtgcatcttacctaggtccgtcgttaccacatataaattaccatctccagtgcacgaaacgatagacgatatatccaaaaaaatcataatcctgctaatttcgttgaagtttgagaaaaactatcacttcttgcaacctattcaattgtccacaaatagtaagacacggatctcaaaatcactagacgaattatgcggagtgcagctgacatcaacgttacggcaacaaaagcagctgcaaggtaacagcaagcccgtaaagaatctccctaattccaatgcgaagcagagagccggggccagtgtttccacaaatgccaacgaaagctttgaattgagttttgatggaaaggcaatggatagatctgatatatttcgaatggtagattcttttagcatcgccatttcagatgaagatgaggaagatgaggaggaggatagctttcagcagagaagtgcgaacaacagaatcctccctgcggagatactaagtaatgaacctttgaaatgatacggattctctgtattctgtctatagtatttatataccaatacatttttccgcactttgaagttttgcattttacttaatgtagtttattattagttgccaaaacgaaacatttaacatgtgaattaaaaatacaaaaaaaagcctattaacgatctaaatttatgacaaaagacatataattattttaatgatgcctttgtcacaaccgaacacaatatctttgaaaagtgatccagcaatcgaattcagaattcgttgtgccatttttgccttacgtttgcgccattgtaatttctctgtgccgtcttctcttcactttatttcaatattatcatgcagtaaacaagttgcagaataataaataatatacgtaccaaatatgtgaacaactcagatactattcatttgatatgttaaaagtcctgcattcctctcccgacattatatataaaatgctcagccaccccttcgttgcacagaaaaaaaggatgacctataataccaatattcaatcacaatagttataccaaactaacacatggttgaagcagactacttactatcgtggagttagctcactgaaaatttaatatttacagcattaaacagttttttcttttgttttgtctcctacattaatttcaatatggatagccaagtagaaggcaaaatatccccctcacagaaggagtcctcctccacctcaggcctcgtttcacctagtgaagatggcccagcacatcaaaaaatacacagagaccaattaagtgtggatcaaatcaagaaaatcagagaagaacgtgctcagaagagacaggtacgtaggaactctctaatatcccaagggaaggaccctgacttcccaacgcctgacttacaattcattgaaagaccattcctccctatcaaccatgataattcgaaaggtcttacgccagcgaccatacaagtcacccaagattcattggacgttaaaataatgacctataatactctagcacaaaccttgattaggagagattttttcccagaaagtggaccagcgttaaagtggcataagagatcaaaagttttggtccacgaattgaaaaagtacaggcctgatgtagtatcgttgcaggaggtcgattacaatgaactcaacttctggcaggagaatttccataagttagggtttgatgtgattttcaaaaggcatgaagggaaaactcatggactactagttgcatggaacaataaaaaattccagttagataatgattggatgctggactacgataatatattggcgggaaatgtcatttcagcaagaacaagaactaaaaatattgcccttattatatcgctatatttcaagggtataacagattcatcatcaagaggaattatcgtcgcaaatacacacctattttggcatccctttggggtatttgaaagattaaggcaatcttacttggttttacaaaagatccaggaaattaaagcatgttccaaatataatggctggcatagcctactgatgggtgatttcaataccgaacctgaagagccaccgtacttggccataacgaaaagaccactgatattaaaaggcccaataagagctatggtggaatgctcactagcgtatcggtattcaaaaaaaaggaatggagaagaaagtgaccaggatgatgaagagtgtgatgaaaagtctaggggcgaaggccattcagatcaaccacaaaacccaaaaccagagagctttacagccacaaaggaagaaaaggctctggtaaatcaattagttgcgttgcataattcactacatgtgaaaggcgtatctttgtatgggattggctacggtaaagtgcatcctgaaaatgctaacggaagccacggcgaaccgggactctcaaactgggccaatacatggtgtggattattagactacatattttatatcgagggtgatcataatcaggacacgcgtcagaaagagcctctgaatgcttttgaaggaaataacaacgtaaaaataatcggatatctgaggatgccgtgcgcacaagaaatgcccaaacactcccaacctttcgagggagaatatgctagtgatcacatttccctaatgtgccaaatacgcttgttttttgggggggagaaagtgcatagcttaaaataaagaaacaatatatataaacaacctacatttgtgtttgaaagacagtaatcaacgcttcgatggtcactgggatttttctttcaatttagcgtcactttcaccttattcacagcttttacgtgctatttttggtcacccttcccctttcgttgcgcctcaacgggctaaaaaaaaaaaaataaaatcaagcatagaaacaccacaacaaacctgccctttttccttgtttcaggttacgtgaaaagcatccagagaagatatcccaaagactgaagaggtgtagttggctcattcacgtcgttcgtttatattatcaaggaaggggtttttgatcggctcgaacaagactcgcaagaatccgttttctattgttttttttgaggattccaatatgtcaaattccaattcaaaaaaacctgttgcgaattacgcataccgtcaacagcaagattataatgggatgaacgccatggtgggaaatccaatgatgtatcatcctgttgatttcgtaaacggtgccggccaatatggtccttctcaacacccagcatattacaccaactcaccattacctaatattccaccaacaccttttgatactgcatacggtgccagtctttttccatctcacctattgatgggatctccatttgtttcctcgcctaacatgcaaagtggctataattctgcaagatcatctaatctcaaaagaaaggcttattcgaggcccgtttctaatcataacggttacaacggaaacagtaacagtaaccaaaacaatactaataacggaatggtaacaccctcgaactattatagaatggggagaaattctttctcgaggaacaacaacagtacgaggaatgttactcacaacaacaataaggggtgcgacacccggaacaacagtggaagaagaacattcgcaaggaataacattttcgacgacatacttccagaaatgcttttacaaagacccttttgtattaattacaaggttctaccgactggtgatgatgcttatagaactaggtcgctgcttattgaaaatgtggatcattctattgatttacactctatagtcaaaaattttgtcaaatccaatactctggaaagtgcctacttaattgaaggagggaagagcgatgattcaaaagatgtagagactaaaaatctatccattctaataagctttctaaccaaaggcgactgtttgaacttttacaataacattttacaaaggttatctgaattcaaaacatttttgaaatctgaagcactaaatctgaaatttgtttgtctaaactatgatcccaaatgcctccctacctttattgagagtgaagcgttaacagaaaacgctgaagaagccgacattaccaatggttcaacaatgatcagtgcttcgctgcatcataatatagcgaacaaagatgctacaaggtcgattataattgaattcaaaagccccgtggagaaaagcgatttattcaaaaagaaattacaatttttggacaggtcaaaaaacaaaagatacattttggaatctatcgatttagtgaacacagatgtaccttccaatcaatttcctgaaaattacgccgttttaacctttttgaatatctctatggctattgaagttctcgattatttgaaaaaatactccaaaaacttaggcatttctaaatgtttttacgtatccctagccccgttggtagttagctcagccagatcttcggttgctaatatttacgagggtaaaacgagcacacatcgtttatcggtgccttctgttactgctgggaacaataacgatagcaacaacaacggaaacaataataaaagtaatatgagtggtatcaccacactcaataataatagtagtattggtgtttccgtatacggtcactctaatatgagtttaaccagtctgtcatcatctgtatctttaaatgaagagattgatatgcttgcgacgaaacttcaaggggtagaacttgatgggacttatttagaaatcaactatcgcgactatcaaacaccaactattgaagaacactctactcacttgagcaatgtcaaaatttcaaagacaacagaaaactctaggcaattttctcaagatatcccatcacctttgccattaaatgaacatatgtttatgaatgattctaatcagtccaatggagcgataatacctcaacagttaatagccacaccttctccggtatcccccaatttgcaaatgaatcaaagggtgttgccgaatccaataactcaaagtttggagcaaaatttcaacgtttcggccaaagtggcatcatccatgggttcagacataggcaatagaacaatttatataggaaacattaatccaagatcaaaggcggaggatatctgtaatgtcgtgcgtggaggaatccttcagagcattaagtacataccggagaagaagatatgctttgttactttcatcgaagctccatccgctgtacagttctatgcaaattcatttattgatccaatagtgttacatgggaatatgttgagagttggatgggggcattattctggtccattaccgaaattaatctcgttggctgttacgatcggggcaagtaggaatgtctacgtaagcctaccagagtttgcatttaaggaaaagtttattcacgaccctcagtacaaaaaattgcatgaaacactatctttaccagatgcggaacaactaagagaggactttagtacctatggtgatattgagcagattaactatttgagtgatagccattgctgttggataaatttcatgaatatatcttctgcgattagtcttgttgaagaaatgaataaggaatccacagtacaaaatgaatccggtgaagtgacgcttaaaagggcgactgaggaaaaattcggtggccgttataagggccttctgataaactacggcaaagatcgttgtggcaatataaacaaaaatttgatagcaggtaaaaattcaagattctataagaaagttaaaagaccgagctataatatacgtttgagtaagttggaagaaaagaggaggcagaatgaaatcgatgaaaaggaaaaggcttttgataaacccttgaacttggaatccctaggaattagtctggacgcacataaggacaacggcggtggtgaaacaggaactgcaaataatactgggcatgaaaatgaaagtgaactagaggctgaaaatgaaaacggtaatgagactggaagtttcggtggactgggtctcgctgtggcgagctctgacgtcaaacgtgcgacatcggatgaaactgattatgaagatatatttaacaagtcatcgggatcttccgactcgtcatcagacgtcgaggtcattatgcactccccgagcgatcctgaatacgctttaaaatcacaaactctaagaagctcgagtcagaccgtcattaatagtaagagaccagtaaagatagaagacgaggaagaagccgtaggaatgtcacagctcaattataggtcgtcattaagacaagctcctccaagagctccctcaactttgtcatataatcactcgaagaacaacgaaacgccaatgcaagatattttcacaaatggcgaaacagcaaataacagaaagaagaagagaggatcttttgcaaggcatagaacgataccaggatctgacgtcatggcccaataccttgcacaagtgcaacattcgacatttatgtatgcagccaatattttgggcgcctctgcggaagacaacacgcatcctgacgagtagtatagctgtgctgagcctgaagtataatgcatatccatcggactatttagacaaagcccaaggaagcctaaggcggcctgccaaggtgtttctccctttttttctccgatttctttgtataaactaaataatatagtgattactaatggaatggcggtattatgcacctaacctgttcattctgccacagattacgtaagcgatttattgccggcacttgttgtcttaatgaccgagtcaccaatgtggaacgataattttctctgactcaaacctgttaatttttttctacttcgtttcgttagcgacgacgtcaagccgcaggatcctgtctgccttgacctcttctctaccttcagaacttacacttttcaggtaagatgacctttatataaaagttgacactattacagttgtttataaacgtctgaagaatgagacgtttttataaaatgaataaaatgcatattctaagtttaaaacaacattttcaaagtgtacgattgtaaaaagagaggcaattagagaatctcaaacaggtaataataatgggcaatcagtcattagttgtgcttacggaaagtaagggtgagtatgagaatgagacagaactacctgttaaaaaatcgtcacgagataataatatcggagaatctttaacagcaacagcttttacgcagtctgaagatgaaatggtagatagcaatcagaaatggcagaacccaaactattttaaatatgcatggcaagaatatctttttatattcacatgcatgataagtcagcttctaaatcaagcaggcactacacagactctttcgatcatgaatattctttcggacagttttggctcagaaggaaactcaaagtcatggctgatggcatcttttccgctagtttcaggctcatttattttgattagtggcagactaggtgacatatacggattaaaaaaaatgttgttagtaggatatgttctggttattatatggtctttgatttgtgggattaccaagtattctggtagcgatactttttttattattagtagagccttccaagggctagggattgcatttgttttacctaatgtgctgggaataattggtaatatatatgtaggtggtacttttcgtaaaaacatcgtgattagttttgttggtgcgatggcccctattggagcaactttaggttgtctttttgcaggactgatcggtaccgaggacccaaaacaatggccatgggcattctacgcgtatagcatagccgctttcattaattttgtgctctccatatatgccattccgagtactataccaacaaatattcatcatttttctatggattggattggttctgttttgggcgtgataggtctcattttattaaattttgtgtggaaccaagctcctatatcgggttggaaccaggcttacatcatcgtaattttaatcatttctgtgatttttcttgtcgttttcatcatttatgagattcgatttgccaagactccactattgccgcgcgcagttataaaggatcgtcatatgattcaaattatgctggctttattctttggatggggctcttttggcatctttacgttttattatttccaatttcaattaaatataaggcagtacacggcattatgggctggtggaacttactttatgtttttaatttggggtattattgccgccttactggtaggatttactatcaagaatgtgtctccatcagtgtttttgttcttttctatggtagcattcaatgtgggctcaataatggcaagtgttacaccggttcacgagacatactttcgtactcagttaggaacgatgataattttaagttttgggatggatctttcatttcctgcttcttccattatctttagtgataatttaccgatggagtaccaaggcatggctgggtcattggtgaatactgttgtcaattactccatgtccttgtgtctcggtatgggtgccacagtagagacacaggtcaattcagacggaaagcatcttttgaaaggctatagaggtgctcagtaccttgggataggattggcaagtttagcatgcatgattagcgggctttacatggtcgaaagcttcataaaaggccgcagggcaagagctgctgcagaatacgattgcactgtggcttagcggaaagcggttattaaggtaaatagatagaaatacaccgctgtcatgcgattatatagacatggggcatttagacactgaaagtcttcatatctcaacatgcaactagtaatagtacaatttttagtaccctttaatctttattgttcgctccctaataacgaagccttgaactgtaaccagatcccaggttaccccttatccttaagaggtcttttatttactctacataatatatatttttcaatccattgaagaggattaaaagaagaaaaatcaataccgaacaaaaaaacaaaacgaaataaaacaaaacaaaaaattaaattaaattaaattaatattaaatgtcatcatgattcttactctgattgtcttctcttctctctttcccttgacgcaatttccttcaaatcgtcatcgctcggttcataaatatgccaaatagtataatgcggtaaaccaccaaccctgtaccccattttctttgccattttaccaaatgcttctgtttctgcatgattttcaaaagtaaatgcaggaaactgtaccccgtttctaaatattttggccttcgccaaaatagaaactccccctacaccgtccaagtccaccgcttcatttggatcaccttctgcatctctgatataggctaagtgaactctccacgtaggatattctgcatagccttctacaataacatcatcttcgtcaagagtctttgccaatgctagtgcctcctgagattccatccaagaattcaaatcatatggttgttcagttcccaaaaatgtaggtagtggtctccaaacgttagggacgataacatcgtagtttttgctcatcaaatcttgaatgactgaaccagggcacagctctacatcagcatctctccaataaacccatgagtggtaaggtttcaaagcattggcagttaaccaatttcttgccctccccattagttttcgtcttataccttgaaccttaacggcatgtctgtcactaaaaccttgtccaattacttggccaaaatccttttggaaaatttgtactgatctaaatggcttgtcataattttcatggaatggtggtgaaaatgcctggtggacacggttgatataaccttcgtccatatatttaagatataatttatcggtgccttttgtttgcgaatcaatgacagcgtcaatctcttgaaaaatctgagacaacgtgccattttgtaagtgcctagaatacgctattaaagcatccaacgtagtgtcaccttctgagcaatcactgactaaaaaggccagatcaatcagctcgtgtggataggttaggttcattaaatgcttgaacattaatggcaatacatccgcagcgtttcttagtggaatgcataaaagaatgtgatcacgtgtttccaatccattcggagcaccttcaaaattcgacaggtcgtactcctcaacagtggaatcaaaaagcatgttgagttccctttggtatttttcatcatccttgggagtcaacacttctgaaccaaattgtgatattagataatgttgcacaccatcatcaaattttgaaatcacttcaggatcgatatcctcaaaatcatagtcgtaatattcttcatcttctaggtcgatagtcttgtaattttcggaggattttgaggaacccaacaacgacctaccattttgcgtggatacaccaatgcccattccggagagaaatgatataaagagatataacgacagaacggcgataataataagagatgtgatactcaccgtaagctggaatttagacggtgtggagcgcggctggtacctgtatttgccctttaatgagttggagttatgctctgagcgtttgtccttgatgttgttcgagctaccgttccttgaaatgggcaggcttagtccattgtccatggctttcttctttatatttgaccttaaattaaaaaacatgcccatttttttgtgttaattggtaggtcaacaagctcaaatgactgttactgcacccttacgtctacttctttcacgttaccatttactaatttacaagacgtaaactttctttgattctaaatatttcaagccttgtttcggtatagtcgccgaagaacgaaaaaaaaaaaaaaaaaaaattcctctccggagataaattgaatacgtattattatattagggacaaacactggttcactgaaagcagttgtttacatagttatatcgtgatctgtggctatatctgcaggaggagatgtcggggcgttttcattaggcgtcgaatgaggagagtgacttgtagtagcatcgatattggttgtgttatgtgctacaggtgtagtatttgtagtatcttgcgctgtcattgttggcggttccgattccgcgaccaggttctccgcaggcatactcgacatttcattctcatcttcactgctccctaagatgccaaataagtttatgtcatcgtcctcatcctcggcgtttgtgttgataactatggtagagttgtttaatgcattaggggtggtcgtgtcgtctgcagcgtcccttgcgtgctcgttatttagtagaagctcaagatcatggccttcatcttgttccctctttgttcgttgtgaaataagctcttcttgccgacgttttagcgattttgctctttcttccttggccattcgtattttttccttcttcaacttctggaccttaggtaaattgtgcatgaatagtgtcatagacttacgaaattgcaattctatggttttttgtatggttttgtgagactggtgaggactctctggaaggtagagagtttcagaaattttcaagaatggattttttgttcttttcaactgattcacttcaaatttcgtgacacgttctctcgccaattccactctatacttcgcatactgctcgatattgttttcattgaaggacttttcagttatggttggtttcctttcttccagcgcgttgccccaaatctccaattgttgctcgatagcgtcctcatcgtctaaacccggcggttgcggggtatttgacgctgatgatatgtgggagagacttttgttcaagttcaatagtgccttttcagactcttggctttcttttactatttctttcttgatggtttttagatcagtaattggatggttgaactcaggtgtaaacttataggtatggtcaggcggaaagttgggcagccaactcggtatctgtttttccagtgggttagagggaggcagcaaaacgttgatctcgttctgttgctcctcgatattattcaattcgtcctcttcatcttcttcgttatgcggtaaagcagcaagagacgaccagctcatcaatttttcatattccgtggaatgcttcgatttgatgaattctgaggcctgaaactgctgataaagggagggcgcatccaggttaaactctcgaagcaacaatttcaaatctgcttgagaagcttgcgaccttctttgtaaaagtgttaaattgtgcaggttccgaaacatgccgtccatttggacggtcacgaggttgaccagctcatccaatgcaaagtttgaaatgcagatgttcaacgaattcaactggaaaagtactgttttctttagaatttcaactacgggagcatctatttccaagtgactaatttccgtcaaatccggtaggttcctcagctgaactatggtactttgggtaccggtaccactttctgacgttttggaagtcattgccctttatgagtccctcaattacacgtttgtttgcttgcttgcctctctctccattgcttttactctcttttttaaagagttcaagattttctacataaaagcatcgggtaacactcccatatacaccatttgtgcttaagctggcttctaccagtcgcgtttcaagcgactttattgatcgcatcagcgtagaacaagaacagaactatgtatgcaaacaggactaatcatcttcagttatcttactttagtttgcaactatttatatcatgttttcttttcaacttctttttttttttttcgtttatgaagccgatgctaatgcatcaattttttttttttggtgatgagttttgaaagaaaatgaaaaaaaaaaaatttctattattgtcagtggagtttttgaacagatcaccttgtgaatctacaaactgtcctaaagtatattggagcaggacattgggtgatggcgaaaactttggcacaaggaaggaaacctggaagcggcagaaagcccggaaaagggaagacgttgagagagggaagaaagcctggcagtggtaggaggaggaggcaagatactgggggtaaagagaccgacgggtctcagcaagatcaggagtcgcgtcttattagttccagggacatggaagctgtggacgcactgagagagttgacgcacagcccgtcgtctcactcagctcataattcatcagcagcaccaccgccgcatgcagcagcggcgtcaacttcattgcctccatctctggattatacccatcagtcattcatggatcaacaacaacaacagcagcagcagcagcagcaacaactactacagcaacagagagtggacgtcgttccgcccaagccgttcatcacccacaagatcctgttatcttcaacgggaaactctggcggccacgtgaattcaaattacaacgccgaccacagcattaatcataattcaaaccacaaccttaacagcaacgtgaacgtgaacatgaactttactataaatgggagcaatcaagacccgtcatcttctttcctgatggggccctacaactacttacagcggcctttcattgtgaaaccatatcttgatctgtccacaagcacagcagcatcaaatcagccacggacgcaaccatcgccggcagcacatatcactaagaattccgattctacagagaaaaacgcaaccatatgacattcatttccagcataccactaaaacattcgtatatgccacataataactagttgagaaaaccatagatatttatatttatatgtatttgtacttctttgagcaatgtatatttaagactgatctcaacttcagcaactgttcaaattcactgtttttcctaattaagcacaacatgaaaaactagaattttagaaagaaaaggaaaaagaataccagatggtagttaatttctcacaaaagcactgccaggtaaaggtatacagcaaggatggactctcttgaagctagattacaattcattcaggtcctgaagaacctgcaaaagacgctgcacaagaccagagactctatcacatcatcgtcgaccaccacaccaccgtcatcgcaacaaaagctgaacaatgaccctatacagttctacttgagaaactacagacatcactacgaggacttccaccaatgtttgttcgatacaaccatgaagatggacccactagatagactggacgtagtgatatactatgttagaataataagaaacttatatccgcatagccattccaataccaatgttacaaaagtgttaaacgaagtgctactcatggacatagacttggtttttgagctttgtctgccctgccaggactggaaatccctcacgaatcaagccacctgtaaagagctattccttgacttatccaaactaatccattacgacgccaccagcgtcacgcacacaccatcagacaccacactcatagacgctactacctggtacagtgtcaagacagagaggactacaaaggactataaagaatcattgcaacgaacggagtctctgcttaaggacagagacttgaagaaattggctttctttcagcagttcaattccgatacaactgcgatcaacccggacttacagacgcagccaaccaatgcaaacattttgttgcacaggatggaagcagacagggaactgcacaagaggtcgaaagagacaagttggtacatcgaaaggccctccaacgatatactggatgaatccgaatttaaaagcttgtggacgcattttgaaactactgattccggatttgataaggacgattacaaaaatatcaaggctttaaatgacattgcgaaggcatcttacatatattagtaccatgacgttatatatatatctgtgaagagaatccgtatctgtattatatatacgtatatacgtatcaatgcgcgtacaaaatgaacttgtctttttcttatctcgatttcaggaaaagcaaactattcaaggtgaaacggcggctaattttcctctaagttacttttattgtagtcctcaacatgtgcagacgaataaacttaacacggtttgcagagtgtgttgttgagtataaaacagtcaatttctgtggacctggccgtagcctattgctgaaaacacacaaaagaggagtttgacgagacttaaaacaagccaaggaaaataccatgttagactactcccttcattcgatggttttacgccgcatttctacacaaatgaatttacattcgggctgatatggttgctacataagcgaatttaaaatttgagaaggttcattgttgccttgtggttcgagcttaaagatcataaagaaccgcggggaatttgtctagttacaagctggaaaggactgagcagaggaagagcattcgttcacagagaggtccacgatagaaaagtgccaagaatattacttctttcacatcaaaaatgtgtgacggttcctttgcacgttgaagcgttatcatttttttatgtatatacggcaccggtttttcgccttttcctgttcgtatatttatagtcgccccgccattgctcgccctgttcctggtagtctaggctctttgcatttctcttttggtgatttttattttttatctgccgttaccaattaagaaaaatttctgaaatcgtccaacagatatgcgtaaagcaaatattgcaattatcattttgtgcataacttaccaataattgatttctgtttctgtaggatttctcgacaagaatctcaacttcttacccgttttggccaaggactttgcaactgaagcagcagatttgagatatattctggggaacaaaagaagtattaatgacttttacattctccacttcatcaaggaaaaatgggagacctcctttaaaatcagtttctacggaagataacattcatctattgaggaagcggcgtcaacagcagctgtcaagtaattctacagataattcgctgcatccaaatagtgggcagactccacgtgcaagtgacagccaggacgatgacatacgcagcgcttcaacaaccaatttagaccgtttacgacaagaacgagaggaaaattcactggaaatggactgcacacagtcaagattatctcatagagcaaatatgctagtggatgtcctaccatcttttgagatgtataatgccttgcacagacacatacctcaaggaaacgttgatcccgatagacatgatttccccccttcttatcaagaagttcgcactcaaagaatgactatattgcccagcaatgataattccgtggaaaggtcacaattgacagcagtgccaggatccgaaaacgcatgtaataatgcgactgcccattctcttaccaacctacatcctctacaaacacaacatcttacaataaacagtacaagaagtggtggacagtcgctccattcttcatcagacaccaatatcagtcaaataccgttcgaagatgatctaaacgactcggataacatttttatagacaagttatacaccttacccaagttatccactcctatcgaaattgatataagaataacgaaaactgcatcaatacctcatgagcgtcctgaggaacagtcaatattgaaggaatacacctcgggtgatattattcatggttattgtttaattgaaaatcggtcctctcaaccactgaaatttgaaatgttttatgtcactttagaagcgtacatatctgtaattgaccgtcagaaagggaaaagaacgttaaagagatttttaagaatggtcgatttgagcgcatcttggtcttatacaaacataaccccaagtacgggtattaatattgtccccggtgaaagggattttgacgatgccatcattggtctttcaaacagcagagaattgaagccgaacacaaagtataagaaattcttcatgttcaagcttcctacacagttattggacgtgacttgcaaacaagagcaattctcacactgccttctgcctcccagctttggtatcgacaagtataaaaataattgtaaatactctggcataaaagtaaatagtgtccttggctgtgggcatttaggtacaaaaggttcacccattctgacacttgacatggcagatgataatttatcaataaattatacaattgatgccaaaattgtcggtaaagataaaagaacatctaagctgaatattatgaaagaaaaagaatataacttgagagttatgcccttcccctttgctggtgtcactaatcaacaaaacgagaaaacgtgtttgagacaactgaaaaatttggaaagcttgattgaagatagatttgaagctttgaacaagattttcaagaaactggaattaaatgaggccatttcgaatgtagatattcatgacacagatataagcgggactttggacggtaatgaagatttggattccgatgagatattaagacgtaagctagatcaactgcacatcaataacaggattgatgataccgccagccaatcaccatcctatgactccaaaaatatggctccaaaggaaaacctagtcgagactgagttacgctataagtttaaaaataagaataaatcaaattcaagtttattttctcattttttgagttcatcagaaacggggtcatcttcaactggtccacatgtatataattccggattgattgtattatcagttaaaaaaccgcaatctacattaccttattggtcaccatcattgttgagaaaaaccaacaaatttgaagcaaagagtgaacaagaaaaggaaaactggcaaaggttaatgggcatgcttccagaaggagtgaaaaccccactgaccaagttagatgtacatttgacttgtatccaatctaataatagtgcaggacataagccgccagaaataagctctgtaacgacagaatttgtggtcatcacagcaaagtctgataattcgattcctatcaaattctgcactgaactgttgatgaatgagaatagattaaacaaactaaagacaaaatttttgacgtatcagaaaaaagttcatgaatatcgtaaaaaatttgaagaaaaccatgcgaagctaaacgagctttataatagaaatagagatcatttcactccaaaagagcttttgttcacaaatttcatatctgatcaaataaacaatgatattgacagtttagctggattaaaagttaacattattgatttacatgatatcttcaaaaagcaaatacatacttttgaagaagaaaacgaggatattatttcgaagaaaggaagttccaatcctccttccgcgtcatccagtaataataatttcttacaagcaacatttagcaatggtgcatccaccgctactaagtttactcagcaaattgtgcatgaatgggaaaaagttaagccattacagtataagagggatgttacagttaatttgaagctcaaccccaacattaaagaaacgttagtgcccaatcttgaaacgtgtttgtgttgtagattttattgtgttcgagtaaacatcaaatttgataaccacttgggttctatgaaagttgatattccggttgatgtgaaaaagttacaaatttagaccatacaacactaacagtaatctcgcagttttacaaataattgataaaagcaggactattttttaaccatttaatatacctattactattaatatcattaatattattatattatgtacagtcacttatttctttttttttttttctttctttctttcgttctatttccccctagtatatacgaattctgcacatcacagcaaaatatatggctatcacatggcacaggtattactaaagaagaagagagacagaaatagtataggcatgttttactagcttcgattttcttgacaaaaaaaaaaggaaatttgttctatttactttaaactttaatgccccaatggatggcacatataccaaaagttaaactttcgtagccagcagatttgaatcctgccttctcaatcatggatttgaacgtttcttggtcaggaaatctttcgatagactccaccaaatactggtaagagtcgtagtcattagcaatcatcgagcccattacaggtaggaccttagcccactgttggtaagcaaagtccattaggggattctcaattttggaaaattctagacaataaaaaataccgcccggtttcaaaactctataagcagtgtttaaacccttttgaatatcggtgaaatttctgataccgaaggagactgtgtagatgtccttggaatcagaatcaatctcctctagtttctcaccattagaaaccaaaaatctcacacgaggatccttgaaatattttccttgttccatggctctcttctcaccttctttaagcatgtcagggttgatatctacaatatccattgtagactcagtgtcaccaaatttcgactcagcatggtctagtaatccgaaagcaatatcaccggatcccccagccacatctatgaagttcaaaggagtcgtagagtttggcctttttcccgcatctagtttattgataaaatggtccttccacaatctatgaattcctaatgacataacatcattcatcaagtcataccgattggccacggaagaaaagacatcaccaactaacttctgcttggtagacttcaatacagtcttcgaaccaaaatgcgtatacttctgctctggctgttcagctgcggatgataaaggactattaacttcttcttctttgcatgctctgtgagcttgcgtaaaacacctagataatcttagcgggacatttaccagcgagcttcgaacgatccgtgaagaaatcaacattatatctttcttgctgcgatctgtactattccctttgcaattgtaacagcagctgtataaggagtgaaggtggcagatatccttatagtttcttgtgtgatccttttttttccactttttcagtttttgtcaaatgcggaagctagtttccatattagggaagagcaggcaacagggcagaatcctatacggaaagactttcatttaatgatacatttgccaaataactgtgttccaatatcgagaacagaactatcggataccttgatatttgctcaatggtgtcacttcccgtttttgacatgtactcttcccaattcagaaaaattctcgcacttttcccacagagaaaaccgcaaaactcagaaatttaggctgtgtatcgccgatagtatcacggccggtttatgcttgatttggctgcaaaatggtcacattggacctagaagtggccttttgtagctaattataagtgcatgattattgtgaccagtaacatttgctgacgcgttgtgcgggtagcacacgccgcgtcttatttttgttttcatctcatcttcgttagatcataataatatgattgaaaactggagtaaaacgctaaagaacagtgtcaaggttagtagtatcgtatactttacattgatcacgtttgcactatagactgaatttaaattagaattttatggtactgatggaagatatgcaaaacaaagatggccataatactgtagaaaacagtagtggtggtacggacagtaataataatattcaaatgaggcgaatgaggaagacacagctgtccaagaaggagctttttgagaagaggaaatctgacgtgttaattgctgccaagtctttagatacagaaattcagaatgtgaaaaatttgaagcgattgtcgattggttcaatggatttggtaattgaccctgagctagagttcaaagtgaacagtagaaactcatattcttcagattcctcaaaggaatcccttcaagaatcgctccatgaagagaacattatacgatcagaacaaaaggaagaacaagggagcgaagacaatgatgcatatgaagagggcgatgctactaatgtcgacgacagtatagatatcactcaaacagagtatttgcatgatgaagaaacattggagaaggaaaaaatcatccgtaatgcttcttcatccacttcatcttcagcaagagtaacgtcgaggaacagaaggctcagtggagtaaagacattggctcacgatgttgtattggatgtggagaacgaccacgattcaaaaatggttgatttaactcaaaaccttttgtgggtgcccgctgaccaacatcctaacgttaagcccgaaaactatttggaattgatccaggacactttacaaaacattcaaataagcacaaatcaagacattgatgaaaacaaattagaactgggtaacaatcatgtaatttcgaatagaaaacgcacgggctctgtagttagaaggccttctcggttgaagacatcttataccaagtttgatgacgaacctccccttgcagacaaaccacaagaaggagaaatacaagtggataagcgaatatcctcatctgacatcaaaaccataagatctgtatctttgaaagaaattactgaagagcttactaagatttccaataatgccggtttaacggactcagatgcggtgactttagccagaagcttgagcatgtcagggtcatttaccaacgaaagtcttcatttgaacggcaatcacactgaaaatgataacgaatttgcatcaaatatgtttaatgaaactggacttaccataccagagagatcttctctaaggaggtctaaattcaacacatataagatcagactagagggtagtagccttccacaggcggtaaaactcaatagcctaatgaatatacaaactaatgacaatcgcagaagtgcatcatcgcctgcctcctacacacaagtgcctcaggagcaagcatcattgaatgattttcacgagattttcgaccattacagaagaacaagtactgattggagtaccgaaaatgagaaatacgttgatagcaccaactactattcggatgaagaagatttgacacatgcatctatttctcaagagagcagtcttttatctacagatagttctaacaacagcgttttaataaagccgcataacactggttcgatgatttctgaaaaattggatcagcacgttagctcgagtgaaaaatcaaataccaataacagcgaagcaaatcatggctggtcatggttgaattctagcaatggaagtttgaacgctaatgaacaaacttatcaacagcttacagatgatgaagacgatgaagaatgtgtggacaatgaaaaagctgactttgttaacttgagtgtatcgaggagagcgaaatctaccaaacgtgcctctgaaagaataaaccattccaaaaatagacattcgccaattttccagatacattctgaagaagcaaaatccgtggtaatcactccttcagtcgtttcttcatctgaatcccagccatctaagcctactgcaccggcagtcgtggagaaaaaggtagaactgcctactgacacccaagccagtacacataagaaaaattccttggagaaaaggcttgccaaattattcaaaagaaaacaacataatggtacctgcaaatcagatgtgaaagtaatcaaaaaaagtgttaaaaaagaactgaaaaagaaggcttcgcattcgagtttatcaaaattcaggaaaagtcccaagaaaaagccccaagaagcggaagttgaacgcccttcatcccccaccaaaacaattaccaccgaagatatagatacagcaagcgtcattgaaccagaagtgagaagttcaaatgcttccacccttcttcctgacagccatactagccacagttctgaatttgtggtggaaactataagcgagttagatggcgacgattcatttgatattagtggtggtgatgtaaactacgacgtcgaagtgcactctagtatcagtagagatacgacagctggactagaagaggatataggagcagagagagaagacaacacttcacctactgcccctcaaatctcaactttgcctccaagaaaattgacatttgaagatgtcgttaaaccagattactcaaacgctccaataaaattcacagacagtgcttttggattcccattaccaatgataaccaactctacagtgattatgtttgaccatcgtctaggaattaatgttgaaagggctatttacagactcagccatctgaagcttagcgatcccgggagggaattaagacaacaagtattgctaagtaacttcatgtactcctacttgaatttagtcaatcataccttatacatggagcaggtgggcactggagatatagccttcaatggtgattctgccttgggaatgatggacaaaaatgattctgatggcacaatcttaattccagacatttaactcataactgtttacaagattgatagatacctatataaggccacatatttcaagtattgtaaggatgcccttttagtgtcaaacttcttattatcacgaaaaacgtcgtcttttcatgcaaggaaggactacagtatatacatataaatatatatttatgtaattatttttttctttttttttaaattttctagcgagaatgaagaaaagccgacctcatctcatcctatttggaacaaattcgaatgatctgtccaatacagcaaggctaccttgcggttgaattctatctcgtactacactaagacgaaagagaaaaacgaaatgtccaagagtaatacttataggatgctcgtcttactagaagacgacaccaagataaataaagaagatgaaaaatttttgaaaggtaagccgggaaaaatgcatgaatttgttgacgagttgatacttccatttaatgttgacgaactggacgaattaaatacctggtttgataagttcgatgccgaaatatgtataccgaacgaaggtcatatcaaatacgaaattagtagcgatggtttaattgtacttatgctagataaggaaattgaagaggttgtcgaaaaagtaaagaaatttgtcgaagagaataactgaaataatgatgttgcttcggttttttgcatgaatataacgtgactgttgcgtatgcatatgtgcacgtaatttaaagagagagtgacagaatctgcgcatcagcatgggggcatatacaagcatatgagaatttggataatgtattacatctaatttataaagtttgtagaacagcctctaatttatttagtctttctcccacgcccaatttcgttattagtttgtcctccttgccgattaactccagcaacattgtgggcaacaactctttgttgtaataccgacaccatagagcgtgtccgttaaattctgtatattctaacttcttcagggatgctcgatgaaagcaagccgtgcattgaaccagatcatccttctggaatttcgtgtagccgagaagcaacagacctacgagagaatagtctttacaatcgaaaaaaaatgccaatttttgtatttctttctcagacaagtaatgaaatatacgggaagagtttcttttaaggctaaattcatttgatccggaaacaattctgtcaatttctgtatgaattctttcaatttcccttataaggttttgtgagcttaaataatactctttgtttaaatcaacctgattttccctccacggacacttttggagatgatttccaattatattggaattccagattttttcattcaatttcatggtgtaatcggcgacatcatcgccattttttaataaaggaattgtcataatggcatggcaacaacagcacttaaatggcacttgcgactgggatgcactttggtacggctcccagcccttggatgctagagtcagtggattgacccatcgaacgtcccattcaatgagcacatgccttgtgtagttttgaatggagcatattcttttcaacaaggcccgaagatcgtgtaatcggaaaccaacaaaatgtttagagctttcttgtaccaaatcatcatacaattgcacgtggctcttacatttttcaggcaacattgaactgccattatgggatttcttcttgtacctccatttggtaataagtcgctctcctagagtattcctatattttcccggtaaaagtttggtattcttgtccagcgaatgtctaatagacttcagtctaacctccaatgcgtccttttccattagtaactgccctactttcctgtcaattcctggggaataatgttttatttctcctttaccatagatttcaagatgacagttactttcgttccgaatgactagcgcttgaaaatttttcaaacattttccatattcaataagcaaaacaaagagcattttgatttgataacaattgtttggtagtttgatctcatcatcaatcagaggtttttaacaaatttattttttgaatacatttcaaaaggaaattgcattttgtctttttttttttgggagaattttgtggggtatttcaatcattgttccaactttacgttccttttttgaataaagacacttcttattattaacaggcttttatttgtcaaataagattcattcaaaatttccataaagcattacttctgcgatatactactaacggaattttggttgcgtattattgtgtctgacattgtatgaaggatacacaaaaaaattaaagattaagaaagttattcaaaatgcctattatgttggaagactaccaaaagaactttctagagttggccatcgaatgccaggctctaagatttggttcattcaagttgaaatcaggtagagaatcgccatatttctttaatttgggattgttcaatactggtaaattgctttccaatttggctactgcgtatgcaattgccatcatacaatctgatttgaaatttgatgtgattttcggtcctgcctacaaaggtatcccacttgctgctattgtttgtgtgaaattggcggagattggtggctctaaatttcaaaacattcagtacgcttttaacagaaaggaagccaaagatcatggtgaaggtggtatcattgtcggctctgccctagagaacaagagaatattaatcatcgacgacgtcatgactgctggtactgccattaacgaggcctttgagatcatcagtaacgccaagggtcaggtagttggctccataattgctcttgatagacaggaagttgtgagtactgacgataaagaaggactcagcgccactcaaactgttagcaaaaaatacggtatcccagtcttgagcattgtctccttaattcacataattacctatttggaaggcagaataacagcagaagagaaaagcaagatcgaacaataccttcaaacctacggtgcctccgcttaaaaatcagttttttaattaaatgatttatttatctcttttaagaactattaatcttagttactacgatacatgcacgccgctcatctatatatgtgtataaatagcgtatattcacacacatatatatagagcgagagagttttcttgttacttttttctgtgtttcggtacctcttgcctgtagctgcttcaaaactcttggcttattgaactctgtttcaactacagacgaaataatacgaataattgatttgtcttgatgtaaaaatttaaaagctgatacaacaagtcatttagcacttgatctgaacaaacatcatattcttatagttctgctattataatctattaatatattaatatattaatctcaatatacatatacatatacataaatgggtaaaggagacaatcatcttctaactactttgtacttattttttggtggcttgaacgacttttctgccgctgtaatcttaggagtttcgtaaacagattttgtcattgggtggcccatcaagaacggactatgcagcggaacaatctcattcattttgaatccctttacacgtggaatctttttgaattcaatattgtcgaaatcagggccatatggaatctcccttaaagattcaatagtagttggatgtcttttcatatactccccaacagctttcattaattgcctctttccacctttgaatttagtggctgcgccaattaattgtccattttctttgaaaagtacacgaattctaccaggattaccaaaatcttgtgggtgacatttttcaccttcaaaaatgcataatattcccaattcacggacagcatctgccatagttttagccaaaggattttcaacagccaactccttaggaacccttctcccttccttatgtgatctgtttatgtcaaagtaacatggatagagtacttggaatcttttgacttcttctaaatctttcttcgaaatagcctccgaacgttcaaccttaccagtttttgggttaataaaactcaactgctctttttcgttgctactattgttgttgctattactgttgttattcgtgccaggtaaaaatgcagggttctcttggtcctggctccttacaaccttaggcgttatcttgggagcgatcggcgtcctcaaagatggatctaactcggccaattccatatcaaggtcgtcgatatcattgaaatcgtcaatctcttctaatctaggcattttgactttatgatactatagcttatggcttattttatttcttttgatttcgttagttgctagcctgttgaatatcattgatatttttttttttttcagattacaaaagcgtgaaaaataaatacttcccaattgttttaagaagaagtacacaatttttaaagcggctgaagaagtgtaccaatttatttgctattgtgacaattacacttttttttttagattgttcggtacttagtcaagttttattttcagtcattacatattatgtccaataaaattgcatcaagagcttccaacagtaagctggcatttaaatacggattctgtagcatggcatggacccggccagcagcttcatgagaatctcttagaccaactacacgaccacaagtgtctgcgaagagtctttgcaaactggttaaagcgagttgttccgtccgtaacctttcaccttcgcttcttgttgcctctgccgtttcatttctttttctttcgaacagaccgttatcaccccatagcatattcttgaatgtaactattgcttcaaatacttgatcctctgatctcaatttttgaatgctgacctttatatacttttcaatagtgctcccaagaagctgttgtaaaacggtaattatagcccttcctcttaaccaacccgcgttggccttatttaaagcaaagagcgaaataaataagtcacatatctgtttaacaaaagatttattttgcgaataaaaaggatagccagaatcggtgaaaaaatgtctttcatcttcatagaaattcaattcaccgccgtcttcagagctttgtaaatcaacaacagaactgctattacttgtgctattactactaccaataggttcatgaagtggctcctccagaatatcatcatgcatatattccttgttcagtttgaatggggtaggatctgtcaaaaatcttctgaaaatgttatcttcgcatatttcagaaatagataatagttctcgcaagtacttttcaagtttttgctttcgttcctcataaagcaatgtttttgtaacatgatatttcaatgacattttcacttttgacgggaacaaatcttgcaactgcctcatcagatccctaaaattctttttcaaatatgtatttaattcaaaaaattcattatatctccttgccatatcccaagaacttacctgcccattgttaaaatgatggatattgatgatataataagttatttcttttaggccattactagaattctcactgaagtacgacctaatgtatatcttagtttttctgaacaaactattaccattttcttgtaccatatattgctgtttcaacagttccttcatttctagttcctttaatagggttctttgtgacttttttaaaattttcaactgcatttgattgttggtcagatctgccttcaaaatcaaatgccttaaaagttcaagctctttctcaatctgatcaattgaaatagtcaaggatgctatattatccctaaagttgtttgacccataaaattggctaggatttaggcctgaattcccgctggaaacacttactttctccatattacgtgggtgatccaactgatcctcgacaacagaaatttctgaggtattatcgttttcatcgtcgaagagtttatctttgaaaatgttgtcattttctgaaccaaagagctgagaataacggggatttgagcttattcttgatttatgcggcttggatcccgatccattcactatattatctaaagcatctgtgatgccggggtttgcgaatattctgacaggattcataaaatcagtcttcacattatcttttattattttgttttgttctggattgttaacaccaccgattctactcagaaagtgagcatatatatcagtcgaaatgatgtgggacgttgaaagcattttgagaaatgaaggtgttttcttgaaaagaggtaaaaatctatcatcgagatactttatagcctctgtctgtagtagtaaaacgcttttccgagctaggataaatgtgtcttcatcgttgttgatttgaaatgaatttctgaaaagtattatatttttcactaaaccttcatccagcaatttcatattttgcaagttattgttatgaaaaaactttgaagaaatctcttgcagttgcattgtgctaattcctgaataaccagaaattatatcttcagatgtagcatcttccaagggatttttgaatgattcaattgtttgcgaatactctaaaaatgttgaaccctgtgtttcaggaacactgcctaaaaatgattcaaaaaaaggaagaaactcgctatcgtctacaatgtccttcaatgtgatggaggtaagaaatgaagccatttccttcaatactattccattatccatatttaaatcgggataattagcctctcttgcaagctttttgcttgccgtatcaatttccgagccagggaacgataactttgattcaatcaaatttaaggaaagcagtaatcgtttcttatacttcaaattttccttggtcaaatgttcattttctttcaattggtatattttgagggccaatgaatacgcaacatatttgatatcacttaaatccaacaaggagtccaactggttgagataatgctcgaattgttttccagtatattcagcattaagctccaatttttcacttgagggttctccaacatctttgttcgctacgtcattcatcacttttctatgatcttgtaactctttactcaacattcttcttatcttgtgaactttgtgcttttcctcgaaataattttgtgaaaggcttacaattcttaaattccaactatctggatcagtaaatttgaaaattaatggagaaataatgcacgtagtgagaacttccgtcattaatgtgaaaacaagcaatgaatctaactcatcattatcaaaaaggtgaggaaggagcccgattacagttttccttatggatttttcaatttctttctgaagagcattcggcttcaatgataatgatttatgtattttgtaatttttattaaactcaacggcaatttgtagatcgatgttggctgatttatgcctttcaagagtcaaatcgcttagcacagcttctctggcatcacaaaaagtgctgaaatgtttgttaaatataggcaacagcttcagaacaatcaagctggcactatcattcttcatcaacttgtccttcaccactaggagcgtttgtaataatctccactttattactttgaggaactctgcgtcactattcttatcgatttttgtgaaccaaggctgaacaaaatctttaataattaaattaacaatactctctaattctttcccaatttgcgcgttcccatcttgtattaaaccctcgacagacttcaattctttatcaacatccacagtattcgaactttccggtacgatatcaacaaatcttggctgaggtttcggtaaatcaggcaaggatttgaagaatacgaagtacgcaaagatgcagacattaagaaagaaccccagcgaaaaagtgattaccgaccattgtatcattgatattaagtaaaacaaaactaaaatcaatcgaaactgtggaaacttaggcatacgatatcatatcagaaggcacaaacacgcgcacttatggcgctttcaaagcatgagagtcttcggttaatttacttatcttattgtttacatatttttgaagttcgtaaggcgatgaaaaaaaaaagtacacaatggatagaactgggatggaaaaagctcatacagtcgcagtccgcagtatagcaacaaagggccacccttgcacttgcactgttcattattatattatgtagctttacataacctgcaaaataagttaaacgtccttaaatagtgaatcttgtaatgctttaatgtctctgctgatacccttgacgaactccaatctgcttgattcatcctccaactgctgttgctcttctaaagttgtaggtattattcttgaattcaagtattttggatgtgttagaaacttgcttaatgcagcgcttaacctttttttatcatgttcagaatctagaccaataaccaattctacagcttcttgttgatcatcagagtttttaggctgaataaacaattcttggtaatttagcaagtttagcattttttgcaataaaaccaattgattcgtttcctttatcaacgaacttgacactgctaacttgttgtcaccccagttatatattgtagattttatttgttttccaaaatatgaaacaaataggcacgtctcaggtaaaaccttgataccgaactgacttaatagtagtagaacaatggataacaaaccattgctccaaatgttgtgcaatctaggcgaaaattcaggttttatatcaccttgctgtattgcaacagatagtggactttccaatagaacgctatacaatccactgttgatgagttttgcagcaattggctcaatagaacacaattcggagataaaggtcagagtaatttgcccaagaattggttcatcgttaatccttatcaaatgcgcgcttgaatataggttcagtataactttcaaagttcctacttcgtttagggatgatgctagaataacattgaagtttttagagggattcacattggtgatcttcttgaagagtgataataataacaataaatcctgagtattatcctccaagttgacaatttgggtggtgtgatcggtgcttaaacccctcgtggagcatttattgatctgacataatatctcagacagtatcaaataaacacccttactaaacactaattcaaaaaattccagtagttgatcagatattaattcgataaaacgatctcctgacgagactaactcgagaagaactaagacagatctcaaaagaggtctataaaagttattttttagtgacttaccaatatttttaataaagtcaatctcaccagatttgaaaattgtaaaaatcttgttcatcaattcaattatcttttcttccttcaacaattttcccgacaacttgaacgaatataaaatgtaaaacgacaactcaattctttccagatatatttgggtaaacatttgtttatctgaaccaaaatcaatatttaacttgaggaaatgctctaccaagtcgacaaaaccatcatttaacggaacagtgctcctcttcacaaacgtggtgattagtgcgccccatgcttttgcggtagatatttcgtaattgacatactgcaaatttaatgaagcgtctgttatttcctccttaaaatttgtctgactcttacttggttcgttccaactacggtcagcttttaaaactatatctaataacggaatatcataaccgaaattctcattttcgtttattctggataatggaattttttggaacgactgaagctctaaactgggccatttctctttaaattttaagtttaattcatcatgaaaagttttattgaacccatcaatttggaagaaatgatgaactaattcaaacaagtcttcctgattcaaaaaatttaaaatttccgagtttgaatcagtggagttgtaaatacacaacgcaaatatttctacaatccttgagatcaatttgtatttcttaatcaaagaaacagtttcgtcacgagtcaaattttcctttttctgaaataatttttttgagtccttcaacttagccaataaggaattcacaaatttaggatcttttatgaatattttagaatttgtccaagtgtttaaaacatatgttatcgtttctaataacttgcaacttacttcttcaggcgttgaatctaatagtaaagaattcttttgcaaaacagttaatatagaactctttttgtctatggaggattcgtcattaatttttttattggaggcaaattgacctgttaagaagaggatagataacccatcttgtttactttctaatagggtagtaaaaaaaatgtacaaacttcggagaaggttccaatcttgcactggagagctcaggtccgacaggacttctttcaaaaatgccattgactttgcttcaccaaggaaagataacagaaatggatagtcgtcattccaaggagcctctactaaatagcttaacaactctatgatctgcactttgaaatgaacataacttggtagggtataaacgtcaaccaattttgatgaatttatgaaaagcaatttttccaggttgcttggctttaaatcacgattgctacctcgaatagcgatcaaaagcgtgcacagcttgaaggagttattcattaccttgctatataaattacccaaaattttgtcgcctaaaatttttgttgtggtattcaatggtgaaatcagaatattcgtcaaagtatttggagccaaatcaatggaatccatgggagtcaaaaataactgcaacaatttgtttgctgacgaggaaatgattaactgatccttttgatgtggatttatggtgaaaacgtcatgaagtacatcataaaaaattaatgtcaaatggaaggcaatttcgaatttttgtaagaagttgttgtacttccagttgtaataactctcaaagatatgaattgcatgtagaatcaacttattaataatatcaattttacttctcttggaaatatggatatttttcaatgagagagattctcgaataaagacttttgttagcttaagcaattggatagtgaatgtgtaatcccccgtagataattcaaccgaaccgagtatcatattggaaagaccagtcttaccatatttgtctaacaaatccgatttgttcaagtaagaagaaacaagatgaaggtaattcggtgtcagcatagtcataaattcacaacattgtacaattgaggtataatcttttctttgtagtgatatttcaaaaatctcgaaaattacttggataatcgacgctccatttatggtgctggctgaagtatccagagaatttgataaatatgacagaatttcactagatttctcgatcgaggttttcggatcgacaacgttagtgactaactttattatggatatcatcaattcatgttgtaagtcatccagttgtgtacccttttccatatatgaatgtaatagattttgcaatattctacccaccaaagaccaaccattgaatttgtaaaggaaaataatcaaattggaagtagttggcggctgttgtccattctgttgttgttgttgttgttgttgttgtttgatagtaagaatttttccctttgttgattttggtattgacaagagacaattagagttttcgttttctaagggtggcgccactagtaaatcagacttcaactctatcaaatcaggcactataatatcggaggatgaagaagagtttgttattgtatcagcaattaagtcataatccaaatcgttcaaactacttttggtaacagcaaatgaacatatatcttttaattcaaaattggcaaactcggtatcaattaaggctaaattaattagcgggatcagtgattcgttcaataggggcaatttagcctttatgatgctcaattttttctcaaaagtgtcattagttaagaaattctcaatgaactgctctggtgcctttgaaattatcttggcgaaaacccgggaagtagatgcagttataggaataaaatttaaagaaaactccaaaaatactgttattactgtggtgtaaacaggatcaaaggatagaatttctgagagagtattcaatttttgaagaacatcatgtgattcagcaaacagagcaaatttcgttatgtctgaatcatcaaatgattccgacgattgtaatgctcgcctataataaagtataaatgaccaggagtaatgaatcattggatggaaaatggggtcctcgttgacgatattggttgctacatcattctctagagcgctattgacggtgtcgaaagtttctgtatccatgtacaaaggtgactgaatatcaaattgcgcgattgaagtgttcagtccaagtatcaatatagttgtgatagtaaataaagatgaaatcctggaaataagcgtttctgagaggtaactgaggtcttggaaattctgaaacttgtacaattgtagtgacgaggtatctatactcttgtctgttgaatttatatttctgcaaaattcaacaaattgattttgatactgtagaaaccattgattgacgatatctactggtacttttgtgttgaggatcattaaattcaaaatttgtaatatctgcaagataaacttcaaatcagaaaatttttttaactgcaccaatgagacaattgtgaacatgtcttgatcgttattataatcatgtgctaaagatgaagctgtaataatgtcgtagttctggattacagatgatattatagaaatcaatttccccactacattgaatctatcgttgtcaataaatgaatatgtctcgaggtcgatgtcagggttaacgagaagtgagtatactatatgaagtctagatgatctctcagacataaagaattctacagcatgagaaaggtcctcagattgagcaaagaatggatcattatcgacgtttatttgcaataagtttgcaattgtagagcgtaacttgttatgatcgccggaagaagttacattctgccttattgtgttcagactctcgataagatttgtcttgttagctttcaaaaactgtcttatttgggccaattgcttggcatccacagcggatacatcagcagcagcatcgttcataaaattagcaacatgagtgaaggtcaattgtggagaggaattgccaaatgaaggtgtagccatggctgatggggtcctttttttagcggtggaaagggttatctctttatttgtgtttctgttcgaatattaaagatgtctcaaagtattcatttcaagaagaaaatttttggtattacaaaatattcttacccggaatatatacatatataccttaactacaagcaggagccggctttctggcaaggagggagaagacatagattgtttgcgtatatatgtgggaatagcgtccaagcacgcccgtggctgagggagcaccacgatcgttcggtgtacttgacacctctatatggtatgttcttccctgatattgatatcagcacaattacggctctaagaaacgatgaatataaaaaacgttaattaggaatttgacatatgtgctagtattcgggcccctgagcaagtttgtgcgcacgacgcctgtccgttgctgcacatgcttgcgtggggcctttttgtcgtgtttttatttagggactgttatcgaaggaatagatttctgtggtgaaaagtagaaaactactagcttttatagacggtgggggagaaaaaggaaaattagaattgaaaaaaatttgaaaaaatatgaaaatgtgaaaaggacgccttatttccttgggttgcccggcgaacacgttagttaactcgctgtctaactgatgggctattattatagcgttatagtacgtatcagaatttaaaagaaggaggcagaaaagcttagagcaaaggggcaggacaatggaagcttcacatttgcaaatctactggcatgattcacaacccgtttactcgctcacattccaaaagaacagtgcgaacgacaagcttttcaccgctggtggtgataacaaggttaggatatggaagttgaacagagatgaaaacggacaaaatgggggggtgcgtaagattgaaagccttgactttcttggctcgctgacgcatcacgaacaggccataaatgtaatccgattcaactcgaagggtgacgtactggcgtctgcgggcgatgacggccaagtgctgctatggaagcaagaagatccaaatacacagcaagaatctgtggtcagaccattcggaatggatgcggagactagtgaagcagacgagaacaaggagaaatgggttgtgtggaaacggctgcgtggtggtagcggtgctactgcggcggcagagatttacgatctagcgtggtcacctgataacaggaacatagtggtggcatgtatggacaattcgatacgactgttcgatgttggagctgggatgctggtatgcggccagtcggatcatggtcactacgtccaaggtgttgcatgggacccattaaatcagtttattctctcacagtctgcggaccggtctctgcatgtatatggagtcattctttcatctgcaggagtggttacagggctgaaacttagaagtaagattgccaaggcagaactgccttgtccaggtgatgtcctgaggacaaattacctttttcacaacgagacgctaccttcattctttaggcgatgcagcatatcgccttgtggtggtttggtcgtaattcccagtggtgtgtataaggtggctggtgatgaagtcgcgaactgcgtatacgtgtatactagatctggaatactgaacagcgctggtggcgttaaaaaccggcctgcgattagaatcccatctttgaagaaaccagcgctgatggcggctttctcgcccgtattttacgaaacgtgccagaagagtgtgcttaagctgccctataagctagtatttgccatagcaacgactaacgaagtactcgtgtacgacacggatgtattggagccgttatgcgttgtgggaaatatacattactcacccataactgatttagcatggtctgaggatggctcgaccctactaatctcatcaacagacggattctgttcgtatgtatcgatcgacacagaaacgcaattcggttcaaggatagagccgccagcgatgcatgcagagccactagacactgacgagagcgcggtagcggctaagaaccagcgcgaggcaggtgggatcgtgaacatgctgccggtgaagaagatcccctgcaatagtagcgatagtaaaaagaggcgcatacatcctacgccagtcgatttgtgatttttaatatatttaatgcggtacataagaatgcctaatctagtttgccagcgaagatattttccattgtgtgctcaatggaccctgtgttcctgagatcttgcacgactttttcctgaggcacatgtggcgccatcgtcatcacgatttcaaccatgtcactattaacggctctctttcgatcactaccatgtctgtttaaccgagcaacgcgttcctccggagccgatggtactggctccggagaagggtcgttggtggcgaccgagggcgccggtttggcatcctgtacggttcgcgagggtacttgcttggcgcccctgtgtttcacggtgtaaacaaacaagcacaccatcgtcagtataaacactatagtcgatccatccatttttacttttgtgcgcgtgggtagccgtgcctcgtctgtgtgtgtgggaatgtataaatgtgtcccgagttattattctaaagcgggcaccattgtagtaacttattgcgaaatttctgctcttctcgtctcgctcaaaaatcgcgttcagggtaaaaggggcgaaacagagggccagatagaaatttcgagaaaagcgggtcaccccgcccctgcattttgatatggcgtatttgggattgcttgctcgaaagtgtctaagtccggctggcgggcctggcgccctcgccgaagggagataggaaggggcgggggtccgggcagcggctatggtgtcagttacctagggaaggagaagggggtagaaccaaggggctagcacactcaccctggggcccccgtctagccaagcttaaatataaatactaatgtaactataaatataaggatctaccgtgtcattgcacatccacccacccgtcgattaaaaaaccaaacaaagcaaagaatacaatagcaacgcaagatcaacacaatggctctcatcgtggcatctttgtttttgccctaccaaccacaattcgagcttgacacctctctccctgagaactcgcaggtggactcatctctcgtgaacatccaggctatggccaatgaccaacagcaacaacgtgcgctttctaacaacatctcacaggaatcattggtcgcgccagcaccagaacaaggtgtccccccagcaatctcaaggagtgccaccaggtcacccagtgctttcaaccgcgcctcgtctacgacaaatactgccactttagatgatcttgtctcttcggacatattcatggaaaacttgactgcgaatgcaactacctcacatacgccaacaagcaagactatgcttaaaccccggaaaaatggttccgtggaacgattcttctccccttcttccaatattcccacggatcgcatcgcatcgccaatccagcatgagcatgactccggttcgagaattgcttcgccaatccaacagcaacagcaggaccccacgaccaacttattaaagaacgtcaacaagtcattgttagtgcactcactgttgaacaacacctcacaaactagcctagaaggacccaacaaccacattgttaccccgaaatcgagggcgggcaacaggcctacttcggcggctacttctttagttaataggaccaaacaaggttcggcctcctctggatcttctgggtcttctgcgccaccttccattaaaaggattacgccccacttgactgcgtctgctgcaaaacagcgtcccttattggctaaacagccttctaatctgaaatattcggagttagcagatatttcgtcgagtgagacgtcttcgcagcataatgagtcggacccggatgatctaactactgcccctgacgaggaatatgtttctgatttggaaatggatgacgcgaagcaggactacaaggttccaaagttcggcggctattccaataaatctaaacttaagaaatatgcgctgttaaggtcatctcaggagctgtttagccgtcttccatggtcgatcgttccctctatcaaaggtaatggcgccatgaagaacgccataaacactgcagtcttggagaatatcattccgcaccgtcatgttaagtgggtcggtaccgtcggaatcccaacggatgagattccggaaaatatccttgcgaacatctctgactctttaaaagacaagtacgactcctatcctgtccttacggacgacgacaccttcaaagccgcatacaaaaactactgtaaacaaatcttgtggcctacgctgcattaccagattccagacaatccgaactcgaaggcttttgaagatcactcttggaagttctatagaaacttaaaccaaaggtttgcggacgcgatcgttaaaatctataagaaaggtgacaccatctggattcatgattaccatttaatgctggttccgcagatggtgagagacgtcttgccttttgccaaaataggatttaccttacatgtctcgttccccagtagtgaagtgtttaggtgtctggctcagcgtgagaagatcttagaaggcttgaccggtgcagactttgtcggcttccagacgagggagtatgcaagacatttcttacagacgtctaaccgtctgctaatggcggacgtggtacatgatgaagagctaaagtataacggcagagtcgtttctgtgaggttcaccccagttggtatcgacgcctttgatttgcaatcgcaattgaaggatggaagtgtcatgcaatggcgtcaattgattcgtgaaagatggcaagggaaaaaactaattgtgtgtcgtgatcaattcgatagaattagaggtattcacaagaaattgttggcttatgaaaaattcttggtcgaaaatccggaatacgtggaaaaatcgactttaattcaaatctgtattggaagcagtaaggatgtagaactggagcgccagatcatgattgtcgtggatagaatcaactcgctatccaccaatattagtatttctcaacctgtggtgtttttgcatcaagatctagatttttctcagtatttagctttgagttcagaggcagatttgttcgtagtcagctctctaagggaaggtatgaacttgacatgtcacgaatttatcgtttgttctgaggacaaaaatgctcccctactgttgtcagaatttactggtagtgcatctttattgaatgatggcgctataataattaacccatgggataccaagaacttctcacaagccattctcaaggggttggagatgccattcgataagagaaggccacagtggaagaaattgatgaaagacattatcaacaacgactctacaaactggatcaagacttctttacaagatattcatatttcgtggcaattcaatcaagaaggttccaagatcttcaaattgaatacaaaaacactgatggaagattaccagtcatctaaaaagcgtatgtttgttttcaacattgctgaaccaccttcatcgagaatgatttccatactgaatgacatgacttctaagggcaatatcgtttacatcatgaactcatttccaaagcccattctggaaaatctttacagtcgtgtgcaaaacattgggttgattgccgagaatggtgcatacgttagtctgaacggtgtatggtacaacattgttgatcaagtcgattggcgtaacgatgtagccaaaattctcgaggacaaagtggagagattacctggctcgtactacaagataaatgagtccatgatcaagttccacactgaaaatgcggaagatcaagatcgtgtagctagtgttatcggtgatgccatcacacatatcaatactgtttttgaccacagaggtattcatgcctacgtttacaaaaacgttgtttccgtacaacaagtgggactttccttatcggcagctcaatttcttttcagattctataattctgcttcggatccactggatacgagttccggccaaatcacaaatattcagacaccatctcaacaaaatccttcagatcaagaacaacaacctccagcctctcccactgtgtcgatgaaccatattgatttcgcatgtgtctctggttcatcgtctcctgtgcttgaaccattgttcaaattggtcaatgatgaagcaagtgaagggcaagtaaaagccggacacgccattgtttatggtgatgctacttctacttatgccaaagaacatgtaaatgggttaaacgaacttttcacgatcatttcaagaatcattgaagattaaattttaccattttaaaattttaattttcttgggtatgaacttttattttcaactgcttattatatatcaattctataaatttttttcttctctctaacgaccaattataaaattcatcctcttatttattacagcatcttatacattatgtatatgggtagctattattcatttttgcttcgtaaggtctttttttgtcaactttttcatcctaagcggctaaaagtgattggagaggaatgtccaggcgaccaatgataaaaacgctttctcttggaacaagaaataggagcaattgacagttgtcgatgaacagcgaaaatagtaagataaccttcaagcccaatattctaattaaaggcgtttatatatttgtactttatggtatgtgcatatgtattgtaaagaattatttcaagacacagctcttccagctactggctccggctattcatgaaaaatccaaaaataacatatttatgatagcatcagattcatttcccaatctttataaacagaataccaattatcgcccggctcatcctctttccgtcgcctccaaacttccaacattacttgcctggctccccaataggagcccactccactttcagctaatttggctgcccatcttctaaactcttgctgtctgttttcatctgtgcaagcacatcctgccatgaaaccttgccaaattaaagggacaattttcacttttttttgatccaccaattcttccattgcatttaagtgatctaatactttggcaacatagttttgtagaaattggcaatttaaacttcttgccattgtaaaataataaataattaaactgaaataaaagctcattgtatggtgatatagtgcttcagccgttgagtttatgaagctttttccctccgaattttcttgatggaagttccattctgatttccatttcaataatcttttttcgaaatttaacgagagttcattaaattttcggggtacaggtaggtaagttaaattataatattcattatgtctcactatcctaacacagtctgaaaatagtaatattaatgaattaggcaatccatagagtgaatctgtaccaattatgttttcatcagtcttcgatactagcttagatatatcagatttattatagtaactttctgttgctatgttggtaaaaattggaggagtggtcgaagatggagtagagtcagcggatacgtttgtgataggctccttaacgaattcaatatgtattttgccgtcattttcattgagtgcctctctaaataaaccttcctgcacaacgtcaactcttggctcactgctactggtagtagcgttagatgtatctaatggtttgtaattatcatcttcttcacttggtaaaataacaatttcctttgccctgactttatccaacgcagtgctatcttgaattaacttcagaaacgagaaaatcctgtgtaaggtttttgtcttttcagaaatattaggtcttagtttcattcttgactcaacgaagtcttcacaaagagccaagtgatcctggcaatctgccatcgtcccccatacaacatcaatagagttcatagataagatcgcagttagtacgtctttatatttctcaggtatgcttgattttgtgttcaaacataatcttagaaagttcgaggcttgatttctcaattcgatacctaggcccagaaagtatttttgtagtttgtagttccttgggtacttgctttgcaagtggaagcaagagacagcaagaagagcattcaacaacgcattcctcgagttggaggattgtcccaaacccgctaaatcgcctaatgccatcaaggctctggggaagtataatgttttccatgggttcttttcgagcacgaccactgtcattttatctgcaacattattaaaataatgatttaaaagaaatctcgctaaaccatgtacggtaaggtctgttttgggtataatatctaccaattcaggtggtaggtcactggaataggatgtgagttctaacatggacttaggcatgcgtgattcttcatttggaggagctagagttattttattcagatcagatgcgggcagagatcttggttcaatattgacgaacacatcgtcgatcaatgcttgagggtctggttcctcactgttcgaagagtttttctggaagagtaacttcaagttttgctggtaaagtttatcattggcactggctgctttattaggtaaagttgatgaaccttgattatcagcctcaaaggcacatccatgttctttggcattcacatgctcttccccactcacgacattagagttttcctctaatgagatttcttgtggctgtgtgtgtcctaagtgatgtccctgtaaggtcaccgctgacaataatgcatcatctctgagttcactcgagatccattcgtaacctgttatattcagattgttccagtcataatctaaaagatttggtgttggtggaacaccatcattagcagagagaatacctgtctttacatgccctttatttctcaacttgtcttcaatatgtctaattggaaaggaaatagttgaagaagatggtaaagaagataacgaaatagaagctgagctctccaagcttttggcaactcttttcctattgcgcttcttccttggagcgtactgcttgtcgatcttatctgttcctttaaacaccccaaatttctttatgatccacgtcttgttatcgcttattttctcaattgggggagtatgcagcattgttagctcatcatccatatcttcatgatacacgtattcttcatcatagcgcacaaaatcgatgttccgtcgttggtattgtggttcatcgacactacctgataagttcgtagtagttgcaggagaattttgtgggattgggacaccgtacgggtcaaattgcataggcttagaccaccggagtttgatatcataaccgccacaaggcaaattagacttttcacatcgttggcagtggggatgccgaagatcacacttaacttttcttcctctgcacgtccaacacccagtaaacgtctttgcccttcccatttttttagggccattcttgctggaaattcccattatatctgcaacttaaaattttcgaggtactgatatcggtaactattgcccactaaagcatcaaatctaaaagagatgcttttcgcaaggtgtatttttttttcatttatttttgagttctagcggaaaccgcaggcgaagagtcattgataacaaagaaggttcatcaacaactgcaacatgaaatccaaaaggtaacggcaggcgagggtgagctggataagatatgtctaggaagctgaaaaaaacgaatctgtttaacaaggatgtaagttccttgctttacgcttacggcgatgtgccgcagccactacaagctactgtgcagtgtttggatgaattggtatctggatatttggtggatgtttgtactaacgcattccatacagcccagaattctcagcgcaataagctccgattggaagatttcaagtttgccctccgtaaagacccgataaagcttgggagagcagaagaactgatagctactaataagttgattacggaagctaagaagcagttcaatgagacagacaatcaaaattcattaaagaggtacagagaagaggatgaagagggtgacgagatggaagaggatgaggatgagcagcaggtgacggatgatgatgaggaagcagcgggccgtaatagcgctaaacaatcaacagattcgaaggcaacaaagattaggaagcaggggcctaaaaacctcaagaaaacaaaaaaatgatatagctacttggcaggcccgtttacgtaggcttgattcagatatacgtagtacatatgtccctttgatttattaattaggcgtttgctctataaaaggggttttgagtttgcgttggtgctgaacaaaaacacttgtcattacaatggcacaattttgaatgcattgttttcttatttatatatttttccaagtaaaatcttaggattcaactggtacatttattcttttagattcaaaaaccctgctacattagtaacggcaaactcctccctctgatagttgtgttgcaatactcagctgtcagcattggatagttaagatgtattgttaagtcaccgcctgaaacagcaacttaagctcccttctgtgcttaggaaggtacgtgcgcctcctaacccatctattatttgattctaagtcacaacgagcctgtactaacgagttttagaagcgatcgttatcagtaaaaaatgtctcctgcggtaagttatttttactattatatttttacaaatacatattgctaggctactctatacatgaaatatgtgcatgagatcattattctgacagagaaagtagagcatcaacacagggcccaatacgcgattttttagcaatacaaacatcctctatcaggcttgggtccatatctggaaacatattctgtaatgtgttcaacgtgtcctttcgttcgttctcttcaattttcttaattaacgaagaaacgtcttcttctttattgctctgttcagatttcaatgcctcttcttgtgtgggctctccaattggagaaaacagttcattgaatttagaaattacaatattggtaacttcgtctaagggtttcagtaaagtgccgtttggctgtaactcatccggaatctctagttgttttttcttctcttcttcctctttttcttctgctagttgtttaaaatttctttggtatgcctcttcaaaatcttcgtgatcttcgatagttaaagaacgttcagtcaagttcataatgaagttaagagcagcctgaagactgctcaagtaatattcctcttcgccccgaatgaagtctggtgatctgaatctttcgatgtagttcacattcgaaactagatatcgtacttgtcctttcaaaatacagtatattagcacaggtataaagctgtcagcgccattttgttccaacttggtatgttttagtaaaccaaatataaccttgcttgcattcaaaacgcaaaccatcttgtcccttggtgacttaaacctatttattttgcccaactctttactggccaaatggacaaacttattcagcctggcattcggcatagtatcaggaatatctaacataatggggcttatgaatctataatgcctaatcttttctagtaatgtgtcatcgttggttaaatctttcatatgctcatcgtctaatggtttctgcagaatttcataaagacttggtgaaaaacagcgagaatatagtttccccattattaacttttccataccttccttggcatttctcatcttggaattgtcaagacttcggaaaggctcgtaaagagtgaatttatcgtaaatgaaggtcttaaagtcactgatgagttttatttcttcgctgaccgtccatagaagtctttgcgccaagaagttacgtaagaatgatttcgtatatttaaccagaggatctgcaccaggagtctgaagctgcttaatgaatatttgaaagtcataaaatggctcctcatctcctttgtcctgcgcggatatgtccctattagtttcttctgccgctgccctattaggatcatcctttttaaacttcacatctttatctgggttgccatttgcctgttccaattggctgaaaggatcaaattctttcaatatctccctcttttcatcatcagtcatggctgttgattcctgttctttgttgtttgatgaagagaaactcaagcccgttggatgtagaacttttcaatgttatgtgtcattacatcaagtaccggcagcttgatatagcccattcgcgaaaaaaataataaaaaagaaagaaaagtgaaaaatattaaggcatcggaaagttccagatttagtaaagccttgagcatctggcattactatgagacatgtgcgggattctattgcattattgtccaaacaataactacctgaatgatgagttaatcgaatttccagaaggaactgaatttggagatacaacatgtaccaatgaatcgtcgattttcaacaaaatcattccgtacatagccgcaagaggtccaaactactcctctcttcgagctgtcaaagcttatcgaataagttggttttcttctgttttatctttgaggcagcctttcacgaaacagagtattaacgtggatgacagatatttcctacaattcaatggtgagttatacaataaagagatatcgcagggtgataatgatagtctttatattgcttctatgttgcagaatttgaaagagggtatgggcgttattgatgttataaaatcactggaaggcgagtatgcttatactatatatgacgtgaactcatccaaactctatttcggcagagatccaattggcaggcgaagtttgtcttattcggtcactccagacaacgaattgtacgtcgctagtgtaacggggtctgctgggtcctttcaagattgtataggtggagttatttatgaatatgatacacgaactaagttgttaaattccaatcagaggtcacatcttccatacgaagtgacatcagagatagatctgaatttcacatcattgtcagaggtgtctaaaaatttatatgctgtgctacgtgattctgtaaaaaaaagggtagagtccatacatcccaggcatattgaaaactctcctattgcggtactattctcaggaggaattgattgttcagtaatagtagcgttgatctgcgaggtgttgcaagaaaatgattataaatgtggaaaaccagttatagagcttctaaatgtatccttcgaaaaccccaggactggtctttttcccagtgatacacctgatagaaaactgtccattaacagtgcaaagactttacaaaacttatatcctaatgttgatatcaaactggttgaagttgacgttccttatgatgagtatttaaaatggaagccatttgttatcaatttaatgtatcctaaacagactgaaatggacttgtctatagccattgcttttttttttgcgtcgagaggtagaggtttcttaacttctctgaatggggaaagaacgccatatcagcgccatgggatagtgttattcagcggactgggagcagacgaactctacggtggatatcacaagtttgccaacaaaccaccccatgaacttgtggaggaacttacaaggcaaataaacaacatttatgatcgcaacctgaatcgtgatgataaagtgatagctcataatggcgtggaggtgagatacccatttttagatgaatatgttataaagttatctacagcagaaattcccattaatttcaaggttaacaaattaatccttcgaaaagttgcctcgcagtatttgaagttggatggaatatcatcagaaccaaaaagggccattcaattcggtgctaaaagcgctaaaatgacaaaggatggtaataagcatggaacagatttattaaaagaaaataggaattgttcataaattcaaatattcaatatattttgcagcttgttcaaaattaaatgctaaaagtagagtaaatccgttgaacatacatagttttgtaatgtcattaagggtatcttcagagttgttatcgtctactatgaatatcagtatattattttcgtttctagataagggctgcattctcctagagatataatcgacatataatttgtgataagtcaaagttaagaacagtacacttcttccacgaactagatagtcgtagtatatcatattaattcctgttgaagatacatatctccaattggtgctctttaagtggttcaggagtggattttctttttgggtagtgttcactagtacagtttttcccggtcgagtactcctgaagggtctctttcgattatagtcatctgtagcctttgagtcggtccattcttccggtttttgctgattgaaggcgtttatgacctggtttgaatttatgcgtcttgatgtttgcggttcctgctgctggagttttgatgcatctatttctaacgattgagatccagtagtatctgcaccactcttttcctttctcaatttggccacaccagccaatatactttcaaatgaagtaggatcagtattgttcatcttctaggataaccaactttgtttatgcccttttttgtgttgcgtggctgtctcataagttacaattttcttttttgttctaacgattttaaatagaaaagtgtcttagatgaaaatcttgctgtgacccaaacaagaaagagcactgtaaaaatcaagccatgtcctctcaaaaaagtatgtaaatgaatagctccttcgttgttgccaccgtacagacactttactaacttttaagttactacatgttcgaaacttagtcgatttaactaaactaaatcccgagcagctgaatgctgtaaaacagcaattcgaccaagaattgcagcatttcacacagtccttgcaagcattaaccatggctaagggcaagttcacagaatgtattgatgatattaaaacagtctcccaagcaggaaatgaagggcaaaaactactggttccagcatctgcatcattatacatcccaggtaagattgtagacaataagaaattcatggtcgacattggtacaggatattacgttgaaaagagcgctgaagcagcaatcgcattttaccaaaagaaagtagacaagcttaacaaagaatctgtacagatccaagatattattaaggaaaagacccagtattccttgtccatcgaggcccaaataagacaagccgctattagacagcatgaagcgatgagtaaacaacaacagcagcaacaaaaaaaggagtcgtctacagcctaggtaactcttttgcttttcctacgatttttcatatctcatttgtagccatctgatatacgtttatctatatgcaacgtaattttttatttatcgtcactttgtagttttccggaaaaggccattgaaaatttttcaaattcctatggcgatgagctgaaaaaattcattaagtgtgcattcaataacatcttgttatatactaataaaagaggcttcaagacaaaataagctaacttaaatatggcaaaaaagaaatctaagagcagatccaagagttctagaagagttttggatgctttgcaacttgctgagagagaaattaatggtgaattcgataactccagcgacaatgacaaaagacatgatgctcgtcgtaatggtacagttgtcaacttgttaaaaaggtcaaaaggtgacactaacagtgatgaagatgatatcgattctgagtcgtttgaagatgaggagttgaactctgatgaagcgttgggctctgatgatgactatgacattttgaattccaaattctcacaaactattcgtgacaagaaggagaatgcaaactaccaagaagaagaggatgaaggtgggtatacttccattgatgaagaagatttgatgccactgtctcaagtgtgggacatggatgagaaaaccgcacagagtaacggcaatgatgacgaagacgcttctccacaattaaaattgcaagatacagatataagttccgaatcaagcagttccgaagaaagcgaatcggaatctgaagatgatgaagaggaagaggatcccttcgacgaaatatctgaagatgaagaagacatcgaattgaatacaattacctcaaaactgattgatgaaaccaaaagtaaagctccaaagagactagatacgtatggctcaggtgaggccaatgagtatgttttgccctctgcaaatgcagctagtggagcttctgggaaattgagtttgacggatatgatgaacgttattgatgacaggcaagttattgaaaacgctaacttgcttaagggtaagtcgtcgacgtatgaagttccgctaccacaacgtatccaacaaagacacgatcgtaaggcagcatacgagatctctaggcaagaagtgagtaagtggaatgatatcgtccaacagaacagaagggctgatcatttaatcttcccgctgaacaaacccaccgaacataaccacgcctcggctttcactagaactcaagatgttcctcaaacagaattacaggagaaggtagatcaagttcttcaagagagtaatttagcgaacccagaaaaagactcaaagtttgaagagttgagcactgctaaaatgacacccgaggagatgagaaagaggactaccgaaatgagattgatgagagaattgatgtttagagaagaaagaaaagctaggaggttgaagaaaataaaatctaagacatatcgtaagatcaagaaaaaggaattgatgaaaaatagagagctagctgctgtttccagcgacgaagacaacgaagatcatgatatcgctagggctaaagaaagaatgactctaaaacacaagacaaattccaagtgggctaaagatatgatcaaacatggtatgacaaatgacgctgaaaccagagaagaaatggaagagatgctaagacaaggtgaacgtttaaaggcaaaaatgttggatagaaattctgatgatgaagaggatggtcgtgtgcaaacattaagtgatgttgaaaatgaggagaaagagaatatagactcagaagcattgaagagtaaattgggtaaaactggcgtaatgaatatggcctttatgaagaatggtgaagctagagaaagagaggcgaacaaagaaaccttacgtcaattaagggccgttgaaaatggtgatgatattaagctcttcgaaagtgacgaggaagagacgaatggagagaatattcaaataaataagggcagaagaatatataccccaggttccttggaatccaacaaagacatgaatgaactaaatgaccacactagaaaagagaataaagttgacgaatcaagaagtttggaaaaccgactaagggccaagaatagtgggcaatcgaaaaatgcaagaactaacgcagaaggcgcaataattgtggaggaggaaagtgatggtgaacctcttcaagacggtcagaataatcaacaggatgaagaagcaaaagatgttaatccttggttagctaatgaaagtgatgaagaacacactgtcaagaaacaatcttccaaagttaacgttattgacaaagacagttctaaaaatgttaaggccatgaacaaaatggagaaagctgagctaaagcaaaagaaaaagaagaaaggtaagtcaaacgatgatgaagatctcttgttgacggcggatgattctacacggctaaagatagtcgatccatatggtggttctgatgacgaacaaggggataatgtattcatgttcaagcagcaagacgtcattgcggaagcctttgctggcgacgacgtggtagcagaatttcaggaggaaaagaaacgtgtcattgatgatgaagatgataaagaagttgataccactttacctggttggggtgaatgggccggtgcaggttctaaaccaaaaaataagaagcgtaaattcatcaaaaaggttaagggtgttgttaataaagacaaaagaagagataagaatctacaaaatgtgatcataaatgaaaaagttaataagaaaaacttgaaataccaatcttcagcggtaccattcccattcgaaaatagagaacaatatgaaagatctttacgtatgccgataggtcaagaatggacatccagagcatctcatcaagagcttatcaaaccgagaatcatgactaagccaggccaagttattgatcctttgaaggcaccatttaagtaactgatatttattggtggtaaaaaaatgcatatgtggcacattccactttttatatctatttattatgcattgtgtagaatagtaatactggaataattagaaaaaaatcatttaaaggttatgtaagttatatacacaattggctttcttttggataagttgagtgagatgggtgattggcggggataattataacatcataatgcttctaatctatcatttatttcttgagaagttaattttctaaatctagggcctttatcggttggaataccagtgtagcctagcaagtcagggttctcatcgccaataatagccagttcaatggtgtcaccattgaattcgccctctaccgactccttcagcgttagtaaggcaatatgaatggcgtcttctagttccagttcatcattccatcttttctctaaaaacgtttttgccgccacagaaccttttcctatagcggtggctttccaagggaagtaggaaccggaaggatccacttgatataaactaaacccattaaattcgtcgtggccagcaatcaacagtgaaacaccaaagggtctgacaccaccggactgtgtagcctcttgcattattttggctacttcagaaaccagtaatttggtgggagggtattcaccataaattcgtttataactagtatgtgctacctttcttgatttatccactaaaactctataatcaggccccataccggaatatactgcaccaatgtccggtgttagtaaggataccttcgaaagtgtttctgacatggccagtggcgaggacgacttcttttctgtggcaattactacaccattcgtagcttttatacccaatgaggtgacaccttgttttactgccgtcaaggcgtaatcaatttgacccaatttaccgctgggagaaaaagtggtcaacgaaaaagaatatctgtcggtcataattatagaactgtgttgattggtgtcttatggttgcttactactaattgaaactaaaaatataaaatgcttcacctattccactctcagcttattggggccggggacaattttgccaccttaataagctattatcgcttttcacgtcgaaaggaaaaaataaaagcgtaagcaatggtgtagatacttcttatatagacgttattattactattattattattattattattattattattattattattattattattattattattattattattattattattattattattattattattattattattattatatgacattaattacttgtaattatgttataacagtgaaataaataaaatatcaaattgtaaaggtcatgcttgaagaggcttgctcttccttaaaagggacctgaattccctgaccttttcaatattggcatcatttccactagtgatgaagctttcttctagatagctcagtatcttattgagacctttctgttggagtgaatagatcaacccattctgaaggactaacgaggaagcgtgttcgtttatataaatagtttcgatcaagttattgaacaacattgaaggagtgaaaggatttaaaaaagactcgactgaaaccaaggtcttcagttcatccatgtccaattcaggtgacttcaaataagctttgaatctgcagtagttctttactttttctctcaatttttccttcattgatttgtcattttcaatgctgggagacaatagtctgatggaatcatacaaattgtttagcatttgattcaggatttcttttttaacttttgctgccattccaccgacgttgaagttcatgaggtgatctgaatgggcaattaagttgtacgtcgatagtaaatttatgaagcttgtttggctggataaaatattggcgaattgtaatgtattttccggactttcataatacgtgatgttcctattgaaactatccaaaaataaggcaaatgtataaaggtccatagtcttatggggggttctcagctcccttggagtcttttcaaacagcgtgaatgccccttttaaatcattcttattaattaaatattctagctgaatatcaatttttgatgattcgcttattttgtcattaaactttttagagagactttcatacttcttgaattcaccagacctgatacaagattttaataaaagttccaaatttaacaccggaacaatattattatatctcaaaatatctgcgtacttaccgccgtcaaacagtctttcataaatcagctcaatagcatttttgttttcggcttgaatagcaatacttttgaacttttctgggaaatcacagattcttatgaaattcgataaagattcgcagttttcgattaattttaacatagaatcatttcttaaatttggcacaaaaactttgctaaattttggattattgattatcaattgggttaggttcctaccaggaatctttgaaatcatcaaatttacgatattttttagttcaattgaatcagggcatacctctaagcacttgtcaataatttgtttgttaatagctcgtttaattatcaattctttataagtgtcataatcaaagcaataaccttctttgctcaatttcgtaaattctcttataccacctctgggtgagttcctgatgaaagaacctagtgacaaaggataagatttgtcccaatcacctggatgattgaaaaagttcaataaatcttgtccattagcggtgtcatctaggttaaccattttcatagcttgagatacgacacctgctaacaaattaggatctaggtttaatctgcagaagttttgagctaacattttaaactgatgttcaatttgatctctaaacttcaaaagaacctcgttgttgccattttgcaaaattgggtaagtgtcaaaatcaaataattttgttaccaaaattgcatgaatctccagaatgtatgggaaatcctttattgtctttggaattttaatgaagttattaatgcatgatattagcccattatagctgaccaattcacagttttctaaattgaaatcttctacgaagtttttgaaaaactttgcgtgggatattttgtttaataatgattgtgattggaaattatcaactatcatatttaagaattgaaatttgttaattgagttgctcttcttgataaactcagcgtgtgattcaataaatctcataaggtagtcctcgccgcactgaatttctcttaaataattgaaaacaaatggataaatgccaatatcaaaagaaaaatttttgacaatggactcttctagaattttcataataacttcattatctttcaattgtaaagaataatctaacaaagaggtcgtaatggagtcaacaccgattggatgcagtaagtaatctgataatttttgtttttttaatggagacaaatttctttccataggaaaaatatagtcatatattttcttagtcaaattccaatcttggaaactgtttgccatgaaaaccaaataaaattcgtaagagaactcaggtatccaatttaaattatggaatttaaaccatatttcataagcttttgaaggatctaccttactcatcgaaattaagaaactcgatagcaataaagaaatattggaagcgagaccatttgagctttgaattttggaaactaaatcgtccaaaagattggtagccagttcaacttcgccagtttcaataaaactagaaagaatcacgctgtaaatttcaaactggtcatcaaataagccttggtctggactgccagatgataaagatagtctgaaatcttcataaagttctttaatggcaaacttatcatttgttaatttagcgtatgagaagcatgctatgaagtaaaaagaatctttgataaaggcaggtgaagatttaataacttgttgggcttttgacagggtgatatggcccggatagatgttcatcgctaaaaggttatagtcgagaacatctttggaaaaattgcgaaacttaaccacacttttttgctttggatcgttggtggtcgtattgaataattcaatggcaattttgtaaaaatcactaccgtttggattttcgaactgataggccaaaattgagcccttgaaaagagacaatagtacaatattataaatctcatcaggaggttttaatctattgttgatcatatcttggtagcacgtcaagagttcgtacattttgttgtctaaatcattgttatctagcggccttttgcaaagagagtccaaaaccttcgtaaatatttccagtggcggaacgatatcatttcttttcaatgattgatataaagagttgattttgttataatttttttgttcgtaacaacgattaatttcatcaatatgagtttgcaagtatgtagatttattcaggcatggttctgtgtcctccttccaaactggagcgttttcgtcttttagaaggctgtactcattttgtggctgttgtactgatggttgtgatgtttttaatgatagatcttggaagttcctattactaaagtttaaggggtcatattggtttgttggtaatgtggggccggtagaataatacctatgttgattgttgttgttgttattaacatagtttgtactttgctgctgcttcagcgatcgaagggaaacgttttggttataaagtagttcttcgtgggtgagggggttgttagtgttgtttatgctagaatccaggtcgtgcggatgcaaaatatcatctacgttgttatagtttacattcgctactacgaccggatgaggatgtagatgagatgcatgaagtacgggatccgaatttaccaaaccttggttttgccttagatactggtaggagctatcgaaaaaagatgttgcagttttcttttgagcggcggaacgatgataacctttagagtatatgaatgatttgaaagccattttcgtttgtgtatgcttgttttttcttttctgtttgttgtagtctctataaatttaaatgcacttatctttttatgcaaaaaaagctgggcgagttatttgtttctatatttgtataatttttttttttgtgaagatgaatataaactgacaaaaaattgtgtcagagttgaagctatagctccttttatgatgtgtcttggttctttgggtgcgatattagggaaacaacgcacagcaaattttcttctgctttcttataacgttataaacaatcctgttgtcttggtttattatgtggaaaacttttcacggatcaattttataaagcatacaactaaagagaaaagtgtaatatggacgaacgagagacaacttaatccatggatttgtaattgacgtgtgtatgattcgagggaaactgacagtttttgctttgtcatgggggaattgtaaggcacaccgagtctcggccccgagtgcctggccaatgagaacgcgcgcattcggagctgccccactttttgtgcgctcttgcatttcattggttagccggaggaattcggcggttaaaagcggactcgagcggaaataaagtctttgcttattgtatgccaggaaaagctctacaaatctactaaaagagtcaaatatacagctttgccaagcgtgcggcatagggaataacaacaaattggaaatgtgcggctagcgtaatcttggtatctactaccgactctgaagagtttagcgggctctcagacggttttttcgcttttggcattttattcaggtagccttagatgttaaattttccatggcatcttgcgtaaagcctgctaggttccttgccacgtataattgcgccgcgaattctgtgataaatatattgtaagattttctgttgtcttggaattgctctctctttaaataatactttatatgtttaccccaattctttgccgccgaaaggtcagcgttgcattacgtggtgtccggtcgctatttcctgggttttctgcggcagattcgcactgcgcgccacagctgcaacaactgcagtgttatttcgggtgccaatttagcgtgcttcgatctaactattctgtaaattctgtagtgactctttagggcgaagtacgtatttcatgatttaaaatccccgtcttcaaatataccgaaaaaagaaacaagacattttttagcagtttatgtacgcattttaaaagccgggaaatgcttcttgttaccccttttggcgctttggataagtagttcacttagctatttttttttccggttcgaactcggggtgaggctttatcatgcacttttttttggctattattaattttcgcagccttaatttttccctttccattttctcgcatgtggcggttttcagtattacttagagatgccttaaataaatctaacaggcaggtataccaggtacgagttaaaaacctttatcaggtggccgacactagggaataagacagcatggagcggcctggcttggtattgcaggaccttccacccgaaatcctgataaacatcttttctcacttagacgaaaaggacttgttcacgttgcaagaactttctacgcatttccggaacttaattcacgatgaagaactttggaagaacctgtttaagtctagagttcacacgactcatttccccacattttctcagtcttcgaaatttagtgtagagtatattgaaaggacacggggtcttcatcattggcagcataacaaggctataagaaccaaatacacaataattccgacgagaaactgggatcagcccagtatagaacgcatagtgtttgattatccacgagttgcagcttataatgatggtaccattacaattttacagttacaaaatcacaaaaggcagaagaaatttaagaaattgatttatattccatgtacaacaccacaaggttgttctaccatggacttcaatattaatgctgcagtgtttggtaggtttgacggcagagtgtttggaaaactgctaagtaacaaatcgtacttaacgcccgtgatggaatttacgggaaggcatagtgcaggcgttactgccatttgtaattcagaatcctgggacacgtcaagagaggactggtctgttagtggctctgaaaacggtgaaattatatggtggtgcgaaaataagcttgttaagatgtggaaggtttctaatagggtaatttggaaactggctttttttaaagattggaccttaattatggatgatgaaaagctgtacattatccatcaaatgcaggaattgcacagtattgatattcctaaggatctggacgaacagcctatgagggtacggtttttcaagatggatttcggttccatgactttggtacttgctgacctgaataacgtttatacaatatcggtcaatcccaatggtaacttcggcaatttgagaaagttggagatgcctgaacaaatatgcgcagttgaaatagatgaaaaaacttctcaaagggaacaaaactggcaatttgctggtgatgacggctgctatatcagtcttttgacgacacagaacactttatacattatcaatataagagatctttcttcgtcaggcttaaaagttcaatgtaagataagttttgatgagcaggtatacgtatcgcaggtgacaaatttaatagttgtggtagcattgccaaatgttcttcaaatattgaacgcgatgacaggcgagttaataaagacagtgttgaaaaccgagaagtttcccgaatttttgaaggtatcgcaggataaaatcattatgggaagcggtaacgttttgaattatttaaagtttgtttcaagtgattcaaagaaacatcaccattccactaaaggtaaaaacacagtaagcaataagtggaatgaaactttgaacacggagctgcaatattatgatgaagatgaagaccttagaagaaaaagacagtcagaaatatcaagattgatcgatgcgtatggtggagaccttgaactttcaggcgacaccgatgaagaaaacgacattcagttgagaattgcactcttagaatcacaggaggcgcaagcacggaatcaagctgaagcgggggagcctgtcggagatgatgaagatgagcagttaagaagggcgctggaggaatctcaactgatatatgagacgcaaacgaatagctctgcgaatcatggtaataatacgaatgatgagatagatgaagatgatgaagagtttctcagagccatcagacaatcaagagtggaggacgaaaggagaagacatcttagaaatcatactacaggtcgacgaaatgggcccttgagcgacgataattttgctacatatggtgcagcagagtcatccgaacgaacctcaactgagaacactatcggtagttctgttggcgttgatgctagtaataatgttgatgaagacttacaattggccattgcgttgtcattgagtgaaatcaattgaaagtatgtacatttggaagagcatatgttaaatattttatttatagatttttcgttgtgaaatattatttttttttttttgaaaaaaatgtcggactttattcctcctaattattaataaaatacgaatatatatctaaatataattaatgcttatttacatgaaaaatcatcaatcgtaaacagttgattaaaaaacaaaaactttatcggttccattacctttgtgaaacccattactccaccccaactcctttgcataattcaaaaccatttcattcattttaggtggtccgcaaatcaataaacgatggtcctccgcttgtttaggtaggtatcttttcatttcctctagagttacgtacccaacatcaccgttccatttaccgtttggcttatgaattacataatgaactttaaaatgcgggtactccttagccatgtggtctagttgcgatttcatgagaatgtcatcctctgtttcgtttgcgtatatcaaagaaatgtgtgttaggtcttctggagagggtatgatttcttgcagcacttgcaatacaggggttataccagacccccctgcgattatacccaactctgttgcggtgtcctgatcatattccagctcacctaacggccctttaaattcaacatactggcgaatttttaatttatcaaaatacttagaaacgacaccatgtttatacgtcttgactactaattccaagtgaccctccgtattaggaacatttactggcgtatagtacctcactaatcgctcaccatttattgtaacccttactgccaggtggtatcccatgggaatatgcaatctttcaaatgggtactttaacttgaagcagtacagactagtattacgagaaatgcgggtcttcttggatagcggtagcgcgacccatttatttctgtaaagagatttatcagttccaatcgaaataaacgctgtggcataaagtactacgaattgcagcaatgaaacgaccacgattctaccattttgcgttttccaaaagtaaagaggtgtaaccacacaattcagaagcaatccagtacaaaatggataaaacggatttgtcgaaacaaaagatatgcatgtctctactatcgacattgttgcgaatggttgctttttacaaagaaaaaatgtgatatgagttaatactaaacatacttaaatcctagagagaaaaaaagtactgcaatatatacagcactcaaaatacatttctatctgatttctaaaaacttccctgtagatggatctacgttacgccatgccgatgtttcgtttttgcttatacgaccaatcattaccgcgttcggcttttccaaaaaaaaaaaactatagtaaggataatgaaaagaaaaaagggtcccatgattactaaaaagctctaattcaaaaaaaaagtctttgataggcagctaggaatagttattagaatgtacatgaacagtcatcacactgctatatatatatatatatatattcttttttagtaaaatatagagattattgagacaaaaagagactagtcggacaactcactaggatctataataccatttatgatagcccactgtttgtttgccaagaatacattatcgggatcttgctcctttcttattttccggaactttttcaaatcctcgccataccattcttcaaccttcaatgccatccccctcatttcaaagtcatcgtaatcagtatcctttttcactggtccagcagctagagtggttgagcctaggaagttcttggcccaatgtggcttacctcccgctaccatcatagtattttcaaaaagggtaaaccatttatgaattggagtattacagccaaacggcctataaatggtagcatttatgtacaacgtcaactgactgttggtaacattttccaacggagcaaatctgcaatgggatggtgtgttatccaggaatgggcggcacacattgccataaacgggaccgggactggtgtttgttctcttgctagtatccaagggttcagaaggtaatgtagtatttgagcaacggacttccataggcacgtggacataaaattctttgtttatggcagcctgcgcaatagaatgatccaatgaacgtaagacttccaaaccattatccatagggcacccccattcatcaacaaattgtgaaaacaaacagtccatattaaatccgctgatagaatcggtaacattaacatcaccagtagagctcttctccaatttcccgtattgcctgttgaaaacgaacttttccacaaatggggttaatggcgcatagattttggtagagatccataatagagtttcgtagaaaaatctacccagcttggtaccccaccatgacttggctggaccattttgggcatctgtagttttgttacccctccatagaacacattttctagtataagggtaccaccaaactctgataaattcagatgaagtccatagggtatcccattgcttcaaaaggttttcaaaagtaatcacttcttgagtggatttaatattgaagccgggaacaaccctgatagtagcagagacaatgataccaatttttccaactgaaagtaaagcagctttaaagacttctggatcgttttcagcatccaagaacttcaattcgcccttaccattaacaatagtcaagtttacgtattgagaagaaatcaaaccgtgataaggtgaggaaccatgactaccagtagagattatgccagcaacactttgttctgagatagagcctaaattttggatagagtaacctttcgcacccaaaaattcattcaattggtaaagcctcataccggcatcaactgtgacatcggcataatgtaactcaggatattcaacaaacttttgtactttgtccaatctgtctaagttaacaagccattcatcagtaacgcacatgttactaggagaatggcccgaaccaacagtaactaagcttttttcagctagcctggcactctttactaactcgacaacctcatcaattgaacttggttggaagtaacgttctggttttgcagaataaattccggcccagtttttgaacacatagttctttctaaatgggatagtagacatggggtgaaaaacctgataatatcggtaactttaattttacgggttcttgttttaccttctaatgaattttaagttttgaaaagcagaaaatcagatattgaaactatagatctgcttaccttgaagttcactatttttggaattctccttgctaatagttacttctactcttgctttgtcctggatatcaatggaagatgtcctcatttccattttttttttcaattcgacggcaaggcgggagaaaaggaactagggatacaaaaatgcaattactaatgaaatccgtgaaataatcatggaaatgggtgatgtaagaatctgatgaaacaagtacaaatgtctttggcccatcaactacgatgagacttactaagctttcatcaaatgcaggttagagaaggagaatggtttttttttttattttttgtacatagatattagagaaatataataagtagattatagataagatatcaccaaagagatataacagtagggggaatttttttttttacaatatacttgaaatatagaaaggataaggaggttgggggcgagagtgaaccttaaaattcctcttcctcagcgtatgagtcggcacccacttcgatgtaatctctttctaaagcagccaaatcttctctagcttcggtgaattcaccttcttccataccttcaccgacataccagtggacgaaagcacgtttggcatacattaaatcgaattttctatcgattctcttccaagcctcagcaatggatgtggtatttgacaacatacagacggccctatccacagtggccaattgtgagtttggtgtggcagttggaggttcgtagcaaataccgatcttgaaaccagttggacaccaatcaaccaattggacggtcttcttgtttttcacctgctcgacagctctttgaacatctcttgttaccacatcacccctgtataacagacaagtagccatgtatttaccatctcttggatcacacttgaccatctggttaccaggttcaaaacaagcgtttgtaatttctgacacagagttggactcatggaatgcctttgatttggataagactggagaatatgaaactaaggggaaatgaattcttggatatggaaccaaattggtttgaaattcgttcaaatctacatttaatgaaccgtcgaatctcaatgatgctgtaacagatgataccacttgagcaattaggttgtttaagtttgcaaagcttggtcttgggatatccaagtttcttttgcacatgtcgtaaatagcctcattatcgaccatgaaagtacaatctgcatgttccaatgtagtatgtgtagttaaaactgtgttgtaaggctcaaccacagaagtagacacttgtggagcagggtatacggcaaattccagcttggatttcttaccgtattcagcggatagttcttccaacagtaaggaccctagaccggaaccagtaccaccaccaagagaatgggtaaacaagaacccttgtaacccatcacattggtctgccagttttctaatcctatccagaacatcgcccaaaatttctctaccaacggtgtaatggcctcttgcataattattagccgcgtcctccttaccactgatcaactgttctggatggaacaagtccttgtaaggaccgttacggacttcgtcaataacgttgggctctaaatccacgtaaatagcccttggaacgaacttaccgtagccggtttcatggaaaaacgtggagaaaccctcttctcctcccttcggctttgaaaggccatcttctagatgtccatccggcttaataccgtgctcaagggaatataattcccaacaggcattaccaatctgacaaccagcttgaccgactgtaaagagaaatcaaaaaaaaaaaaattttgcgttgaagttagtaatgaaagatgaaacgccaaaatgaactaacaaaaaaaagatctagcctggacgggcaaatcgaacataccattaatactaataacttctctcattgtttgtttgcagttgtaagtttacagatcttgggtggcgagaactgttgtagacggatatactgaattgggtaaaacgatatagtagatgtttttgttttgttttgttttgttttgtagtttagtttttcccttggctcgaggcgttttcgcgtggcataacccggccggaaactacggtgatattatcgtctggcacatatatatatatatatatgtaaactatacttatattaatagtttccgatcgtcttattactcacttactatcaatggaagcactatttcattacttaaaaaatactttctattgcaggatctgaaacagtcagttataatggaaaaagtatgcaattgtgttttcttaaagaaggatacagatatttatatatgttagttcctctggaatatatcgctagatgcattaaacatgaagaaatttgccgtatgaattattcctgtatgtacaccaaatgtgtcatgatcttcttgtttcttcaatgtggcgctggcattcgagagtgatgatgcttggtgtgagcacttgaaatgtctcctctttaagaaagacaatcctatcctttcatgatcaagggcttctaaggcgtctctcaatgccaatttcaaatcggtagggtctgacacggtctggtagcatttattaatgcagtgggtaaggaagagggagggcttgataatgtggttggctgaaatcggatggcagtgcccgccattgatagactcaaattttactgtcttcgtacagtggttgaaggtcagtatgagttttgactcgcagatcaaatgtattttgtacttttcaggagtccttgttctttgtatacgcttattgctgagttgctcgtgaacattcatctcacaaacgagttcgtacttgttcttattgattttctttgtcctgtagatgaaactaatgaatgaatatactctaacgaactgctcaaacgacagggtacataggaactcgaaggaggattttggatgcttgaaaataaagtccctgaagtttagaatgttgttgatattttcgatctcgtccttgtttactggatggtgatattcctgtgcgcatgcaattagttgtttaccagacctaactttgctcaattgtgcctttgtttttgcacaaccaatgtagtttggaatcttcctaattaattcctcggtactatctcgctcaacatcacggccgccgccattcccgatcacaattttgggcaggataggatgtgaaactctgtcctctactgtgctgggcacaggcgacggtggtagtttcaaatctggcagctttatggcgaccggggccaaagggggtgagggagccgttgcttcaaactgaggtcttggggaggtcataggtgtgataataggcatcattgcggcatgatttcgtacagcgacagggatagtgacaacctgttgtgaccaatggacgggcgtatttgtgctcatagaaggcaatatgggtgttggcaagcacctggggctggagtacccaaatgtcagcgaatgttgttgatctaacgccaatatgattgggggcagaacgggcgataggcactgcctgcctggaggtgttctgggaacgtgcgcctggttgttgttatatacatgtaaatagtccattgagtctttaccaggttctatcttaactaaagaactacttctacacaagacttaaggcaccttcatacgaaaaccctctccacgatggcgttcaatctttcgtctttatatacatatgttactttatatatttatatatttacgtatacacccgaatgtatttatatatttgtatgcatatgcccacacgtatatgctcaagagtaaattctccgacccgtttaaaagcaagcacacgtcaaggtttgctgtctccactcgattcgtaccgttcctgcggtactcctaggcaagcagttaggccctgccattcacccactcaacagttttaacagtatacgactgcaaggccatcgtttaccggcagggtctattgttctgcgcgttccttattaggcaccgccaaaaaaacccttgaaattttcgtttaggtgccggctcgttaagggcccttttgctctcgcataacgcaggcacaggtcacgaactgcggtgcggataccctcgatttaaagacaggcagcaggtgaagataataccatgctcaacatggacgccaaggatagacgtgtaagtttaagtttctctcgttgtatcgactgacctctttaatagcagtccttaccaagttgaaaaaccacatcttcgtgttacccgactacctgtgcgatgccgtctggaaaattcgcaatgaaaatttgatgaaaaaattgcctctcaatagtgaaagaagtatagcagggccacgcagagagtaagggctataggcgaagttttcctgacattttcttcttctataggacattataatatggtttcagcgcaagtggctaccgagctaggacagcctataccactggacactcaacatgcggtatctgtatgtttcccgacatggaaatctgtaatttcgtatgtggagaaagaccccaaagttttagggtgtttaaagtctggctaccccaggttttggatccacccctcgattcaaaagctgcgtgatattttaatagaaaagtatgctaaagaaaacgaaacgtgcttttgcttcccctcttatagagttgccaaacggtgcagagagtatgtaagaaggaagtgcgcgcatcgcaatggcaaagtaaggatattacagttagccacggcgaaacctatcaacgaggagcagaagacgtggaaaagagagtgtaagattgcggtagtgtttgtagatggggcatacgagaatatattaaaacagtattggcaatacaccggagagatcatctcaagcagactagctgaatatgttttgcatgaacttttcatggtagaaaagaaatccagccctgcagaggaaaaggaatacatagagatgcggtatggcaggaatctgaattttgcatttgccgatcgagccaaggaattgattaagaagaggatcgctacaaaggttatagataaagatgagcacgatgaggaggaaaactaccatttcttagcaggtaaccaagatgaacaggacttccaggacacgtttctggattcatccctcaatgaggctaaccacggagaagatcatgacggcgggattagcggtgaagtagacagtcaagaagaaccgcataatggccttgtttccactatacccccggagcccatcgaaatgagcacgatagaggaagagcaatccgtagaggaagatgccgggaggtgtgcattaagggtttgccctgagagagacgtttttttgtttccgagcggcatggcgtcgatattcactgcgcatagattgctgttgcaatgggactcactgcgtttgaatagatccagaaatggaagcgacgtcacctcgtcacctccgaataagaagaccgtgatttttgggttcccttatgcggatacattacatgtcttgcaagagtttaatgaaacgtatttcttgggagaaggagatgagtcttcaatgaaagaactaacaaaaattttacattccggggagcaaattcttgccgtttttatagagaccccatcaaacccactattaaaaatgggaaatttactggaactgaaaaggctttcggaattatttgggtttttcattatcattgatgaaactgtgggtggaatagttaatattgacggtctaccgtttgctgatatcgtttgcagttcattgacgaagacatttagtggggactctaacgtcattggtggttcaatggttttaaatccacaaagccgggtatacgagtttgcctcccgttttatgcaattagaagacgaatatgaagatttattatggtgcgaagacgcaatttacctggaaagaaattccagagatttcattgctagaaccatcaggatcaactacagcaccgaatacctcttagataaaatactgaagccacacgtaggcgaaaataaactattcaagaaaatctactaccctaatctaacctcaaaagaaacactaaccaactatgacatggtgaggtgtaagaaagaaggtggatacggcgggctcttttcactaacgttccatgacgaagatcatgctgcggccttttatgacaatctaaagctgaacaagggtccttccttgggcacaaatttcacactcgcattcccctatacgctcatgacatactaccacgaactcgacatggctgaaaaatttggggttgagagaaatcttctcagaatcagcgtaggcctcgaaagtcagtcaatattgggcaagatcttccaagaggcaattgataaaacggtagaaatatgacaaaagaaggaagataggcatagtgaattttatttctaatttcactttttatgttttttttttcgatatttaattttttcacgcattacgaatatatttctatatacaaacatatgtagtagtactagtagctgtcatcatcacctacaaatgtgtttgtcctagcattattcaatcaacttccacaaactttccaccttttgcgaatctgggatttcttggatcattgataaattccttcgtgttagaagaaaggtcagcagctttactcataccataatacactgcggcgccagccacaaagaaaggccagtatactttaaggataggggtagggaatcttttcaacatggcagtacaatccaatcaattaatctgtcgtcgtatgttaaactaacgatatctgagtcgaactcttctcaacacatctcagctgattgttccttatattttctctaggcctttttaaaccctcggagatttatccgtgtaaagccgcattgtttgaccttattgggtcgttaagagtgatacatgatttattggatgtttttttggccaagttttgattattaacctttcgtgttattattgcacgattaagtacaatagattaatgttggtatactttggttgtggctgctttgaatacttttagttttgttgttataacaactatcattgcacggaatcgcagctattttaaatccgggtaatggctcgttcatagtggcttaatctttttttttgctgaaaaacccgtagattattaacaatgatgaatggataaacgccattgtttggtctcaataaagtggtcgtattgggttattctggtcatactggtggttaaatcgactgtcggaaagcaccacggataccctgggtaaaataaaagcccagttgtcttctgttctatcagcagcgaatatttcagcttcttgtaattgtacgttgcatctgccatgtcatcggaagaattcaaaggacttccgatcaaacgagatatatcctccactatctatgctgatagacctccagcattatctgctcctccgtgcgttggtgctactgggaatgataaaatacaagtactaccgatccccaagaaatctaggactatcaaaaccgataagccaagacctttcctatgccacatctgtacaagggggttcgtgagacaagagcatttaaaacgacatcaaagagcacatacgaacgagaaaccctttctctgtgtcttttgcggaaggtgttttgcaagaagggatctggttttgcggcatcaacataaactacactcagcactggtttctaaagaatctataaactctaaggataaaactgaaatagatgctatcaatgataagaatataattcagattcaaggcaataagcaaacaattttaccaacgcctagcaatccgctagcaaagacggcagtacagttgaaaaaagccgccaaagagaaaaaaaatggtaagcaaggcaaattagacctgagtccttcatacggggcaaataatcatagtacagacgtttcaccgtcagtggggaactcatcaacacctgctgtaatcgaagagacagactcgtcttcccattttccgcttccagatacaaatattccgaccaaatcaaagaggcatgcatcattttcggcatctagcgcattcacatatagttcagataactttcaaaagctacatcaacaagcaaaatcggattttgatgaactacaggaaagtatccctcaccaagtgggattttctacaccccaattaacggcacaacaacttatagaaaatgctattgaatctggtgttgtggacttggaaactttggatttaccgccatttttatcgttagatggcttaccacccgcgagctcaagtgctgctgtagcagcatccgagcagatagatatctgtccctcctctgcgacagacactatctctggcgctaacagtactccaaaccaagcagcaacagctcctccttttcaattaccaatagcaagggaaagcagttccttgtttttggcaaataccccttatttatctgactttttaacaatgggatcttcctatggtggttctggagggtttgccaaatctatcactgctgatcccagtttggactatttcaactacaaaaaccattcgcatccagattcaaggcataacaacagctccagcggtatcaattatagcaataataaaaacaacaatgaatcaattgaaaaatctcaaaacaacagtaacgtaatcaatgaaactattgaccacactgacatccatgcccatcacgcggatgctcatgatgactccttcatagaaagtgaagagtggctctctaagtttattatggactctcagattgataatgatcttaaacttaatataaaccattttaacgatattgggtttaacaatttacaccctcaaaatcctacgacccattctgaaccaagaaatatgcataatgaaaacagagatatgcaccgatctgcaagcaaatttcaatctgtatcggaaaacatctctccaagggaacaaatgtctttgtttaaaactaaacagaacaaggccatttcaaaatttctgtctgacgagaaaattccttcaactgcgtcaccatcttcctctgcttcgccagttcagtttgataaaaaaaatgttgacatcaatgaatttttactggacgagtccgtgtccaacttattcacgactaggcaaattgatttattcaagaaaaatgtgaacttatattcaccactatttcaaaatcaaaaagacgcagtctcatctacaagcctgacgccatcgttgactacacaaactgcaacgacacaatcggggccagggtggacagattcctcccaaaagctgactttctttacagaacagttgagaaatttaattattaaagaaaacaatctaaagtctaatctctttcccactgttgatgaactgaatcattatgtcgatttatatcaagtggaatttcataaatatttcccctttattcatttatactcaattataccatccagtgaaaactatcctttagtaatatccatcagtatgattggtgctctttacggatttcattccacacatgcactactattgtcgaaaatagcaaggacgagagttagaatgttcctagaaaatactcgaagcaatcatgataagacaccaatttggctaatgcaatctttagtcttattaacgtttaccagcattttctccaatgatatgaatgcctttagaaccgtgaatacccagataatgattttggttcagttgattaaaatttcaaagttgaattacccattagaaaacttcattaagccaccgatcgaaagtgaccatgttttagaatatcaagataaccccgctgttttgaaccagttcaaggctcaatacaatacccgtgaacaaataaacagaaatttcaaatattttatcttagcacaatcaagaataagaatatgccacatagtcctgctgatttctaacctctttaaatccttagtggatttcgattgttgttttcattccatagatttgaagtgtggtgttccttgttacaacgaggtactgttcttttgcgaaaattcaagaacttggaatgagaacttgacgagattcaatatcgttttggattccaagttttccctaattgaagtatctaatggtgaatcaaactacgagaagtgcttgatgtatttgtcaaacggtaatccttatctttataaaaacgctaaaatctcattcaagactttgctatctttactgatctctattcatgaaaagataaacatcgaaagagatgcgttgaaagatagttacgaaagcgatttccatgcgaagaatgttcagtggcggatgcattcaagacccttggtcgccacaatgctaaaacattgggaactactttacatcaaaaatggtgggatattggctctcagtgacgaaaacctgccaataataaatactaatccgtcgtttagattgataattcccttgtacttctttgcaaagctaaggaagtgccttgatattgctccaacactaagatgcatttggaaccaagactggaactcaatgaatagctctttagaaaaagtgtgctacgagcgggaatcactacgagaggccacagagtacgctgtatccgttatcactttctggattgatactgtctctgtaatgaagggtaaatcgacacagactccaatcttcaccattacttgtatttttgtttcgatattggtcatagcggggtacatgaggagattggaagactttgctcaaaacaaaaacagtgattgtatgattggtagtttaaaaagcactgacaggatcttgtggttaaaagcattcaaaactttgaagaggatcgaatcacatttatctgaaagagagtataaattacaaacatttgctgagtttttaagggttccagataatggcagtcttgatattgagagtttggactcatccttaatagagaatactttgaattcacatgatgttaccaatcaagcgctggacataatcacgagaacaagattgtcatcaagaacattgtattgcggtgctagaattcttggcgatacaccagtctggcccgtatctctgttgtttgctcatgccttacaatctagggctatttacaatatcaaccacaggaaatctgtaaacagtgtatagactttagatagatatttagcatatccgtatgtaacattatattagttctttagggcaaattgaaaaatttaatcatcttttcttattcttaaaagcgtgaaaatcaaaaaaaaaaatcgatgagttgagaacatatgataaataaaaacaagcaaggtgatcgtcaaactgcactcacgcacacatagatttttagctcccaaagtgctatcgtctatactatccaagtttttacaggctcgcaataagctcaataaacaatatcaactgcatatgactgaacctgccctgagtagcgctaataacgctctgatgcaaaaactaacaggtcgacaactttttgacaagatcggccgtcctactaggatcgttgcaccaatggtagaccaatccgaattagcatggcgtattctatcgagaagatacggtgcaaccttggcgtacactcccatgttacatgcaaaattatttgctacctcgaagaaatatagagaagataattggtcttccttagacggctctagcgtagataggccgttggttgtacagttctgcgctaatgacccagagtatctattggcggcagctaaactggtggaagataaatgcgatgcggtagatttgaatttgggctgtcctcaaggcatagctaagaaaggtcactatgggtcatttttgatggaagaatgggaccttatacacaatttaatcaacaccttgcacaaaaatttgaaagttccagttacagcaaaaatacgtatatttgacgactgtgaaaagagtttgaattacgccaagatggtgctggatgctggagctcaatttttaaccgtccatgggagagtaagagagcaaaaaggacaaaaaactggtttagctaactgggaaacaatcaaatacctaagagataatttacctaaagaaaccgtgttttttgctaacgggaatatcttatatcctgaagatatttcacgttgtatggaacatatcggtgctgacgcagtgatgagtgctgaggggaacttatacaatcctggtgttttcaatgtaggccaaactaagaacaaggagaagatatttccacgcgtagataagattatcagagagtatttccagattgtcaaagaatgccaggaatctaaagcctccaagacagcaatgaaatcacatttttttaagattttaaggcctttcttgccgcatcatactgatattaggtcaacacttgctactatgaatgcaaaagccacgtgggaagaatgggaggaacaagtagtgaagcctgtcgaaaaagtagtgcaagaaatatttgaacagccagatatcgctattaaggatgaaattactatcggcgaaaagcaatcatggggtggttcatatagaactgttccatactggagatgtcaaccatattttaggcctgttaacggtatcacaggtgataaaagagttatgcaaggcctcatagatgaaagcgtgaacaagaaacgtaaagctgacgtgccattagaatctgctgataaaaagaaggacgtgaaagcttaaaacctgataaaatccatgtatatttctttgccttttctattcttttctctaagtatagtttttatgtatgtatattaattcaaacagaaaatgttcaactccgtctccataagaaaacttctttcaatttgaacacttgtatattcaatcagaattcgccatagagagcatgtcagccaatgtacaagaagctgcaaatgcagctatagagccggccagtttcgttaaagtcccaatgcctgagccaccaagtagtttgcaacaattgatcaatgattggcaattaatcaagcatagagaaggtgggtattttaaggaaacagataggtctccctacaccatggaagtagaaaaaccagtaaatggaggctcaggtaatactgaaatggtaacaagaaatcaatctacgttgatctattatctactaacccccgacagcccaattgggaaatttcataagaatattaacaggatcatacatatcttacaaagaggcaagggtcaatacgttctagtatatcctgatggtcaagtgaagtcatttaaagttggttttgactataagaatggagaagtctcgcaatgggttgtccccggaggtgtgtttaaggcaagtttccttctgccaaacgaagaatttgacaacggtttcttgattagtgaagtagtggtaccaggttttgactttgaggaccataccttcttgaagggtgaagatgaactgaaacatcttgtgggacctgaaaaggcagctgagttagcttttttagcttgaacttttgtacttagttattatcaaaataaccaataagaattattttagtcctttcgcaccgcgattattaataaactcaatatttttttcctatttaattccataaagaaacaaaaaaaaaagcaagcaactacaaaggtctacttaccatgtttaaacgttccatcattcaacagtcccgcttattctccaattctgcttctagactaggtaaaaaagtgttctttgatcctgcggtcaatggaaccaaaatcggcagaatagaatttgaattatatgataatgtggttcctaaaactgctgaaaatttcagagccttatgtaccggcgaaaagggctggggctataaaggtgtccctttccacagaatcatcccagacttcatgatccaaggtggtgacactgatttgactaacggttttgggggcaaatccatttacggttccaagttcgctgacgaaaattttgtcaaaaagcatgacaaggcaggtttgttatctatggcaaatgctggaccaaacactaacggttctcaattcttcattaccactgtgccttgtccatggttggatggaaaacacgttgtctttggtgaggtaaccaaaggtatggacattgtcaaagcaatcgaatcatacggtactgcttctggtaaaccaagagctgaaatcgttatcgaagaagctggtgagttatgaaggcttatatgaagctaaggtctctcatatttctagcatataaggtatgcgttatctctatgtctacgaattatatctgtttatagtgttttattttatatagactcgctggctcataaaaaatcaaccaacttttattctggtttgcctcagtcgaaatgttgtcctttactattgactagtgttgaagaatttccggatcttatattttcgacaattgagttccaacatacattacagaaaaaatacaaaaaaaaaatacagaactatcgtaagataatctgcttttgatataaatcataaatcagtggagcatggggatatattcattttggatctttgataggcattgtaactgtatatttgatagagaatggacattggcgtccaatagcgcaagtggtacaataaactccaaacagaatgaagaagatgcaaaacttctgtatggtatgatattttcgttacgctccattacacaaaagctctccaaagggtctgttaaaaatgacatacggagtatatctacaggaaagtatagagtccacacatactgtacagcttcagggctatggtttgttctattgtccgactttaaacagcagtcttacactcaggttttacagtatatttacagccatatttatgtcaaatacgtgagcaacaacttattatcaccgtacgatttcgctgaaaacgaaaatgaaatgagaggtcaagggacaagaaagatcaccaatagaaactttatatccgttctcgagtcatttctagcaccaatggttaatcagtgagcacgaaccatgagcagaagaaaaacctaaaataaatagaagcgatgaattgaattgcattcatcgtatatatacctaaggataaattaattagttttacatattttaaactttgtttgttaatacaaactcggatctggtttgggtcataatttttgttgtgggggctcaaatatcattcatgaaaaggtctgtccaaaactcgtcatttaatgaattaacgccccatgctaaggagtttatatccgtcaaataatcgttcaagttgtctaccgatgaactaggtgatggttttatattagttgagtcagcagagttagtcacatcattagaaataaatggtggtggtaatagagttgtgcctgtcatactctctcggtgttcatgtggggattcattcatatatgaagtactgttaatattcaggttcattgcggcagtatcgtcacgaactcttgagtatactggcagcatttcatcaggtacagcggttatgttttggtttgtattattgtcgataattggatcttcttctgttggcatcttttgtgactcggttacatatgcatttattggcttcgtaccatcgtggccattgcttacttcgtctatgacctgcttttcctttagtttctccctttctgcattgtagcgatcagcaacatcaataactttgtttgcgtaggtttgacaaaataacgcaataacatacctaaatttgtaaagagagttgttgaagggatacagctctgatgttttttctaaaagattgtttacccctattaccaaggcaatagcatcatctgtaaggggcattaaatcgtgaaacgaaggaatagcgactacggaatagcgcagctttaataagagcataccaacggtatatatgatcctggaagtatgaaataaaggtaatgaggtaattaaaattggctccaacttggaaaattcctcaagggcagatttacagcaatgatagcatttaacaaaatcatccattatttctctgggcaattcgactttttcgtttatggtatgcgacatttccccgatgaatactgcaagtttatactggtataaataagcttctacagagtaataaaatgcaatcactcttggcctgtttctgtcaagtttagtgaaaatctcttgcaattgcttgtggtatttttccattagtttattaagatactttttagtaaaaataggatcatcaaactcgtcatcatttagatctctctcatgtaggtgtgtgtgaatattttccaagacgtggttcattttagcaaattgaaccaagatgggatcatcagctgaatcaagtaatagtttatcgttgtcataatgtcgcgattttttcgtctctttaactaaatcctcgcaggccttttccgtgacgtgactccaacgagcttgtattgattgacgtagaaaaattgaaatattgagtgcggaaatgtataccaataaagttaaactggcgccattactgtaaagttccaaaggtgacttgaatctctttggatcctcgtcactaaacataccaaaggatcgattgacataggtaggccccaaatctctagttaaacagcaacagatgtaattaaatatatggtatctcgttttacttgaccattcaaaaaaattataccatagacataatgtagacagtgattcgatgatttcgatagatttattattagccttgaaaatctgatttgtaattaagtttagtacaaaactatcaagcttcataatagttcctctggtggtttgtttgggtgttagtacaattgaaacacatgacataatgacggagaataaaataggtttcttctttcttaattcatcgacactaacattctcttcgacctttatgaatggtaattttgacaaatatgaaatctcggttttataaagatgtaagcgaagcgtcgcttcttcatgagatatgattcctactgatacaggatctgcaatggttggcaaaaacatgctcttttcaacaaggtcattccactgctttgaccaagtgtcaagcttcatcgaaatatctctaattttacctttttgagaaataatcagtgattgtagctgcttcctgaacgaccgtgtcatatgtctagagtatgatttcttttgtcttttcactttgacgttctgtgtttcctcatcacccacaattttaggcctatgtttgaacagtgcctcgctgttaatgctggtaggcgcagatgaaatcggtacgggggagttgtaggtactgtatataactggcgcatcactaatattagtatgctcatcgttagatgctaaaactgctggatttgtgggcacactgccattggattttgtatgattattggtggttatctctccggtagatgtggtttcggcctctcttgctccatatgagggtggttggcttaaagttgaccaaagatcggataaactttgttgaagtccaggtaagactgtccgagagtttggaaattgtttagcgtttgggtcagaagggaaactggcgaggtaagatgtaccatccttcaagctagattcttcagaatctgttgggcctttgcttttagtagagacattcaccatcggcgattcaaaaggtgtgggtgaccttgatctaggctttctcttccttgtcctttttgaaagatcaaacttgcacagcttcttgtgtttcagacaccttcgacaaggtttcctataaatatcgttaacatcagaaggctcacatttttgcttcaaggaatggcagcatacacaagcaaatgagtttcttttggtcttccccttttcagtagtctctagttttgtaggatacgaaagcctagggtcatctttggagcatccttctataatagtttgtgtggccttatctatgcatgggacatccgccttcggcaaagaaactttttggtcggtctttgaattatcattattgatttctttcccgacggcaacgccagttattgcaatctgcgtgtccatgttgtaattcaaccctgaagatcttcccgatcacagtcaatacacactagatattaatgtatactgtatgaaaaaattgactttccgcttcattgctcctacatttatcggatggcgcacatagctaaaaaaggaagattttcactcataagggaaaggaaccgcatgactcaagagaagcatgtggtttttgagtttttttcgttgaattttcaggtaaagctcaatagttatgacaattacaacaacagaattctttctatatatgcacgaacttgtaatatggaagaaattatgacgtacaaactataaagtaaatattttacgtaacacatggtgctgttgtgcttctttttcaagagaataccaatgacgtatgactaagtttaggatttaatgcaggtgacggacccatctttcaaacgatttatatcagtggcgtccaaattgttaggttttgttggttcagcaggtttcctgttgtgggtcatatgactttgaaccaaatggccggctgctagggcagcacataaggataattcacctgccaagacggcacaggcaactattcttgctaattgacgtgcgttggtaccaggagcggtagcatgcgggcctcttacacctaataagtccaacatggcaccttgtggttctagaacagtaccaccaccgatggtacctacttcgatggatggcatggatacggaaattctcaaatcaccgtccacttctttcatcaatgttatacagttggaactttcaacattttgtgcaggatcttgtcctaatgccaagaaaacagctgtcactaaattagctgcatgtgcgttaaatccaccaacagacccagccattgcagatccaaccaaattcttagcaatgttcaactcaaccaatgcggaaacatcactttttaacacttttctgacaacatcaccaggaatagtagcttctgcgacgacactcttaccacgaccttcgatccagttgatggcagctggttttttgtcggtacagtagttaccagaaacggagacaacctccatatcttcccagccatactcttctaccatttgctttaatgagtattcgacacctttagaaatcatattcatacccattgcgtcaccagtagttgttctaaatctcatgaagagtaaatctcctgctagacaagtttgaatatgttgcagacgtgcaaatcttgatgtagagttaaaagcttttttaattgcgttttgtccctcttctgagtctaaccatatcttacaggcaccagatcttttcaaagttgggaaacggactactgggcctcttgtcataccatccttagttaaaacagttgttgcaccaccgccagcattgattgccttacagccacgcatggcagaagctaccaaacaaccctctgtagttgccattggtatatgataagatgtaccatcgataaccaaggggcctataacaccaacgggcaaaggcatgtaacctataacattttcacaacaagcgccaaatacgcggtcgtagtcataatttttatatggtaaacgatcagatgctaatacaggagcttctgccaaaattgaaagagccttcctacgtaccgcaaccgctctcgtagtatcacctaattttttctccaaagcgtacaaaggtaacttaccgtgaataaccaaggcagcgacctctttgttcttcaattgttttgtatttccactacttaataatgcttctaattcttctaaaggacgtattttcttatccaagctttcaatatcgcgggaatcatcttcctcactagatgatgaaggtcctgatgagctcgattgcgcagatgataaacttttgactttcgatccagaaatgactgttttattggttaaaactggtgtagaagccttttgtacaggagcagtaaaagacttcttggtgacttcagttttcaccaattggtctgcagtataactggtatgaattctagcagcattcaataaatacacattgatgacagcactgcatactaaggcggaaagaactaatttactgacgaacctatcacgaatggcaacactgacattacgaagcaatagaagaaccatatcctcaatgcgttggtaggacttaatgggtttgtaatataataatggggtgacactaacaatagcttgctctttaaagttttcagaggcattcgaggtaataaaatctggtagagaaacacgttccttatcgaagtacaatgaattgaaggcatcattgacccaatttgcaccaaagttataaaagttgatgaagacaaacaacagtatgacagagagtttcatgataatgacaaccacactgagatttaagaaagaagatacggatttcttttctgctttagaaatgattcttgctgtagatggaacaacaccgtcttcttctaatgtttgcttgataatagtagatctgtggataacattcatttccagtctaagcgctaagatagcagaataaaatgtaggagttaaaatcaattcaaaaattaggataaatgctgataatatgcagaagtttgtcaaagtcttcaattggtgagcatacatagagcatccgataaaggcaaaaatacaaagcaaatggtcttgaatcaaacgaccaccctcttcgctcacggattcaaaaacgatttcatcggtagtaatccttttagataaaccgactctttcaaatttctccagggcatactgggcaatcttgattttgtgcttgaaaccaacaacaactacaatgaaaggcaaaccttcaaaaagagttaatgcggaaacttctttgcctagaatacattgggtgacatacaatgctaagaaaagtgatgatgcagaattgaccactgtagaggcgctcaaccaaaaatttgacccggtcttcctcatgtcattgaagaggccgaatatggtgtagaacatcattaggtaggcagtaaccataataaggacgtcaaacgggtctgcttgggttacattttctgaaaatacatcgtagagagaatatgctaacgtctttacgtcgaaaagactttttctgtcacttcttaacctccatttcgttccatcagtagaagaaatttctttggaaacactgagatcttcttgcagaatatattttgtattatctttctcaaaaaccgtgttagctagttctggaatggagtcagtttcattaggactattgaagttcaggtttaatagatagtaatggtgtggggctggtaactcactagcttcatgcgcggtgattgatacccaaccatctagagaggaatctctgtagtaatgggaacattcttgaaatagagtgttggagtctttatttggagcagtttcaaaaacactatttgaatctagttgccaaccattgaagtaatactgaatgacggatagataagcgaatgcggatatgattagagaaaaaagtattatatgaattggtcgtttcgccgaaaatcttgaaacataggcaattggctttgccatctgtttcagtcccttgaatagcggcggcatgcttgttttatgtatttatctactttgtatcaacaattagacaatgatacactatgttccagcccttagtcttttcctgactagaattgggtagaaagaagaaaaaaataagttaataaaaatcaaaaaaccgaagacgaatatagctctttcaagttgtcttttttaaaggaatgcctttgaaaattagatcttttaaactttcaaaaatctttgcctggatttatcgaacaacagcttttcatagccgaaaagatacaggaaaaatgaggaagaaaccgatgaattgttttataagctatcacctagcgataataataggtaaagtagagatcctatagctagtacggacctttctttcggacgttctatagagttttaaacgagcgggcgtagagactcgcactacgttttcttcgcactacgctgaggtcttccaactcttctccagaaggcttttctttcccttagtccacccgataaaaatggggccctttgaaattccgttttgtagcttagtttctcggacttaaagcatgtgctcaccatactaccatcacccgaatgtacagccaacgccactttagtggataataagtcatgatagtggacgaacaatcggggtaaaaggggttggaagagaacggctggaatccatcaatcagcagcgtttaacggttctaattttcagttacaaggatgatcaacgagagccttatttctaatgttccctaatgtatatgtgttccggctactgtttagctgaagagctgtgtctagccttcctggcggttatcgttcacagtcagcttgcgctttatttcattaacatcgaactaaatactagaggccataaccgcaattacagctgcggcgataatctaatttaacgtcaatgtctgaattcttattgctttgaagatttcttcacctttcttgacgaccatccagtagcactcagtgaaataggaacagaaagaagataacgctttttttgccgccatatatttctttctatacaacacagcttctttatttgtatcatccgcggagaaaagtaaaatgaaaagcttataaagagcaatagatactaaaaagaaatagaatgttttcggatttacatacagaaggttacaatattatgtaaaaagaataatatatataaacatctatccgtacgagcgcgtgtactagtttttcatagaaaccaatttaacgtcgaatgtcagttcggaattggcaggaatacctggcagagcttgcttcccgtaggcatatggtgctggaatgatgattctacgttcgccaccaacagacataccggcaacaccaatgtcccagcctttgataacttcaccacggccaagtttgaatgcaaatggtttaccgctggtgttcttgtcgaaaactttaccgttctttaacttaccaatgtacctcatgcctactctggcacctctcttagcctgtgggccatcaccgatagtacggtcttcgattactatgccgccttccaaaaccttactctttggtttatgcttatcttgttcctttttgcttttgggttttgttggaccctcctctaagtccttcttgaattcgaccttctttacttttttagctttcttttcttcttctttctcttcgtgctttctctttttttcctttttgcttttcttaggttctggcttaacttcttctttttgttcttcttcttcttcttcttcttgttcttcttctccatcattatcttcttcatcttcttcttggacttcttcaatacgaacttcttcttcctcttcgtcatccaagtcgtccatgtcgtcgccaataatttcatcctcatctggggtcaagtcgtagtcttcactgtcatagatgtcagcgtcttcatcttcgtcttcaccttcgactcccattggagtatcaaatggatgcttaacatagttaccgctcaaggagatagcgtaagaaccagtgacaatgaattggacttcttcttctggagtaatggtcaagtccaaagattgttggtattgggcttccggagataaagtcaaaaggacggattcttggaactcatcgtcctcgtcatcgtcttcttcatcatcctcactttcactttcagccttcttgcctttactcttctttttcttttgggttttttcctcttcttcttcctcagaggattcttcgtctatttcgtcttcatcaaaatcaccacctaaaaaatcatcatcttcaaagtccgggtttcttttgataattcttaaagtcgatggtttgttctcttcatcgatggcttccgggttcaaagcagccatagtaatacgaacggtgatgggcatcgtgacgtcgattgctggaaccggggtataaggttcaacattcaaactgtaggtagctagtggtaacaaatcagacatattgggctggttggatgcttgctttcaattatgtatgaactttcacacaattatgtattatatagaaacgtgttagtaggctcttttttcgaatttaaaaattttaccttcacttttaaattttgccgtcctttaggaatgacgacagtccgtagagggctgaaaattgaacagcgagctaatactagtggattctaatcaatggaacatgaagcatgtatcataatctctgttcttgccggttttgactatatagatgtagatgcaatccagattttagtgaaaggtagaggaagcaagccagttgaaaaaggtagaaagtatgcgatgtgtcatatacatttggcatattctccccataatatcatgaacaggtgatagtagaatgtttggagcattgatgacagattatttccaaaagaagtttgattgtgcgatcgctctcttttatgttctttgatgcatttttgtacaatatattaaagtaacaaatcggcgaaagaacgtcagtaatgtgtcgttgccaaccgtaaagtgctcgatgattaatttcacaatacatttcaaccaaagtgttttcattcaaatactggcacaaaggtttgtttttctaagtgcctatggtgtgcgataaaatgtttttgatggaacacagttcattgctcagaaaatacgccatttatctatttgtgtcgttcttccttccaagaattacaagaattttattttttattcaatgctcaatcgtctgctcaaggacttctggtaagttacgttaaataatagctatggcgcttttctcatttctataatgcagagttggtggctataaccgtattatcgatgttattaccgttcgaatatatgtaagcttaacattgccgcattagttttgcttgaagatgctctgtccatattttgttaacccgtcttagaattgatcattgcttgctttaaataatgaagatcttttgacgaagccaatgactatgctgtcttcaacttttggcagtaaagccaattctgtgagaactcgcggggaaactccaaagcacacttagagaataaaaatacatggagtcgaagcatgactcggatgatttctaacgtcctgacatttactcgaaagtatttcactaccagtggggtaaaggacaatatcgacgtccgttggctatgttggtaactgagatgaagttgtaacaaattcctgcaggatgcttttacactcaccggttgcattttcctcatttcatagataacaaagtaaacagagcgcattttttggagtattttatacgtcaatgcgactttgatacctgaaatccccttaatattggtaggaacattgggctcaagcgatgcattttctcttgcattttgtttctcactatttgtcttttctactttcaattttcttatctttgttctattcccgttcctgttctattcccgttttatttgctgtgagcaggccttgttattgccaacgtttaaaaccatttactttttgtttaaaaatctctcttctatttccacatctcacctaaaacaacgatcattatataacatgaggtgtattgtttttcctcaccatacgatcaaatataacatcacaaagcttacagcagagcgacacttttttgcttaacaatttgtattttgtatgatgcatccaagtcttgcgccaagaaagtctacattataggaaagatcaaaggaacttgaaataatgtattcctttttcttttcacgccctttctctgggtgattgccgcaatgaagatataaatatgcgaataaaaaaccaatgctcaatacaaatgcacttatgaaactgtagttaaattataattttacctgcatatatattattatagaagttcgttaaaataattatatttaaaatttcaacatgtgtggcttgtcaccgttcttcaaagagaaagaagcagacaagtattgcttcaataatggagtcttcttgatttcagcaatcaaagccttgtcgacaaccttttggtcttcaacacgttcagccttgatttccttgttttgttgttctgggaacaagttagcttccttcttttccttcttagtcaatttttccttagcaaagtattcgacattgaatttttcaacgttgacaccttcgacagaaaccttagtagaggtagcaatgacgtaacgagcattgactcttctcaaaggaacaccattgaccttgaatggaccagaaatcaacaaagtgttgtcttctagatgcttcaagtaaacaactctcttacctctgaaacgaccagctagtaagatcaagacggtacctggaactagagaggcacgcaacttttgtgggcgagcagcctttctggtcttctttagagcagcgacgtcttcggatggataccactttggagcctaaatggaaaaaagaaatatcaaacgactaatgttagtattcttgatttgcgaatggtgataaatttttatagggagagattatgcctagcgatttgaaactgtaacgtgggcctttgtttggaaactaaataatcatgagctagggtcgatataccttattgctttgctcaccttctcactcatagtattaacattgtgttgaaaggtatactgccttaatcatttatcctcactgtacactgtataacgtcatttatcagttttcattgtattattttgttcgacgtcctgatcttattgtttcttgtatggatatgtctgagattgatggcatcatatcaaatttcaaaacttatgccttcgtgaatgtaaattgacatctccccctcgaaattaacatgtaggaacatactttttgggcactcatttcgttggatggctattactttgttgtttcgcctaatgtaaaactgatattcaatctttaatgagtagtacatttaatctattcatgtaacccttccattcgataacctccataccaacgaaattttgcaaaaggaacaaagcacactccagtgggaaactggacaaatccggtgagtcctcccagacgggaaacgtgtctctcgcttctgttgtccgcccagcggagaagccctctccagaacgctttagccgcaaccgcaatggtctaggcgggccgcttttcgaatctggttaaggaaaaaactgaagaaaaatataacaaatccatacattttaataatgtacggatttaatagcagtcttcacatttctttcttctccctaagcagtaacaggagagcgttgaaatatgttgtaatatatgttgtaatatattatagtaaatataacgttatataataatagcgcaaaattataacaaacacagaaaagacacctgttaacacaccaaatgtgcccttattgagcgtataaaagaatagttttcactgtttattactgcgtgtattcttgaggaacttctggcacgggaggtacctgaccattcttgtctttaccgtaattaatctttacaatcagatgaccgtctcctaattttacagaaatttggccatcttgttgaatttgagggtcacccaagttgatttgagcaataccaagatctttgtccctcgatagtctttgatgggaaattgcacccagtaccaaattggcttcgggagaagccttgaacgagcactcttcatcaaatacggcaacaccatcattattggctttttggcttttcgttttgtatatgtgttttagtctaccaccttgagttaaagagatcttaatttgaacatgcttggcaacgttttccgcagcaaccacggtaataaaaccattgtaagtgccatgaggagctaaagtacgcgcaaaactgcttgcacgagaatgtcctctagagttgctactaggggtatcttttttgttgcttgagctagaagtgttgtcagttggcttgactacaggagatgcgctttgaacgggcgcgtaacttgtgttaggtactgatggatcatagtctagtgaagctcttggtgttacactagtgctattcaaattacttggggatctcctatcaaaagattttttctctgatgatttttttgcaccgttggactcatttccattgctgctcttgcttcttttcattggattgccacctagagattttagaaggtgaccacctttctttaaaccaccagtggcaactcctgttgctgctcctataccagtaccagctatgccaacagttgcatgggctgcaccactggctattttcatcggcttatcagtgataccgcctttcacgatatcaaaacttggcttgatatattctgggttgaatgaaccttgtaatttgatacttccttgtgtgtttaaattcaaattccagttgtaagttttaccaacttctaatgaggaaacgtcaagtgaagcttggcctaagtcgtcattatcacctgcacgatcccaatcaagaacattaaatatgacttgattcttacttcttgaaaggattggtattttagcatcttcgttccatacgggatccaatgttttctttttaatgttcgatttgaaaacttttttatcattgacaaagatgtgaacaaatggatctgaatagccattcctatctgcggacttcagaccgtgtccggaaataagctttatattcaaataaccagtgtcttcaacactttcactgctaggcagtttcacgctagtgggcgtgtacaaaaatcttaccttcattttagacccattgaagtttaaccacatgggctcttcgtaagcttgctttagtagcttcaatgtactataggaagtttcggatatgacatcatctgaatctttggcaatatgtttcttcgatactctaaaatgtagtttactgtaattcaaatctctaatgaaaatatttgccatctccgagtttagtttaccttgagatggtttcatgcaaatgaatacagggtacgaaatgtcatccgctaagatttctaggtaagcagaggatgggctcaaagtcccttccaatatttgcatagacaaaataccagatttttgcttgatcaactcgtttaaagataacttggccttcctgtttatttttttttcatcgctgtcaaatgggtcttcgatctcggcaacttcccattcctttggatttttttccatctcttgctcgttttcttcttgggtagcttcgaattttttcttcttttccttcaactccttttctagtttctcaacattcaccaactcctcaggggaatacaccagattgattgggataaatgttgttgaaacattgacaatgctttcggtaactttgtgttcgtggtcttttaattttagttttgaaatttcttctttgccattattcccaacatattttcctgatttaggatcttttttgaaaacatttgatgtaggaatttgtacagagccaatgaaacggtctttgccgatcttttgataatcatgaaattcgagagtcaaaatttgatttggagagaagataggaacgtaggtgctgttgtcaaaaatgggatgatccgtatcagaatgatatatggacttgtaaagaacacgtctattcaacgatacggtgtaatatggatcaacatcccctacaccggataagtcacccttgataatggcatccttaacgtctagcttaatacaaccaataggttcgcttacagagtttgcagcggcaaaagctccggtcatttcaattgatttccaagaaacatccaaataaatgtcaccttgtggtgagcctttaacaaactcttgagcagtgtctaaagtagtcattatatcatctaaagaagatgaatactcacagatcagcgccttaccattcattctgtcatcgaatatttttaggacaaacttagagttagattttgatggaaccaaaacttcgatggtctcattccaagatggctcattgatacgtctcaaagttctatagctctttactttttgtccatcaatgaataattcagcacatgggctcaagctaccggtcatagaactggttgtatccagatatttgaccttttgtaaagtgatcttggcaatcccgacatcagtttgagaactttcttcattctcgtcttcttctttttcagtagtgtcctcgttttcatcttctttcttgcccttggccttagcttcggcacgctcaactgctttttcctctgatttatcttctttcacagggaaccagtgtaaggaataatgtaaaataccttttgattttgtaccggatcttaattcagcagtttgattatccaaaacagggttttgtagtaaatctgccaagtcaagttgaagatcaccaattacggtatcttttcttacatcattgaagtcaaagcactttaagtttaacttttgctctaaggtgtttaataatagatatttggtttcgttccaacgtggatttttaacatttgatttgatagatgtacgcacttcttcatctgtaccaggcacagcatcttcggtagtcataacaatataaggatcgacagtattggtaatgaaatctgagcctttcaaagagtcggcagaagcaatggttacggcaaggacaccaatagcttcttttgattgagcagccataatgtcttcaacattaatatccaaatggttcggagggaatagcataggccctatattggagttgataatgtttttaacaaaactcttcaaaccaggcaagaatgacataacatcaagacctaaagtatcaccaccaattggtttcagtgcgaaatcaatcaaaggtggttctaaaagttgtaaagaaacaattttgatatttgggaaagctttaccaaattcaactttaatacgcattttaccagcaacgttaatgtcttcaaccaaaataggcattgttttagagacaaaactttttcctaacgtgacacccagagatatttttggattgatcttctccctagcttcagtagctgtcatatccgagacatcgcttggggtgaatgcaaatgaccaatccatttcaacagtgtttttaccagtcttggtgtacgatttaataccttttatggtgggagctttagagcccagagtgaattcatcgatagctaacgcatcgataccgtaacctggagcaacacctgccagttgagggttaacgttatctttgacttgttgagataaaactggcatgtaaatcacccaaaattttgataaaaatgaattcaaccacgtagtggattcaacgcgatccgacaaggtttcttcgactgtaactcttttcaagtcatctctgatatttctgttgaatcttgtatattctgcgttgtaaacggtcgcagttcccaagaagataaatatcatagaccaccatgaaaacccaatgtaagcaaataaccatgagaagaaacaagttccaagaacggtggctatattacagtaccaatcgttataaaaattttccagaatgtaagcttttataaccctggacatctttgtatttggcgaaccctttcctgaagcatggaactcaccaacattttgccatggaaataacttgtcgtcggaatctaggtgaaatttttccttaatatccttttcatcaagtttgcctaagtcgtctaagacgccaggcttagtaatcgaagtgtcgaatttatttggcttcctagatggtgctgatctgaattccttcggacgtaaaccttccaatggcacggctcctatgcttccctgtgggttgggaccgggcaattgattggttttttgagcgctggaggcaacaaatatgtcttttgatgactgtttcttaccttccgggttggagtcagcagttttctgacctttagacacatcagaaactgaatttgaggtctttgtgtcatttgcgtcatggttaatcagttggtggtattgatggtgacccgatggagcgtgatcagaacccctttcttgttgatttatgaccttttgaggtaaattgcctcctactttcttcttctcctcctcatgaaatagggtactatcaggtgggggatggacttgagctttgatgccagtcatttttcttgactttcaatgcgtagctctacttattttctttctagcaatattgcgtatgtcaataaacaaagctagctaatgatgctctttatattgttaagaagaaaactgattaaattaagtaacgctaaaaagcaaagttgtctatcaaagtgaaatgtatcgcaattggaaaaggtaagtgcaattctaaaggatgtaaggtacaattatccctttttccctttctgactgcagcagtgtgttgtaaaggtatacatacattctcgtattgttgtttctcccccttctcgcgctggcgaagaagtgaaaaaaaaaaataaaaaaatggaaatttcggacgatcgtcattttgaaaatacatagtgagccaatattatactaggagtatatatatttagaggccagttctgctctcttgtcaattgcccgggcgagctgctcggtcgtaaacaagctagtgtcattgattttttttaggaagaggtggtggtagtttcgattcaggtcgcaaagacggaatgaacagtacaccaactgcaggcaaacggagtcactcagcttgatgctatttaacccacgagtgaggtcttttaatacgtatgttatgcacttatcaacgaattgcaacatgactgcatttgtaggtattttgttttccctttttgaagtccgaatctttttgcttggctcctctggggtcacttcaaccttattaatttcttcttcttctttttctgccttgttatctatgcttttgcttggctcttctggggtcacctcaaccttattaatttcttcttcctctttttctgccttgttatctttggtatttacttcttcctctttttctttttcagccttgtcttctgttttgtttactgtttcattttctatctcattttctgttttcctttctgctccatcatcttcgccttccactttgccttgtacttcctcttgtacatcttctatcgatttattttctgtcacatcttcttcattgttcgctacgctatcttgtttttgatattcttccttctttgtttctttctccttttcttcaatttctttctcttcgttagtcccatttatccttagcacagtactttctagttcctctgggaaaggaatctctaagtcatttgtatcatacaagaagcttttcagaaagacattcaaggacatgtagacatgttccctgaggacttcaattttcctcttaaccatcatttcaattaaagattcattagaagactcaacgtccaaaggatatgatgctatttcatcggtaatgaatttgtatctcatggctaaaaacacacttaataatgatttattagtctttccatcaaatggtggaattgaattcaagtactgtagtattttctttagtgagtttactgatacattagtagacagtaattttaccagcccggataacatggtagtactaatttcgtttaaaactttttcgcaaacttcatccacaatggttgaaccagggaatcttgacctcagggaagtagtgtgtgtgtatagcatgacggcctcctggtaatgacctgttctgatacatgtgcgggccaaaaatggtagttccatcaaatccgtaatgctatccaaattttctagtacagtgactaatgtgtcagatctaatgtcgtccttgtcatcttctttagttgaaattctgtttcttaacctacttaatgccttgtgaaactcatcctccttcttctttcttgccagattgttactctcagtcgtcatgatgcgacctgtgtcgttgtcttctttatcgtcttccaaaaagtcatcaatagaaacgctttcattgtttatatcgtcatttgtaacgtttcgatcggctgccttattaatattagtatccaattcccataattgctccaaagacttggctatatcatccaattgagccctatcatcgttttcaagaatatttccgataatctgagacgtattatctagtagtgttttccttatctttctatcaagggcagataattcagcatcaatttctgctatgtcttcagttatgctaccaggaacagccctagatgaaaaataactttcatagtctttcgtgttagattgtaggatatcctgtaggaaatcaagacttaaccgtttttgttcctctgttaaatcatcagaaatgaggctgtttagtatcagctccattttactcaatgattatgtttattgttgaaatatgttccctcaaatgtcctaacacttctatgattattttttctgtgcttctcttttcagtatgttactacgctatatttttagacattgaagccatgatcgcgagatcgatctaatgtacgtataaaaagaaaatggacttcaagagtacaactaactaaaggaaaatccaactcttcctataaatttagaattagcatattcaaaaaagaagaaacaaagcactcacgatgggggtcgaacccataatcttctgattagaagtcagacgcgttgccattacgccacgcgagctaaatttcttgaattgttgggtaaacaaatattactaatacaaatgttattagaaaccaaaaatgcacttttccggggttaatatatatgattgagtgatggatgaagaatgagataattgtttaaattctatagttgtcaagcgctgtgataccagatacacaaaatgtactagaggttctcctcgagaatatgaaaatccacaatagagaaccgatatttctgtgtaggaatattattatttcttctttcattttgtatgttctcgttcattttcctagcacattatcaaccctttcatttcaatttccattaaaattggtgactgtttctcaatatttatttgaccgtcttatacccaatatggtaatataccagtaatataaatactagtcgttagatgatagttgcttcttattccgaaaatgagtatggaagtgttgcatatgatagggcggctacagtgatggtaaacataagatactttagcgggaaattagcaactggaagttaaattatctagacataagtgtggcggtcacgctgaacgcaggagatcggatagattgataagctgatcaagaacattgatcggtttgttgtttaaagaatggtttttgaaaacgtttgaccagttgcttctcccagacgcttaccgatatgatgataaagataatatcttcaattgaataccccgtggatcagcacgaataacagaaaaaaagggtgaaattcaccgtaagcatgatacgcactacgttcttcttacctttgccaacgtgttgtctttgacgtacgtaattatgggagatcgttgatgattagccccagctcactttcttcttaatgactgacccgctactatcaaaattaaggtgtcaaatatcatgatgaatgaggtctctaggcgactcaattatacatcttttagagatttttttactacttgcagataatttctcaagggattagattcaaatctggcttgtcaattacgcccttttcaagctcatcaaattgcgtatgtcattcatgcttccattaggaaccatagaagcatggctgaaatggcaatatacggcttcccaatttcaactctaaagtaatggcggtcgaatttaatctatattttacagttttatacgtactttaaaagcaatcagtaaacacctctggtgctattcaagggttttttgcctttatttgttactgtcaattgtctggcgctgtgataaaaaacaaggcataaagctcccccgtcatgaacattaagactcgctagacgagagagtgaaatataatgcatttcctgatttaaatgcgctacaaacatggtgtaaatctggcccggagtgagtgcttgccaatttggcttctaagggagaaagatcaaaccactcccaattgcgtcattttgaaagagtggccacctcgcgagcgtctgtcgaactaactgatgaataaatatataaggagaaaatcacttcaacttcgctacaagtagtcactatttgtagcaactgtaaacgaacacatcaaagaataagattacattctatatctaagactaaattttaaatgtccgctaaatcgtttgaagtcacagatccagtcaattcaagtctcaaagggtttgcccttgctaacccctccattacgctggtccctgaagaaaaaattctcttcagaaagaccgattccgacaagatcgcattaatttctggtggtggtagtggacatgaacctacacacgccggtttcattggtaagggtatgttgagtggcgccgtggttggcgaaatttttgcatccccttcaacaaaacagattttaaatgcaatccgtttagtcaatgaaaatgcgtctggcgttttattgattgtgaagaactacacaggtgatgttttgcattttggtctgtccgctgagagagcaagagccttgggtattaactgccgcgttgctgtcataggtgatgatgttgcagttggcagagaaaagggtggtatggttggtagaagagcattggcaggtaccgttttggttcataagattgtaggtgccttcgcagaagaatattctagtaagtatggcttagacggtacagctaaagtggctaaaattatcaacgacaatttggtgaccattggatcttctttagaccattgtaaagttcctggcaggaaattcgaaagtgaattaaacgaaaaacaaatggaattgggtatgggtattcataacgaacctggtgtgaaagttttagaccctattccttctaccgaagacttgatctccaagtatatgctaccaaaactattggatccaaacgataaggatagagcttttgtaaagtttgatgaagatgatgaagttgtcttgttagttaacaatctcggcggtgtttctaattttgttattagttctatcacttccaaaactacggatttcttaaaggaaaattacaacataaccccggttcaaacaattgctggcacattgatgacctccttcaatggtaatgggttcagtatcacattactaaacgccactaaggctacaaaggctttgcaatctgattttgaggagatcaaatcagtactagacttgttgaacgcatttacgaacgcaccgggctggccaattgcagattttgaaaagacttctgccccatctgttaacgatgacttgttacataatgaagtaacagcaaaggccgtcggtacctatgactttgacaagtttgctgagtggatgaagagtggtgctgaacaagttatcaagagcgaaccgcacattacggaactagacaatcaagttggtgatggtgattgtggttacactttagtggcaggagttaaaggcatcaccgaaaaccttgacaagctgtcgaaggactcattatctcaggcggttgcccaaatttcagatttcattgaaggctcaatgggaggtacttctggtggtttatattctattcttttgtcgggtttttcacacggattaattcaggtttgtaaatcaaaggatgaacccgtcactaaggaaattgtggctaagtcactcggaattgcattggatactttatacaaatatacaaaggcaaggaagggatcatccaccatgattgatgctttagaaccattcgttaaagaatttactgcatctaaggatttcaataaggcggtaaaagctgcagaggaaggtgctaaatccactgctacattcgaggccaaatttggcagagcttcgtatgtcggcgattcatctcaagtagaagatcctggtgcagtaggcctatgtgagtttttgaagggggttcaaagcgccttgtaagtacttggctcacgaatacatatcaagatacttatgatatatatatatagaaaaagcttacttttcttggagttattgttattatcatcgcgaagaacgattgtataacccggttcaacgcgaaacgaatcgttaaactggtgaaatgttaacgcgagtgtcagagatatacatagtatgagagtagctagatgttgaatcggtggtaagaacaagaaggaaataccgttaacaagtgaaggaacaatctagtattgttgaacaagaattatgagtaccgactttgatagaatttacttgaaccaatctaaatttagcggtagattccgtattgctgattctgggttagggtggaaaattagtaccagtggtggctctgcagcaaatcaggcaagaaaaccatttttattaccagccacagaattatctaccgtccaatggagtaggggctgcaggggttacgacttgaagataaataccaaaaatcaaggtgttatccaactagatggattttctcaggatgactataacttaatcaagaatgatttccatcgccgttttaatattcaggtagagcaaagagaacattccttacgtggttggaactggggtaagacagaccttgccaggaatgaaatggtttttgctttaaatggtaaaccaacttttgaaattccttatgctagaataaataatacaaatttgacctctaaaaatgaagtaggaatagaatttaatattcaagatgaagagtaccaaccagccggtgacgaattggtagagatgaggttctatattcctggtgttattcaaacaaacgtcgatgaaaacatgaccaaaaaggaagagtcaagcaacgaggtcgtaccaaagaaagaagatggtgctgaaggagaagatgtacaaatggcagtagaggaaaagagtatggcagaagcattctatgaagaactaaaggaaaaggcagacatcggggaagtcgctggtgatgcaatagtttccttccaagacgtcttttttaccacgccaagaggtcgttatgatatcgatatttacaagaactccattagactcaggggtaagacctatgaatacaaattgcaacatcgtcaaatacaaagaattgtttcgttaccaaaggcagatgatatccatcacttattggttttggcaattgaacctcctttacgtcaaggacagaccacctacccctttcttgtcttacaatttcagaaagatgaggaaacagaagtgcaattgaatctagaagatgaagattatgaggaaaattataaggataaattgaaaaaacaatatgatgctaaaactcatatagttttaagtcatgtattaaaaggtctgactgaccgtagagtcattgttcctggagaatataaatccaaatatgatcagtgtgcagtttcatgttctttcaaagcaaacgaaggttatttgtatccattagataacgctttcttctttttaactaagccaactttgtacataccattcagtgatgttagcatggtaaacatttcaagagcaggacaaacttctacgtcatcgaggacgtttgatttggaagtggtactgcgttcaaatagaggttctaccacttttgccaacatcagtaaggaagagcagcaattattggaacaattcctaaagtctaaaaacctaagggtgaagaatgaagatagagaggtacaagaaaggttacaaaccgctttaggttcagacagtgacgaagaggatattaatatgggttccgctggtgaagatgatgaatcagtagatgaggattttcaggtcagctctgataatgacgcagacgaagttgcagaagagtttgattcagatgcggctttaagtgatgctgaggggggtagcgacgaagaaaggccttcgaagaagcctaaggtagaatagtaataattttagactgtataagttaaatttattgatattgtgtaaaaactaactaatatattttgccaattgatattatcatgacatggtgagtgtaagacaccacctcttaattactggtgttattctatacatttatttgaaattggttttgttttgcaaaatatttatgttttgttaatctcctctaccctttcaatgcttgaaaaatactttcaacttttcgattgggtgatgaaaaaaagacaaatagtgtaaagggttcaaaaataaataacaagcaagagaaagggactttgcttttctcatttagtcaccagtaagttatgtcatggtgtagaataacgaattacagaaaactaatataactgatgaaagaccagggagtaaaatggctttgactcagtttgaaaatgatttggaaatattaagagatatgtacccagaactggaaatgaaatcggtaaaagtagaggaggaaggtgaattccctcaaagaattaacggaaagttactgttcaagatatcactattggccgatgtaaatattgagttcggcgagcaacatatgttactttcaaacttatctaatgaatgcgtggagttcaccatatatagctgtcattatccggacattcgacggtgtgttgttatggatatcaaatccttatggatatcaacagatgaaaagaagatgttaattgacaaagcgctgagactcgttgaagaaactgtagatatgagtattgagttcgcggattcgtttacctccatccttatcctcatctttgggtttcttatagatgatacagctatattactattccctaatggaataagaaagtgcctgacacaggatcagtatgacttgtttaagcagataagtgaggaagccaccctccaaaaagtgagcagatctaactaccattgttgtatttgtatggaaatggaaaagggtgttagaatgatcaaattgccatgtgaaaatgcgaatgtagaacactatctttgcagaggatgcgccaaatcttatttcactgcaatgattcaggaaaaccgaatatccagtgtaagatgtccacaatgcgaatacaaagaattaaaactagaagatttcaagagctataaaaaaatgctgaaggcattgtttacacctttgattccagtgtccttcttaaaagaggttatcgatacagagctatgtgaaagatacgaaaaaatgttctacaaccaggcggctacaagactctcaaaatattgtccgtatgcttgtgtgacttgtcgaagatgtgatagttggtgcacaaaagaagacctcgatgatgcgatgattcagtgtcaaaaatgtcattttgtattttgctttgactgcttgcatgcctggcatggttacaacaataaatgtggcaagaaagtttcgttatcgaccgatattattgaggaatatctagatgataccgttacttcatatgagagaaagcggaaactggaggcaaaatatgggagaagagtattagaacttgaagtcaatgattaccttgctgaaaaaatgttagatttagcgattaaaaaagagggttcgaatttgcagcgatgtccaaagtgtaaggtagttgtagaaagaagtgaaggttgcaataaaatgaaatgcgaagtatgcgggacgctgttctgttttatatgcggagtattactttatcctgaggacccttatgaacattttagagaagcatattcaggctgttatggacgattgtttgaaggtatgcctggcacagaaacttgagtgcgatcgctctgccttcagtctcacactttttcttataatctattgtcatgaaatttatacagatgaaaatgaaacgttatcttgggtatactgcattctcttttcttttacatatctacctatctaaaatacccttagttttatcatctggctgataacgcaaggaccacttaggtcccatgatggtgataagagccatatccagtagtgtgaaaatccacgaagcacagtagaccaaaaatgagcagattgccactaatctgaccaaaaactgtataaagcttaaacgaacatcagaaactactatggataatggttcgaaattgtatttgaagaagatgcccggcattttatcacctttagcagcgacatctttgtacaaatagcggtaatcgttaacagaatattgattagtatccacttctgcccccaatttcttgaaaagagtgggcacaacagatgtgtaatagacgtaagtagttaaaggttcatcctgattaaactgtgcagtgttatccaatgggttatcaatatatggatagaaatcaccaaaagagaactcattaataacatgattaaattttaattcttccagtggtgctttgcgtgaagccacgtaacctaaactcttcgctgtaatctgcaattcgccactaactctatttaccggaatggacccaaatacatggcacccattgaattccggaagatgtgccttgttaggatcactttcatcaaaaaatgacctagtatctagtttttctctaaattctgctgggatagcttcccctaagatttcatccaattccggcgtaataatttcattgatatcattgacttttgtgtcataaggaataaagaatggcatctcttccaattgcaattcctctaatacaagtttccgatccattgtttggtctctgacgttgatttgcaaccaatcacatttcgtgttgacgtatatatccatattaatttgaacggtatctctaacttgactgtccactacgtactgctggtcaatataaccaccgaagtattcaccaaactcggtccatgctataaacaacagaaacagatatgtcaacaaagatgttaagccacccttggtggatttcttcttgtactgttcttcagtttttgctgtaaagttaaatttccattgttagtgaaaaagcaaaagcaaaaataaaatatgctgaagcgggctacttcagaaaaatccatataacatacgaaacgcatcaaatgtcttcaatcctgccattatatactcctgaagtctctgcctgtacgttacagcaaaagcattttggaggaacgcttttctcagtaagaatagaacattgataatatcttttcaaagccttgaccgagcgggaaaaaaggacgttatgcaaaaatacttaatatactgaaaggctgtgtatatgtttacatatttactgtcatttgaaaaaaaagttctgtggtgaattacttctccatcaagtctggagaaggggagttagatgtgtcttctgtatacttatcagactttttgggcttagctttgtaatgatttgctgcaagaaatgcgagtaccaataggacccactggatggcatacctggcgagccccataatgaacccacttcccacgtttacttttaacagttcccagcctgtagtgtgtacagcagcgttgtcagatcctacgtctgttacctcttcaggttctaatgttttcagtgcaatcaaatatacgatgttacataatattgtcaatgtagcaataacaactaatattgaacttgatgacttcaaaagcataggaaataagcggtgtcgtttcccaacactaagtgctcccccaaaggctgacactacgcagatactgaggaatccgactattatttccaacactgcaaagtaaaaaaccatgccgttgaacatcatcagtataaatgccaggttgacgcctttcagatagttttttgttggtgacacgccttttacatttggatcaggactgccaatcaaagcctttgatagggcatttcctgtgtgcttgtcgtgtttcaaaaaatcacgaatagatgtcaatgccaaacggtaggtcaatacgagagagtctccgaattttttggtttcattcgatcgtgtagtggaaatgttacctaattgaatcccgacgtctctgacaagtacttcaagtacgtccatgccataattctcattagaggtacaataaactttgcttttattactccgtttacaaaatccaaaataattgagctcaaaaaccttatcaggctgaaatgtgtccaccaaattttcatcctcatacacacttggatcagtgaattcattcgaccaacccatgtcaattgtcaggtacgaaatcaatcgcagaaattctcttacacttgcaataaactcatttgcagtactggatcctccaatcacagttatagtaaactgtggagcgcataacctaagtcccttagagttcgtacatgttgtggctggcaggtagaggacaaattgtgataaacttaaaatcaatagaacaccccacacaatcagacgtttagggaataacatgctcgcccttttatattatgacagaaagaatatatatattcatatataacatgcttctatttattagttttatcttttaattgatggatgtgtccatagaatttaagtaagtgcatggtatggagtgtataatggtttataatttcccctaagatgacacaaaaaaatgttctcccaaaaatttaccaagaaaaaaaattaagaatactacacaattgatgcttgggttattttaaatatccggtacattctattacaaatatgtttgtacaatgtaagccccttcataatggtcagtattaagataaggactgctatggggcattttttgtcttactgggtatcacaggataataacttggcgccaaattagaaaagatataaacctcaaatatttgaaattctttggtgacctgtctcatcgttatatcaacaaatattgcaccaacgaacaccactacatatgtaactactctcttcctcgacttattttttattaacgttgacacggccagatcgaaaatcatagaaaaacaacaacattgagaagagatgaagttgcgcaaagggaaagaaaactgcataggcggcaaattcagcctaaaagtttccagaagcaggaactcattccctattgattaatactcattacaaaaaccacaatagagtagataagatggcaaaaacgttgaaggatttacagggttgggagataataacaactgatgagcagggaaatataatcgatggaggtcagaagagattacgccgaagaggtgcaaaaactgaacattacttaaagagaagttctgatggaattaaactaggtcgtggtgatagtgtagtcatgcacaacgaagccgctgggacttactccgtttatatgatccaggagttgagacttaatacattaaataatgttgtcgaactctgggctctcacctatttacgatggtttgaagtcaatcctttagctcattataggcagtttaatcctgacgctaacattttgaatcgtcctttaaattattacaataaactgttttctgaaactgcaaataaaaatgaactgtatctcactgcagaattagccgaattgcagctatttaactttatcagggttgccaacgtaatggatggaagcaaatgggaagtattgaaaggaaatgtcgatccagaaagagactttacagttcgttatatttgtgagccgactggggagaaatttgtggacattaatattgaggatgtcaaagcttacataaagaaagtggagccaagggaagcccaggaatatttgaaagatttaacacttccatcaaagaagaaagagatcaaaagaggtcctcaaaagaaagataaggctactcaaacggcacaaatttcagacgcagaaacaagagctacagatataacggataatgaggacggtaatgaagatgaatcatctgattatgaaagtccgtcagatatcgacgttagcgaggatatggacagcggtgaaatatccgcagatgagcttgaggaagaagaagacgaagaagaagacgaagacgaagaagagaaagaagctaggcatacaaattcaccaaggaaaagaggccgtaagataaaactaggtaaagatgatattgacgcttctgtacaacctccccccaaaaaaagaggtcgtaaacctaaagatcctagtaaaccgcgtcagatgctattgatatcttcatgccgtgcaaataatactcctgtgattaggaaatttacaaaaaagaatgttgctagggcgaaaaagaaatataccccgttttcgaaaagatttaaatctatagctgcaataccagatttaacttcattacctgaattttacggaaattcttcggaattgatggcatcaaggtttgaaaacaaattaaaaacaacccaaaagcatcagattgtagaaacaattttttctaaagtcaaaaaacagttgaactcttcgtatgtcaaagaagaaatattgaagtctgcaaatttccaagattatttaccggctagggagaatgaattcgcctcaatttatttaagtgcatatagtgccattgagtccgactccgctactactatatacgtggctggtacgcctggtgtagggaaaactttaaccgtaagggaagtcgtaaaggaactactatcgtcttctgcacaacgagaaataccagactttctttatgtggaaataaatggattgaaaatggtaaaacccacagactgttacgaaactttatggaacaaagtgtcaggagaaaggttaacatgggcagcttcaatggagtcactagagttttactttaaaagagttccaaaaaataagaagaaaaccattgtagtcttgttggacgaactcgatgccatggtaacgaaatctcaagatattatgtacaattttttcaattggactacttacgaaaatgccaaacttattgtcattgcagtagccaatacaatggacttaccagaacgtcagctaggcaataagattacttcaagaattgggtttaccagaattatgttcactgggtatacgcacgaagagctaaaaaatatcattgatttaagactgaaggggttgaacgactcatttttctatgttgatacaaaaactggcaatgctattttgattgatgcggctggaaacgacactacagttaagcaaacgttgcctgaagacgtgaggaaagttcgcttaagaatgagtgctgatgccattgaaatagcttcgagaaaagtagcaagtgttagtggtgatgcaagaagagcattgaaggtttgtaaaagagcagctgaaattgctgaaaaacactatatggctaagcatggttatggatatgatggaaagacggttattgaagatgaaaatgaggagcaaatatacgatgatgaagacaaggatcttattgaaagtaacaaagccaaagacgataatgatgacgatgatgacaatgatggggtacaaacagttcacatcacgcacgttatgaaagccttaaacgaaactttaaattctcatgtaattacgtttatgacgcgactttcatttacagcaaaactgtttatttatgcattattaaacttgatgaaaaagaacggatctcaagagcaagaactgggcgatattgtcgatgaaatcaagttacttattgaagtaaatggcagtaataagtttgtcatggagatagccaaaacattgttccaacagggaagtgataatatttctgaacaattgagaattatatcatgggatttcgttctcaatcagttacttgacgcgggaatattgtttaaacaaactatgaagaacgatagaatatgttgtgtcaagctaaatatatcagtagaagaagccaaaagagccatgaatgaggatgagacattgagaaatttatagattcggtttttattattcatgacctagcatacacatacatatacctacatagtagcgcatttatccaaaacatacgatattgtggatgtacataccttctatatctccttaaagctattgtgtagcttgatttaaaatatgctaacgccaactctcacatggtagcaggcgggtatagttgttttcatgtattaacgcccggcgatggtgccttagatgagggcgacgaggagggcttcctgatattatggctctttctatcctgacttttgttatgatgtcgatgttgctggccacctaggtgcttatatatcaaaagaggatcgccgatttcattgatttctgggatggttaatgtcaaattaaagatctttgccagtgcaattttgaaaattttttgaatgtttatagatttggcagtagagcagaatataagaggagcattcatgacctgtgcatacttcatactcgttctcgagatttgttcctgatattccgggtctaagtctattagtaaatcgtactttgtgcccaccaaaataggaattgccgaatcatttagcccgtacgcctgcctataccactcctttattgaactcaacgtctctggacgtgtcaggtcaaacagaaatatgatcactgaagaccctaccgtcgcaattgggagcatgttgatgaattctctttgtccgcctaaatccattatagaaaatataatatccgtggagcgtatgcttacttttcttttcaaaaagttcactcccagcgtctgtgtgtattccttatcgtatatgttctgtacgtacttcaccatcagcgatgttttccctacttgtgcatcccctactaatccaacctgaacttcaacctgatttcgtaccgcaggtatagaattgtttgctcccgtgcttggtgtagccatcttagcttaactcaatttaatttctacagcaaaatccaaacgtaatatctatatttttctcgaaaaactgaggacaagagccaatcaatcatctataatccaatttatattattttttcccttctgggttcttttcttccttttcttgtttaccttttttgctttttcataaaataatttctctagatttgaagacagcatttttgtacatccatacaccatacaccatacaccatagcaccagtacactatatttttatgaattttactaagaattattcctgcaggagctccactgaaaaaaaaagagcagcatggatgtccggtagaagtgctactgagtaaatgggaaggacgcggtagatccagtgtggaatcaaggtggtgccggtgtgaagccgcctcggccggctggactctccaggccggagtgatgattgccacgctgaacgtaacacagtttcacaataccagtgtcctcattagtgagttccaatgtatagttagtagtggtattttgatatatgtgagtggtagcagatttgaacttagttagttgtattcgcctttgaggaaaccaagcaaaaaaccgatctagactaatcatggctgttggtaagaataagagactatccagaggtaagaagggtttgaagaagaaggtcgttgacccatttaccagaaaggaatggttcgatattaaagccccatccacttttgaaaacagaaatgttggtaagactttagttaacaagtccactggtttgaagaatgcttccgatgctttgaagggtagagttgtcgaagtttgtttggctgacttgcaaggttctgaagaccattctttcagaaaggtcaagttgagagtcgatgaagttcaaggtaagaacttgttgaccaacttccacggtatggacttcactaccgacaaattgagatcaatggtcagaaaatggcaaactttgatcgaagctaatgttaccgttaagacttccgatgattacgttttgagaatctttgctattgccttcaccagaaagcaagctaaccaagttaagagacactcttacgctcaatcttcccacatcagagctatcagaaaagttatttctgaaatcttgaccagagaagttcaaaactctactttggctcaattgacctccaaattgattccagaagttatcaacaaggaaatcgaaaatgctaccaaggacatcttcccactacaaaacatccacgttagaaaggttaagttattgaaacaaccaaagttcgacgttggtgctttgatggctttgcatggtgaaggttccggtgaagaaaagggtaagaaggtttctggtttcaaggatgaagtcttggaaactgtgtaaacaaaataaatataaattataagatttgacatgtacacaatttattaatatgttttctctttattattaatataattaattattactaaaaaaaagaaggtgacgcaccatacagaacttgctcttttgtccaatactgtctttttatggttgttattttttacgttaccgatttcggtttctattgaactgtaataacttgcctatgtgtctatatgccttttctatttagtaagagctatgcattatacgtggtcattttacttcttcaacagaggaagacgcactaaaatcgcttgtagtgcctccaagtttcctgcttgagtgatcgctatctgcctcctctgcgtcattaaccgcatctggctcttctatcactccagtttctttgtctgtttcctcattattaccctggcgactattatcttcttgttgactgctttccccatcaacttcattatcctcttttatatcctcaacgtctacttccatatcatcttcctcttcattttcttcatcctcctgatcgtcatattcatgatcgctttcctctttttcgtccacattttctatagtattcacttccaccattgatctctgccttttaaacctctcttttctttcctcatcttcatccgattcataatcttcatcaatgttatctccttctgcctcattgagcaggccatctctcttcagaagttcttctttgaatattgatgtgatcttgccaaatatttctgcatctcttagccacttctctttgtaagacgatacctcctgccttacgttttctatatccgatttcattgaggcgttgatactttctaactcttttgggcccttagagaaatcgtcataaatacgatatctctcctctgaactatcctttttcaggcccggatcaactagtttgagataattcttttcaattaaaaacttgaccagatcagtgccaagttctttctcccattccgcacgtgtcaccacaaggctggtacggccttctgacaagccttccacctctctgttaattacttggacagaatcgtaaagaccttgtagttttccaatacgtaaaagcaacttgctatggatgctctttatatcaggcaatttatctttgagattttccagcttggccaatgtctcctgttggcatgtttcccaattttcgtctgctactttctttgtgtcaattgatgactgcagatccaaaaatcgaagatgagcactttcttttagttgggagatattttgctcagtaagtttttcaatcttgctatcatcattggataatgtgccatttataatgcttcctgtcagcttggttacttttcctaagatgtctaaatatttattgaatggagtatctacttcactgtagtgcactttggttctaacttggtctatttgtttttgtgacagaggcattgtgagttagtctcctttggctttagttctttgattccttttttacagccagttgttgtattttactttaatttagataatgtttcacttttttctatcgaaggaggttcaccaaaataatagaatgaacaaagcgcaagaaagaaagataaaaaggtgtcaaagaaccaatatcaaaataaatacagataaaaccgcggaactatgtatctcggccttgattattatagcagtttgtattctatataactatgtgtattaatatgtacttattctaagatgtggtcttcggtatcctgaccacgaggttcgtcggaaaccaatgaatgaacttgattactattagactcttttttcaactgaaatctcttcctactgtgtctttgcaacatcgctgcgataccattattagattgtgtggtcgctgatatgggtgctggagaatttgactttgacttggatttagccttatatttagggcctggtgcgtagtctaacttcctttttttcacttgctcatctgcctcaagttgcttataggcactttcggctgaagataaagtaagataaaaatcaattaccttttgatgtgctttgatcctagttctgtcaaaatttaacacctgtagtccttctcttgaaacagctctagaaagggcaacgtacgcctgacccttttcgaatactctacgtaaatccactttaacttttggaagtgtctgaccctgagatttgtgaatggatagtgaccaggcaagcattagcggtaattgaacccttgataccagtggcttttcattttcgtcttctatcgcccaatcctccggctcgacaagcaccatcctcgtactcatatcagaagctttgaatctcacgagaggtaaccttcgttttcctgcagagttttgatgtatggtctgcatcagttgttccttgcgttttatattttccagcacaacttcgtcatctgtcttgactctcttcatgaagtcaaaaactgaggaatctaggggagagaccggctcacctatatcactcttagcaaatccctccttcactgaagatttgcgactagctaccgcactttcttccccatcactttgctccctctccattgcagcttttagttttgaagggttttctgcccaagtctcgagtttttctggaggcatagatggatcgtttgttagcgcctcatagcaaaaatatgtttctggatccatgaattcgatgactttaccaagggatccattaactaatgttgcgtctagattttttaccatcataacctgagcgccaactttcaaatgtaattcctttggagctaaaaaattttgtaacagcctttcctttaactcttcgtcttccaaagcaccgccatcgattgcattaaaaatatgcacctggcctggcaatttacttagccttgaattattggccctttctacttccattctggtactataaagttccgcgggaataatttcatcgtctggcaatggtctagaaagcttcttgaactctctttctgtttcatcatcaatattgcctagtctcatccgattcaacatgtcaatgaacttaacatcgcctcgctgtctaaaaaccttttgtagcataatcgtcatctttacaccttctttccaagccttggattcgaaagcaaacttagttggtctattaggatcttttgatactggcggtaactggaaaaaatcgccacagaagatgagttgaattccaccgaagggttgatgatttttccgtatttttctagctatgaaatcgagtttatcaagcagttctgcgtctaacattgatatttcatcgacaaccaaagcaccaatattttcccagcgccttaggtgctttcgagacctacgaacttttttatagagtttatccgcatcaccttttcctaatcctataccagcgaacgagtgtatggttataccaccgatattacaagcagctaaacccgtggaagcagtgactgcaacattctccctaccatatatgccttttaaaacttttatcatttcacgtaaaagaatggatttaccggtaccggcactccctgtataaaaaatgttgtggccattttctgccaacttgatgatactttcttgttctttgcttaagcaaatcggtatcttgactttcacaccattatggggattcaagttactgtcatcttggtcattctgcaattcagtgaagctaggtctttgcgtcaaaacagcaatcttttctccaaattgcattttcttcttttcgttttcatttatcatttccaaacttctctcttgagatatagaattattttgaagttcatcaaaagaactttcctttttcaacgctggtcttaatggattcttgaatcctgtcgatctcgattttttttgactgctctggtcaaatgagttttcagaaattaactgcggtggttgtattatactgggtttaaacatatcgttccaggataaaggactgtctttattgataaaattcatgacatttttatccctcataggctttttgtccaccgggtcttctttatgtatgtcagtgataattttcttttcttgcttctcagtttctaactgtatgcaatcaggttcttcccaatcatccgaatcagagagcaaatctaggtcttcttttgaaagtatggaaggatgcttcaattgtgcttgaataaagttattagacctgaaaccacgactactcatagaaaacgatagtttggcgtgcgatacgtttttgagtaaaagaaaactgttgaaactacagataaatggccttcttggtataatatgattcaatgttgatcttatccactttggcatgtaaaattgattgatacaagtaagctaatcgctcaatggataatattacaaataaaaatatcgaggcaataccagtatttcaatgtctggccaaataaatagtttagtacagcaatttgattaacgttaaagttactctcctctttgaataatgtcgtggttaaaaagtaaagtatttgtttatacattaagtgaagaaaattaagacgcgcctttcttaatgtaacgccaaaaatttttaagagatgagctgaacagcatcacaaaactactatttccagcggaagaaggcatttgaagcgtcctgattcataattgcgattttatttatcaaccagatgtcttataaattcggcaaacttgccattaataaaagtgagctatgtctagcaaatgtgctacaggctggccaatcctttcgatggatttgggatgaaaagttaaaccagtacagcactacaatgaagataggccagcaagaaaagtattcagtagtgattttgaggcaagatgaagagaatgagatcctggaatttgttgctgtcggcgactgtggcaatcaggacgccttaaaaactcatctaatgaaatattttagattggacgtgtcactgaagcacttattcgataatgtttggattccaagcgataaagcatttgcgaaactttctccacaaggcatccgtatcttggcccaggaaccatgggagacattgatttcctttatttgctcgagtaataataacatttcaagaattacgagaatgtgcaatagcctttgctctaatttcgggaacttaatcacaacaatagatggggtcgcctaccattcgtttcctacaagtgaggagctaacttctcgagccactgaagccaagttgcgtgagctgggctttggatatagagctaagtatattatcgaaaccgcgagaaaactggtgaatgataaagctgaagctaatattacttctgacaccacataccttcaaagtatctgtaaagatgctcaatatgaagacgttagagagcacctcatgtcctacaatggtgtaggccccaaagttgctgattgcgtttgtctaatgggacttcacatggatggcatcgtccccgtagatgtccatgttagtagaattgcgaagagggactaccaaatatctgcgaacaagaaccatctcaaagaattgaggacaaaatacaacgccttacctatctcaagaaaaaaaatcaacctagagctcgaccatattagattaatgctttttaaaaaatggggatcatacgctggttgggcccaaggtgtcctattctctaaagaaatcggagggactagtggtagcactacaactggtactataaagaagagaaaatgggatatgataaaggaaacggaagcaattgttacgaaacaaatgaaactgaaagttgaattgtctgatcttcacatcaaagaagcaaaaatagattagcttaaaaagtcatagtaaataccacgataaaagcacgcgaccgaaaaggcgatacatattctttaaaggagcttgaaaggtaatgattgaaatattagagatatttacagtataaaacacaaatatttagaacgataaataatacagtaaaaaacaatgcaatacctaaatctatctacaaaaaacggtcaccaaggcgttggaagatagaaatctatcaaatactatttcttctatgtaataaaaactcaggaacttgagaattcaaagtggtttcttgtgaaccaggtatatatggcatcttgtcgtcgtcaataagcccttgcaaaaagatacgaccatagtctacacccacatgataaatttcttcgaacttgctaaagtctaatgtggcatattcttcaataggtggtctcacataaacgacacctggtgtatttttcgctttctctaaagcatttactgatgcgacgtaacccaatctaacttgaatctctgccatattgggtatgtttggatgagaagaaaatggattccatctattgaaaatgatccaaaacccatttagggagtcaccatattccataggcgttctatcatctgcagaacctacatctactgcaaatatagtttggcaaccacgcgctctcatctcagttactggtaaattatcaacataaccaccatccagtaacatagacccgttctcttccaaaggaggtaaaagaccagcaagagacatcgaagctctgatgtacctccacgcataaccaaaggaatgtatttcttgaaccgaatcggttatattagtagaattacaataatactggatccagaagtcttcaattcttgtatccccgaaagttttccaaatacctctattaaattcgtgaccagtagtataagaagtaaccggccaggttaaatctgttaacattctccatatagaggaaattcgaccagcaaacttcttcacgcggccgtaaattggcaccaaatcataatccttcgcgtacaaaccgccaacaaaggaaccaatcgatgttcctccaataacgtcgaccggaataccttgttcttcaatagcttgaatgacacccaaatgactaatacctctcgcacctcctcctccgaggacaagtccaatagcttgtccagaaagaattctagccaatcttagaaaatcatttttatgcctatgaactggtgtgtaatattgtcttttacttttcatgaatcttgaagaaaagttttctacggtgttcttgatagaatctggaagtagttttgatatattctgttgagtttttctactgaattctgtttgaatcaacttatccattaatgccaaggcaccattattcaaaacgtgcattttgccttcgttcatcaaggttgttcctgtcaaactaaattgaatgtgatgatgcgaatgaacccatggcctatagcgtaaccacttatgggttagtcctggttccacatacctttcagggtgtagaagaattaactcggtccttgcggtagtctttgaatttagtaataacttttcatattctcctatttcggctgatggagatctagcatctgctagtaagagaatacaatcaccttgcgcaatacaggttcttgtccaattagatttaactggtgtatctgatatataaacaacagtctggtacatttcttctagttcagcaaagtaaccactttgttttaatttggacaatctgtcaaatgcatgacgacctaaatgtgttagggtagttctttgatttaaaccaatcgtggtccttcctacctgtttgaaagcttgcactaacttcatagcaaatgcttctacaggtagtccactggtaattggtaagatagtgatggttctaaaagtaattgtgccagaagtaatattttggggtttatgacttaaagagctagagtaagacgctttcgttggaggtattaaagaagtgaagtcgttttcctttatagataatggatcgcctgttaatgctggaacagttctatctccgacaatttttttagcaactaatctggaaactctaatcatgatagatggatgttcaagagctaatagttcgaataatgttctcggaattctcgctaattcagaatccctcactgccactatcgttgaatatctattcatagcggtaagcacttcaacttcaccaaaactctccccctgggccagttctcctagaataatgttctgagtttcaacttcttcggaacttgtattggagtttgacaatgactgctgttgtagctgccttagtctaccattcaggacaacataaataccgttagccgagtcaccttgtgaaaatagagtttcagaagccctcaagtgaacccattctaaagcatggtcgagctttaataaccttgaagatagcaatttggttaatgaatcagaaatccgtaagtagattaggaaatatttatcaaacaatctttctaaggttgcactagataaaaatccaacatagacatcgctcttggcaacgatattaacaaatgatttgtaaccaattagagaggacaagtagcccacaataccaccagatcctacagagtataacaaatgttgagtatgatgaggattttcacccttgtgtgaactttgggctgaaacctgctctggtttagacattgatgatactactgacgaggacgaatttgttgtcacattaactttcccggaaatgatatagaataggcctttaccacgagcgttctgctcaacaattgtggtgccctttttaaagaacttcaactgaatgccttgtgcaaagtctttcttgacatcttcgaaatccaaattgggtgtcaactcctctttgtaagctctaggtttttttttgtcctggcttttacttttattatgccttttattgctgatagtgtattctttgggtaggattcttaacattgtcggttgagtttgaggagaggcaaatgatgaagctacggaaatgtcagatggtgtacagtgaggggacatcagaaaacttgcgttacttggacggcggctatacatttcattaagttgaggagagtttaaagaagacatatttgctatcgaagaagatgaaacggacatattgcttttgtttacacccaagtatgttaacattgcctcaactaaagccattcttaaagcagagtcctcggtttcttcctgggcagcagaaaaggatgttgtgggcagtaaattaggtcttggagagacccgtcccttcaaatgaacgggacttgggtggatatggtcatgaacagaagtattatccaaggacaagggcgatgtactaagttgtgcgttgcgcaattctggggacaaagaagaaaacttcttagagtgtacggaagcattgttactgctactcctagaagatcgcttatgttggttagaggtagaagtgttaataccgtttgatttattgcggttgttattatggattgggttgggtgacagaatatccatagttctagacagtgggacatttgacagtaaatcaccaggattaaattggtctcttgaacccagtacgacatgtctcgaacttggatggtgggtgaattctggtttcagtgaaagggaattcgaacttgtgttagcgttggcgttagcaatcttaagcgattgaatgataccatcagatggcttcgctttgggcggtttcttcaatttagaggaagcattactatttttgggtttcggttctaaatcagccgatccgctcgacttatctacagttttaaacttacgaataacggcctctttcaaataataaggcaattcataaacgatggatttatttagtaaaacttcgatatccatgatctcctttgttaaacctaagtagtcgtgagcagtttggaacgtaacatggtatagcttggtgagaaccatctgtatgatatgggaagcagaccgtgggtattttgcggttaatttggcaaacgattgaggtgggataataccaattgtgcagtctgtagccgcacgggcgacaagtttaggcattgaagaggggaacgttggaaagctgttggtggagtttgtcatggaatctgtgttggagaagttctgctctgatgagcagaacatattgttgaccgacaccgttgtgtctataggtgacgataactcagagggaaagttactgttgccatacgaggacatggaatgcgtgaataagtttaaaatgctcacgagggaggtcagcgggtttcctggcttgactgtatttagcagttgaaaatttcccagtccatttttcagatgaatgtaaccaacggattcatcttcttcatcgatgaggttagaagaacaagatttggtgtcgtagttatcaatgtcatcatcttcttcttcgtcttcttcatctctatcctggtcgtcaagaccatccgtgtcactgtggtcagtttcatcgccatggtccttatctgaatgatctacttcatgatataactgcagggtgccttcaacgacgatggcaaacccaatagtactgtccaacagtaaaatctcaccctcatccattttttgagttttcatattcttggtcaggtcatggaagactggtttttccagatagccaaagattttgatggcgctgagaaattggtcaaggtaagatgaaagaaaggtttcgttttcgttgccatctttcaatgaatgcttttttgagtctataatcgagcttgcacccgtggtagaggaacctatggcgggtggcgcgttggctgactgagtggaagctgcattgatattggcgctggagccagatttacctgtattttccagcggcaagaactccggggtcagcctcttgtactgggatagaattctctccttcatgatggtgtaagtcacaaagactatgacggctagggcaaacaggatcagccaaaaggaaagagtgaactgaacatggtgtaacttgaagaagatccacttcggaatccttaaaagcgataaagttgccagataccaaccgtacctgaagatcatacgagaggcacccataacaaagtaggacacaacccacgagaagttgaagagggatgaaagtgaccacgtctgcgcctcagaaataatctggtcggtgagacatgtctggaatctataagaagtataattactggaattaaagctggagccaagactgtttttcgtgttttggccggtattgttggtgttgttcgtagtgcaattcattgaacgcatgcaaaaactagagccaagcctttctattcttttcttgtttattttatattcgttagagttttgtggtgtttctttaacttaataaactttcgagaaaagtgtcaagtttcccagatttttaagatccttataacctgtaaaaaaaaaaaaaaaaaaaaaaaagaagggtttaaataaaaatcggacttactcaaagggttgaaaagcactttaatataggtttttagtttcgggtaagaagatgtgtcaaaggtctcgaaaaggaaacattagggcaaatacgtaaaggttgccttcgtatctcgtttccacagcaacgagaaacgagatacgaaggcaactgattcccagcatataaaaggccatgaatttttggcgtttcctattgtcttttcgaaactatttctttcattcctttcctttcttgttcttttacttataagaaaaataatatacgtatatatataactacaaaccacatcagcaataaaaaaaaactatatgaccatggaccaaggccttaacccaaagcaattcttccttgacgatgtcgtcctacaagacactttgtgctcaatgagcaaccgtgtcaacaagagtgtcaagaccggctacttattccccaaggatcacgttccttctgccaacatcattgccgtcgaacgtcgcggcggtctttctgacattggtaagaatacttccaactaagagcatgcttctctttttttttgtaggccaatgataggaaagaacaatagattataaatacgtcagaatatagtagatatgtttttatgtttagacctcgtacataggaataattgacgtttttttttggccaacatttgaaatttttttttgttacctcgcgctgagcccaaacgggctccactacccgccgcggtcgccattttgggaagtcatccgtcccaaaaaggaaatagccataacatatcgttactgttttggaacatcgcccgtttcgcccgattccgcctcagcgggtataaaaagagatctttttttttcctggctgtcccttcccatttttaaatgtcttatctgctcctttgtgatcttacggtctcactaacctctcttcaactgctcaataatttcccgctatgcaaaattcccaagactacttttacgctcaaaatcgctgccaacaacaacaagccccttccacattgcgtaccgtgaccatggcggaatttagaagggtgcctttgccacctatggctgaggttcctatgttgtctactcaaaactccatgggcagctccgcttctgcctccgcttcttcattagaaatgtgggaaaaggatttggaggagagactcaactctatcgatcatgacatgaacaacaacaaatttggttctggcgaactaaaatctatgttcaaccagggtaaggtcgaggaaatggacttctaaagttcctttcatactcttttcttttctctttccatttcccactagttctgttcttttcttctcttagatacccttcttttcagggactctcgtcctactattgttgtcattctcgaaacattctctcccgtgcattttcctttccctttatatacatatatatatatatatatatatatgtctcttctacgtatttttgtatttctgtgtctttatcaaagatagtctataatacgtttgatacagctagatatcgctagcgccaacattgtccccctctcttgatcaatgctttttttcggcccgagacaaatgagaaaatgtcctaaaaatacctttcatcaagactcctatttttccttagaaaaaacatatatccaactggaacagtattaagccaattgctacgatacaaacaaaaggagatattccttccctcccatagagtcacacaggagccagtacttcttcttgaacccgcaatgtcttcagacgctataagaaatactgagcagataaacgccgctattaaaattatagaaaacaaaacagagcgtccgcaatcgtccacaacccctatagattcgaaggctagtacagttgctgctgctaattccacggccacagaaacttccagagaccttacacaatataccctagatgacggaagagtcgtatcgacaaaccgcagaataatgaataaagtgcccgccatcacgtcacatgttcctacagatgaagagctgttccagcccaatgggatacctcgtcacgaattcctaagagatcatttcaagcgcgagggcaaattgtcggctgcgcaggcggccaggatcgttacacttgcaacggaactcttcagcaaagaacccaaccttatatctgttcccgccccaatcacagtttgcggtgatatccatggccagtactttgaccttttgaagctattcgaagttggcggagatccggccactacatcgtatttgttcttgggagactatgtcgacagagggtccttttcgtttgagtgtcttatttatttatattctttgaagctgaattttaacgaccatttctggctactgaggggtaaccacgaatgtaagcatctaacgtcatatttcactttcaaaaatgaaatgctgcacaagtacaatctagatatttacgagaaatgctgcgaatcgtttaacaacttgcccctggctgcgttaatgaacggacagtatctttgtgttcatggtggtatatctcccgagttaaactctttacaggacattaacaacctaaatagattcagggagattccctctcatggcctgatgtgtgatctgttgtgggctgacccgattgaagagtacgacgaagtcttggataaagacttgactgaggaagacatagtgaactccaaaaccatggttcctcatcatggcaagatggcaccttcaagggatatgtttgtcccaaactcagtaaggggctgttcatatgccttcacgtatcgtgctgcgtgccattttctgcaagagactggcctgttgtccatcatcagggcacacgaggctcaagacgctggttatagaatgtacaaaaataccaagactttgggctttccctctcttttgacccttttcagtgcgcctaactacttggacacctacaataataaggctgccatattgaaatacgaaaataatgttatgaatatcagacaattcaacatgactccacacccctattggttaccagatttcatggacgttttcacgtggtccttgccatttgttggtgaaaaagttacagagatgcttgtcgcaattctaaacatctgtactgaagatgagctggaaaacgacacccccgtcattgaagaattagttggtaccgataaaaaattgccacaagctggtaagtcggaagcaactccacaaccagccacttcggcgtcgcctaaacatgcttccattttagatgacgaacatcgaaggaaagccttacgaaataagattctggccgtcgccaaagtttccagaatgtattctgttctcagagaagaaaccaataaagttcagtttttaaaagatcacaattcaggcgtgttgccacgtggcgctttatctaatggtgtaaagggtttagatgaagccctgtctacctttgaaagggcaagaaagcacgatttaattaatgaaaaattaccgccttcactagacgaactgaaaaacgaaaataagaagtactacgaaaaagtttggcagaaagtacatgaacatgatgcaaagaatgatagcaaatagagaaagctcctatttccactgtacatacttcaataagtaagtaagttgcattaattatctatttagaagctagatgctcctcaaatgcacagaatcatatagcgttttattaggtctgttctttattttagttttgttgatctctatgaaggtatatttatatgcaaaaataaacttttaaatatctatggatgcttactcaattgtatagacgtttttcataggagtgcaaattatggacaccaccttctaattgagcagaagcggttctgaattcaaatctaacttcaccattttgaacattctctttcaatgaagttagagattcgcaaccaatgtcttgacaagaatgttgtaaaccgttgtacaaatatggaataaacttcttgatggaacctttgtctacgacagccccagaaacaccttgtgcaaccaagacactgtctgactcagagaaataacgagaagtagaggcattacccttgttaccggtcttttgcatggcgtcaatggaccccataccacgataagccttcaatctcttaccatccttgtagaagtattcacctggtgactcggtagtaccagctaacataccacccatcatgacggtggaggaaccaagggccaaagccttggtgatgtggccaatgttttggacaccaccatcagccatacatggaacgccaaattggttagcaaattgacaaacgttgtagacagctgtaccttgtggtctaccacaagccataacttcttgagtgatacaaatagacccagaacccataccaattcttaaaccatcggcaccggcagcaatcaagttagcagcttgttctctggtggcaacgttaccagcaatgatttccaaatctgggaaagtttctttaatccatttgatcatgttcaattggaaaacagagttaccttgagaggaatctaagataacaacatccaaacctgcttcgactaatagtcttaatctttccttatcagcttcgatagtaccaattgcagcaccacatagcaattgcttggtggtggcggatttagaagctaacgggtagttttgattcttcatcaaatccgctcttgacaacatggaaacgaggttaccgttatcatcaacgataagcaatttacctttcttggtttgttttaggatttcattaccttctttcaaagtaatacccttgatgccagtaactggatttttagtcatgacttcagaaacaaccaaagaatcatcttctaagaattgtatatcacgagaggtgactaacccaactaacttacctggacacttaccgtcttctgtgttcaaaaagatgtacttgtttccttttattttctcaactttatgaagactgaagaaattttcagcccagccagaaaagaaaaaaaataacagtatttacatagcaatgttagtaaaataagccacatatttttttatcacatatattaagttcctcaagtgcactgcacgtcaattaatcacacataatgggctttccgaaaaaggtgcgaatatgatttaattcagagtaaaagttctctacaagatcgtttgatcacagtcagtagaacgaaagttattgatataaaaagttgatcatcatcttagatctttttcacaccttggaaaactttatggatgattaaaaagcgcattctaatgaaagaaacataataccaaaaattttgtctattataacataccagtaactgggaagccagagaaaccaaactttctcttcataaccttaacttcaccaacagtggtggttggagaaattactattggagaattgatgaaaccgttttcaaacattttaactttcttgaccatggaagcctgttcctttggagtacagttgtgatggatgaaaccaataccacccaataaagccatataaatagccatatcagcttcagtgactgtgtccataggagaagagacaaaaggagtgttcaaagtgattttcttggtcaatttggtttgcaaactgacagcagaagatgggaaattgaccaagcctggtaagaccaaaaaatcattgtaggtcaacccacctctagttgtggagtccatcaattcctggacagaaagaccgtccttggaactgtatgtcttcaaatgttctaaagcctttttgtaatccaatggagcagcactcatcgtaaaatgtttgttaggtttcttcaaagctatggaattggtccaatatcctttggttcaagcagcaaagaagaccagagaaaatgtaaaagccaccattttttcgtaaaaaaatttaagcccaagagtttgagaaaaagagatgaaaaaatgcgatgagccaagcatgatttgaatcggatggattctcaactgatatttatatggctttttcagtttttttttttttttttttttttttcagcatctcgaagagcaaaaaaaaggaacgaaaaagtgccacggcaaagagtttttcacattagggctgccagaaagaaaagagtaagcagatttgaggattaaaagcactagtgcgtccctcaagtctatcataacaattttatgtattgatggagtgtagttgttttttaaatagtaccattagctagcttcttgtaagatcaatgtacttttgtaaaggaatatgccttcttgatgaggcggaacctttaagagattttttcagttctgcaaaatcataccagacaaaaaatgacaattgtacacgttgaaacggaattatagaaggaaaagcacaagttattgtaaggaaaagagacgcctgttcaagatgagttctgctaaacctattaatgtatattcaatcccggagttgaaccaagctttagatgaagccctaccttctgttttcgcgagattaaattacgagagatcatacgctttactcgatgctaaattgtacataggttattccatagctgttgtagctggtttgagtttcttcttggataaaaaatttgagagagatcagattgttacgtatcaaaagcttttggtaggcgcatattttgtgctctcgctacttttctggtatttctctcgttttattgaaaaggggactgtttatgtgggaaagagaagaggtacaaaggaggaaatatatgtaaagacaaagttcgaaaagaacgaaccattatatctggttgagcttgttcagaaaaaaaagggagaaaactccaagaaggagttgaaggcaaaattagaagtgaataaggtttttaatgaaagtggatatttacagaacgatgcgtattttaagtggttctctgaacagcacaatgtcctcgacaccaaaaaaaatgaataaataatgtataaaacatataactttgcaaatgattcaaaaattcaaattttctctctctctctctataaacataaatatatatgtgtatatgttttcttttttttttttttttttttttgaatgatattaagttatacgaatgttcgataatatatatgtatgaataaataaaaagtttttaaagtagccttaaagctaggctataatcatgcatcctcaaattctgttaaagtaggtccctcataaacttcattatacagcacgtcgtttggtactccaactgttcttgcctttagtgttgatagatctaaaagatcaggcttcaattccgcaatgctagtaacacctaatagtctcatagacatttcaatttcatctcttaaaatttcaatggctttttcaacaccattacgaccatagcatgagttcgcatacaagaatggtctacccaaaccaacacctttagcacctagacataacgctttcaagacatctgtaccacgacgaacaccaccgtccacgaaaacttccaacttatccttcaagttacgttgttccaggattggcatggtttcagccaggacttcaatgggagcccttgaaaaatctaattgtctaccaccatgattggatagaaccaccccacttacaccgatttctgctgctttgataacatcttcggtacgttgaacacctttgataacaataggtagttttgtctttttcttcaactcttctatatctttccaagtcaaagaggggtcaataaactttgataacgctctcgaagcaccttgagattcttctacattagttttcttcatcgcttttggaccagcctttgtattggaaaatttcagcttcatatctttttctctttgacctaaacttggagcatccacagtgacaaataatgcctttacacccagcttttctacatttttaaccaaatcatcagtgatctttctatcagagttaacatatagttggtaccattgaatttgtttatcagagggtgctgcttcaataatttcctcaggggaacatgaagccaaagtagatatcatttgtgggacttttgtcacaccttggccacaacctctggcgacatctttttcaccttctaaggggtttcccagtttacacaaagctgtagcagacacgtagaagggaacatccacatgagaacccaacatgtcagttgaaatgtctactttgcgtacatctacaaggatctttggtttgaaaaaaatcctatgataagcattatggttttctctgtgagtaacttcgtcgttagcaccggaggaatagtaggcccacgcttgtttagtcaaagtttgagaggccaagtattcaaagtcgtaaaggttaataatattatctagaggaggtagcagcgattttagttgttcttttctagcgatatcttccttagtttcaccaggagcataaggaggacagacaagttcaggaggcatggatccttgaaggggacccaattttttctcgggagctatatacttatcgatgacattaggagcatgtagtggttcaaaaatagcagtgacatctttcccggcgttaaacttgataacatcctgcccacctggatgatttggtaggaatcgcgttaagtcgtatacgtaaccattgatcacaacccaacaatcatcgggcttgttatgcttggcaacttcagcgggcgaaatcttttgtttattcatatccagtttcggctcgttgtctatttggccattatgccagtttagatacgccacggaactagtagcggctagaattgcaccgactctcaaggcagtccatgactgtgtgcgttttcttgagtcttgttcgaacgacttggattttggaacggtagaaccgtacgcgcggattgtgttcaatctagtcttagacgctctgaggatagcagcctcacagttcttcgagatttttagtaaaggtttgtattttagcattgactacttttgtttgctttcttctctatgcgggaactgtattagcgacataggatgtaagaatacgaaaagatgcaagaagattagtcgaccaggtacttatatattcacatactccaactgaaagtattggagatctaaggttcagcagttggttcttggcggttcttgtatgacattattattggtcgggtcgtagttctctcgaacaggaggagggggcaaggagatatcggcaggctttttgctagcgccttgtttgaaaagcgtgggggtaggtctccaagcgattattgaggaagtagtttcaagtattacagagtccagggcacaagggtcttcattatagagagagaattttcgtgaaaaaaatgggcagaatgccacatgttagcaatgcaacgacttgagtggggggtgatccttccgatgtatgcgtgaaagatctcgtgttgtgcaggaaagggaatcatttcggaaaaaaaagatgcaacaaggaggatggcatgtggatactacgttcttgcgtaatatcctttttgttgcctgtgttaatacgtgagcaacattttttgttaaagtaggcgatcaactattgccccctgatattggtagtaattctgctaaaatatcggctgagaaatggtgattctcaaataattgctgggattccactggatatggccccattcttagatatatggaacgtagtagaaggcctcttagaggctatgggagtctctcaagagaaaatcgacatttttacgtaatcattcgttcatttcactttatacgtcatgattcaatatcgtattactttatcaagtacccgcgtttaaacttcattaaatgactgcgtctcaatctttatgtcatcctccctccgcaagtgacaatgtactggtaaaataaaaactaactaactagatgatatttttagagttttattccaacgtttctcaataggcgatggaggaacagagtgaatataagaggctctgtggatttatggttaccggatttatttcgtaaattcttattgaagaatgggtgaattttgagataatcgttgggattccatttttaataaggcaataatattaggtatgtagaatgtactagaagttctcctcgaggatttaggaatccataaaagggaatctgcaattctacacaattctataaatattattatcatcattttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacacttatattctatatatccataacattgtctacatataatccgagaggttacgacaacattcatataataagggtagtactgacactttattttgaagtaaatcaaaatagtcactctcggtagccaagttggtttaaggcgcaagactgtaatttaccactacgaaatcttgagatcgggcgttcgactcgcccccgggagatattttttttccctttttctccaggcctagtgaggtttgagttttgaacgttttatagatagatgtaaggtagccagaatgagcacttagcctttaaagtaaattgagtagagatacgtaaacagtcgtgataaatatgtaatacattgtattattttaaataggttaaattttcttttttttttttccatttcattttcattttcatttcctgcagttattttttttcttattaatctatatccatgtaatcgttagcgatattgttgttagtcaacgcggccatggcagtaccgggtgcttgtgatgcaattatactttgggatggtagaagatgatactggtgttgtataatactagcacttccagtaggactcgtgcctgttatgtcgcgattagtgttaccgaaataaccatgaatcatgtactcttctgtttcagaataaaattcagattcgttcagtaagcggctgttcatagtgtggtgcatactaaccggtttcaggggacatatttcgatattttttttataatgaatattattgtaggttgcagtattattgctgttattatgattatggttattattattattattgttgttgttgttgttgttgatgatgatgttgttgttgttgttattaagattagcacacccggaaccgaccgaaaactttgtacttacagaatctcgttttgttctcttcgatctttggtagaaagtgtgtgtatcaaactcgaaatggtcattttttcttttattcatgatcgtatcattattggcgtcgctgttgtatgtagtggcggcattgctaccggaattgcaattgtttgtttggaacgcagtattgtgttcatagtatgagagcatttcacgcagcacacttgagtcttaaattaatgaataaaagcagccaaccccaagaaaaaagagcccttatctgtttctgtcgcagtcctattgtattcttcctaactatataattttgtcaaaatgaaaaatataaaaaaaataataaagtcagctgagtggtaaagagaaagcaaagggagagaaaaatcggttacccagatggattaggttacccagatgtcatacgtgtatcatgatttctagaaattattaccctgtttggtaccatgacaacggatatggcaatcttgcattaagtaaaatgtctctaatgggaccgtgaaggtacaaaacagcaatggtctaggtagtggcattcgaagcttcgaaagcgtggcctcgcctcgagcgtgaagtcatattttctcactctgcactgccgtgctgtgccatgtagcccactgtatgcctctagcaccccaatcgggaaaattgtaaacattagcaggtgtcgcctcgaggcccccgatacatttttcaacatctcctcgatacttaaacagcaaacaaacaagcaacacccacgcaagaagatttattaatacctcttgactcccgtagatattgaagagactaagtatagtaacgcatatccgcacaatactatggttaaggtctggaatatagtactacgtctggtagtgttgctgtttttagcaggtaataccttgctgttaattttgatgattatatctggtgccacggaccattaccccgtgaacagattctattgggtgcagggcaatacaacaggcatacctaatgctggggatgaaacacgttggacgttttggggcgcctgtctacaggataaagacgggtcggatacctgcacaagcaatttggcacctgcataccccatttccccagtagataacttcaacacacacatcaatgtccctcaccagtttatttccaaaagagacgctttttactacctgactagattttcattttgtttcttttggattgcgcttgcctttgtaggtgtgtcgtttatcctttacgttttgacttggtgctcgaagatgctttcagagatggtgcttatcctcatgtcttttgggtttgtcttcaatacggcagccgttgtcttgcaaacggccgcctctgccatggcaaagaatgctttccatgacgatcatcgtagtgcccaattgggtgcctctatgatgggtatggcttgggcaagtgtctttttatgtatcgtggaatttatcctgctggtcttctggtctgttagggcaaggttggcctctacttactccatcgacaattcaagatacagaacctcctccagatggaatcccttccatagagagaaggagcaagcaactgacccaatattgactgccactggacctgaagacatgcaacaaagtgcaagcatagtggggccttcttccaatgctaatccggtcactgccactgctgctacggaaaaccaacctaaaggtattaacttcttcactataagaaaatcacacgagcgcccggacgatgtctctgtttaaatggcgcaagttttccgctttgtaatatatatttatacccctttcttctctcccctgcaatataatagtttaattctaatattaataatatcctatattttcttcatttaccggcgcactctcgcccgaacgacctcaaaatgtctgctacattcataataaccaaaagctcataacttttttttttgaacctgaatatatatacatcacatatcactgctggtccttgccgaccagcgtatacaatctcgatagttggtttcccgttctttccactcccgtcatggactacaacaagagatcttcggtctcaaccgtgcctaatgcagctcccataagagtcggattcgtcggtctcaacgcagccaaaggatgggcaatcaagacacattaccccgccatactgcaactatcgtcacaatttcaaatcactgccttatacagtccaaaaattgagacttctattgccaccattcagcgtctaaaattgagtaatgccactgcttttcccactttagagtcatttgcatcatcttccactatagatatgatagtgatagctatccaagtggccagccattatgaagttgttatgcctctcttggaattctccaaaaataatccgaacctcaagtatcttttcgtagaatgggcccttgcatgttcactagatcaagccgaatccatttataaggctgctgctgaacgtggggttcaaaccatcatctctttacaaggtcgtaaatcaccatatattttgagagcaaaagaattaatatctcaaggctatatcggcgacattaattcgatcgagattgctggaaatggcggttggtacggctacgaaaggcctgttaaatcaccaaaatacatctatgaaatcgggaacggtgtagatctggtaaccacaacatttggtcacacaatcgatattttacaatacatgacaagttcgtacttttccaggataaatgcaatggttttcaataatattccagagcaagagctgatagatgagcgtggtaaccgattgggccagcgagtcccaaagacagtaccggatcatcttttattccaaggcacattgttaaatggcaatgttccagtgtcatgcagtttcaaaggtggcaaacctaccaaaaaatttaccaaaaatttggtcattgacattcacggtaccaagggagatttgaaacttgaaggcgatgccggcttcgcagaaatttcaaatctggtcctttactacagtggaactagagcaaacgacttcccgctagccaatggacaacaagctcctttagacccggggtatgatgcaggtaaagaaatcatggaagtatatcatttacgaaattataatgccattgtgggtaatattcatcgactgtatcaatctatctctgacttccacttcaatacaaagaaaattcctgaattaccctcacaatttgtaatgcaaggtttcgatttcgaaggctttcccaccttgatggatgctctgatattacacaggttaatcgagagcgtttataaaagtaacatgatgggctccacattaaacgttagcaatatctcgcattatagtttataaaagcatcttgccctgtgcttggcccccagtgcagcgaacgttataaaaacgaatactgagtatatatctatgtaaaacaaccatatcatttcttgttctgaactttgtttacctaactagttttaaatttccctttttcgtgcatgcgggtgttcttatttattagcatactacatttgaaatatcaaatttccttagtagaaaagtgagagaaggtgcactgacacaaaaaataaaatgctacgtataactgtcaaaactttgcagcagcgggcatccttccatcatagcttcaaacatattagcgttcctgatcttcatacccgtgctcaaaatgatcaaacaaactgttattgccaagaaataaacgcaaggctgccttcaaaaactgatccattagatcctcatatcaagcttcctcatagaacgcccaattacaataagcatgttttgctgttatcaccgggtgataggtttgctcaaccatggaaggtagcatggaatcataatttggatactaatacaaatcggccatataatgccattagtaaattgcgctcccatttaggtggttctccaggaatactaataaatgcggtgcatttgcaaaatgaatttattccaaggccaaaacaacacgatgaatggctttatttttttgttattcctgacatgaagctttatgtaattaaggaaacggacatcgaggaatttgcatcttttttagatgaaggagctattcaagcaccaaagctatccttccaggattatttaagcggtaaggccaaggcttcccaacaggttcatgaagtgcatcatagaaagcttacaaggtttcagggtgaaacttttctaagagattggaacttagtctgtgggcattataagagagatgctaagtgtggagaaatgggacccgacataattgcagcatttcaagatgaaaagctttttcctgagaataatctagccttaatttctcatattgggggtcatatttttgctggtaatgtcattttctataaactattcggcagagaaaagatgcaaaacaagctggattcattatggtttggtaaagtttacccacacaacttgaagctgttatgtgaaaacttggaaaacggtaaaatcatcgacgaaatgtacagaggtggcatatcgatgaattaaaacggtttccttttaaaacagaaataaagatgaggtgaaattttatatttcttatatttaaagctatcatatattccttgtacatatatttattaagaaaatacattaacacgcctttatacttggtattattactgtaaaatcattacatgtaatttgttctgacttcgttgattgtttgaattatatcctccacttgtacactctttaaatttttggccaaaaattcctgctcattcaaggaaagtctcaggaaattttcacataaatcaccatcaataactttacgtacaggggcataatagcttctgtattcttggtggtctctacctaaaatggaacaggaaccctcacatattatttcatcctctataccatgccgtccttgtaacacaacacttccagattcctcttcatcgtcttccttacgcatattgttattcttctttcttgattcataatctaaataaaacgtatcatccgcctcagccattatattctcaatgtttcccatcataaaaacattccccttggataataaggggataaagcatcccacggttccttgtaagcccatatagatacaaccaggtctatcagaatttgaaaggctgtccaggatatggaaatcagtgatgatatcattaacaaagaagtggttcagtagttgaaacttgaacttgcaatcataagtattgggtaatttctgctgtaaagtgatgacgtctagtgggtacttgatggccccattagataattcgctgggatcatgatttgacatgattttttcgcactctggtggagaccttaaagtccacgcatttccatatctatcagcgcctataacagttgcctcatctagaaatttcaataccgtcacatggcgttttacagagtcatctacgtacggaataaatacattccccgcaggatcccagataaataaagtgacagattcatgtatatcaccaacggccagtctttcataattccactggtgcatagacacaatttttgttatggataccggggtctgtgttacggaccttcttaataattgctttttccccaaaccataaaggacaatagtggagcccatggctgtcagcaagaagtttttaaacttcaacatagcatgtattggtgaaatgatttctgtttggtgaagtaattcaatatcaaaagatagtttatctttgttaactaatatcttgtatgttaacagccttttgtcgccagcacaaatgatcaaatgatcagcttgtcttgtgaaatctattatagcagcggaaacgcaatcgatatcgtccagtatcttgtataaatgatccgaactgccaaactttaagcattcaccatcaatttgcagtgatatacggcattgtttcttaccactgtgattatcaataaacaaaatgcttttcggattattgggaaatgataaaatagtacgaggtcggaatgtagatatttgtaacatttccatttcttcttccatttcatcttcttcctcttcattgctttcatctcctccaccgttctcttgcttgttaacacttgattcatgaacgtgaaaccagttatccaaagttggaaagttggaaactctgccaatatttaagcgtcctgagctcgatattgaacaaacaccgttgattgcaacatctgcgttaacaaatttggaacaacttagcatgttttgatcctttaactgccgtatggtccacacatttttccacgtgtagcttacccatgtagaagaggaatggcaaaccacgcatgacatccatttagctccactactatttatttcttcttcttctttttcatcatcatcgtcttcttcttcttcttcttcttcctcattatttagtgatacagatatctcacgcaaatacgaaagggaaacaggcttcaagccaaggaatcgcctttttatgtcagtgaacgatccgtcaacatcccctatatgaaatttcatgtaaacgccattttctaaacctacatgcaaattaagctgtcctattgaggaatctctaaccattatcatgtcagaaatcttttcactaactaattgcaaacttattacagttaaaaaatcttccttttggtctttaagagacattattttgatcataccctcattgtcagcaatggctaataaatcagcatgctgcgtatcttgcacaatcgcaactttagagggcattgtgtccaattctgggtgggtggttaattcgattaacgaatccgaagatacatctatcttgaaataaaccaattcgtaatttgataatgatataattagttgtgttttcgaggacgtggcacatacaatacgaattcccgctggtggcacccaagtcagcttattagaatacctagatttaccagtcggtacgatatgtcttagttctgcggtgcatacttggataatagagtgtgagcccattaggcatgtatgaattgttgtgtcctgagagagcttgaaagctgaacgcgttgcttcatccggtgttagttcctccatggactcgttgtcaatttgtagtatcatagttttcttgggaaaagttatgaacaaaagagtattgttatcgccggttgttgcaggatcgggtattagccataacttggttgcgttcgggggtaaactagtagatatcaaattagagtaattcacagcatttgttaaagttattatcttgttgtttgtaaaatgtttagtggcgatagacagtggcgaatcactgacaatttgagattttattgaagggttcaaattcaattgttgcgataatatgctcaaattctgcaactttatggatggttcgaaaactagcgacttatttggatcttttgaggttaaaacattagaaaaatcatttttctctacaccaagtttctcaaactggaaaagaaagttgttattcatttcagatagtgcaaaaagataaccgtttttgaaaatgtgtaattggtgtgaattttggattgtatcaaagtaggacaattgaactaaaggtctatttctatcattagtgtctggacttacagttaacttaaaaagatcgccatggttagattgtaaaagtacgaaaaaatcatttttcaatttctgcactatgcctgatatgattgttacatttttatgacggctatttgtgatagatcttttgggtatttccactttcaggctgaaaaatccgttcatatcctttaccagaatatgattttcgaagcctatgacaacaaaagggttgaaaagggtatcatagtcagcatcatagttgttgtcgcttagcgaagttgttatattatatcgcgatagatctggcaaactcagtacgaaattggcagatgggttaactaaataatctgccttcttgacgatgtgattcaaacccaactcgaggacataaaatatcaagtgtactgatagttgagtagcggcattgtcgatttctaaggtaacaaaacatggattattgaaatttacatcaacaactgccatatccagcgttaccatatggggtctgatgatttccaatggagacgaaatcctcaatttttgagcataatcaacgaggaaacacaatttattttgttcgacagatgagagaatgatacaacgcccattagggtcaatttccatgtatgatatgggagagactcttcgaagggtggtcctcgtcaatggctggttcactaaagtcttaagtctaagagcacctgcatgcataatgatttgcacgatacttaggttaccagaatcggaagttagcgctagaaaagtgggccagttggaagcttttgcccttgaccctgaatgcggcagatccagcgacttcatcgaggttatcgtcgcaaacaggttttgaaacttggcaataagctttagttccccatctgcagtatcataaagttctaaatgcgtctcagtagctacgcacaattgcgactgctcacgcttggaccctgcttccagatcgacgaagtgtccgatgcaggagtgcacgaaattcgtctgtttctttaaagtaagatggtacaagtatagctcatcatctttagcaaccattgttatgttatggtcactccttgttcttctttcagcctctcgttttaaaccgtcataagccatcgttgtgctagcttgcccaaatagtttacgcatcttcgccgtgtggggcgacaagcttactactgccattttgccacctccccacatttaatgatggaaaatattataaaaaagcgagaaaagaagctaatggtgccattgttttcctttttagagaggggcagcagagatcggtggactttgttttgatagagggcgattgcaagcatggagatttacattagacttaacgcagatgtcgagcacgactatgcgtttcaggtgtcaaatgaagacaccataaataacaaaattaagaagattttcccttccaagacgggtttggcggacttaatggtgctgagaccatcaattttccatgagaaggagcccgtaaagttctataagtctatccatccagggtacctgtccgaaggtggttgtttgatgttccattatgaagctgataacgaagaaaatctcgaggagttgaatgactccaagccgcttattgaccagttgtggcctggtcagctagttgttccggagtggaagctatccaagaaaaacatatgggtatacaccattattatgttggcctggctatataccgatttgcccgacgccatttctccaaccccaggtatttgtttgactaatcaattgtctagactattgattcctgtagccaagcacatggatttacctgaaattgccgctaaactcgaacaagaagttcaggcaaactattctagtctcgtagctcaatggcttttctttgtcatgcacattttcaaagtgggcataattactttattcctcaaattaggcattgccaaccccatcagcttcaatccttacaagttatggagtttgagagatttaacttctccttctgctaacggcgctaagaattctggcggcaataacaacactactgacttaaagacacgtttgcgctctctgggctggattggtgctaagagagctacttacgacgattaccagactaactattacaactatgtcatagataagatgggtggtgcagttgctgcttatagagcgggcgcgattaggaaagctgcagcaccaggtatccaacttgtggctggagagggtttccaaagtcctctagaagataggttcactgcttccactttcacggctattaaaaccgaacggaaattcattttaagtgaagaatactttgtggagctggaaaacaatctaaagaagatcttggaagagtatgacggggatattggtaagatgaatgctgaaattaggaggtttagaaggtttggtatttatgaaccagatgaaaaactggcctcgctagttaagctcagaagagaaattgctgatgagaaagagaaagcatcaaacaatgatgctacttttggtataaaaaagaatgatttgaaaaaatctaattaattgtaaaaccaaaacactaccatccagactttttttttattcaaccatagcctttaactactactactactactagtactactactattactattactattactactactagagggcctttttttactcctagtatttttgtactatcctatttactctcgttgtttttattagttttttcactctttttttcaattcctcacgaatctactgttttcgtagtgcttttttttgtttcattgtttatagccatcaatggtttttgttactatcattatcattataaatatttcatacaatatatacaatatatatacaataaatgagaatcgatttacttttaatgcatttttgcagtcaaaaaaagcttcgtttacatttatatgtatttatgtttgtatttctgggggaaatatgcctttatgggcgtatatactctttcgtacgtttctacatccgagtagcagtagtaactcggtattgtgctttcgtcgccataatcaggactatcataatcgaattttttttgcgttttgttgtcaccacatatggtcccttcttcctcatcatctatcaatattcccaattcgtagacagttctacttaaattctcgtcaatgactttagacacatactttcgtagtttcaattcataccccttaaccttccttttactagacaaaaatctcggacgtataaaaatgatgaatattattatgcttagaattaatttgcttattaaaattacccatatgataaacgagaacaacatgaaggacaagatcacactttcttcgtaatttgtcttagcaatatgttttatcttgtttattattccatttaggtcatctaaattacctaggctttgagtactatgggttccgctactggtctcattcgaaactgtcagtaaaactgaccacaaagttaatccgttgattatttgccttggagagtcaccgaacaatagcctcaaacatccactgatttcaaaatatgaaaagaataaccacttactgaattttttctcatcagtcagcactattagttcgaaaatttgatactttttgaaattgaacaagcaatttattaatctgctaatgccattcatgtagttcgatgtaatctctttcttcctatacactctcaatccaattaccaactcccaaattaatattaatgaggagcataatatgcatccgctaaacaaccattttgaaatacggaattccaagaatggttggatgatattgttcgaccatgtgttaaatgccagtaatttaatacacgtgtatatatcagaaaaaaacatggccacatgtagtatcgactgacaccaggtgtatagaatatactgtaattttgtggtccacttcgcagtaggaataagatttatgtcaatatcctggaatttcaatttttgtaaacttgattccattatttagcgctttgttgtcattttcctttccctcttagacaatgtggtaaaaaatgccagctccagggctttcaattaatccattattgatttttaatctggaggtttgagcatggctgaataatttatatacaaatatctttttttattgtttcagatcattcgttttcagtatgatttactatcattcattttctttttctttaccattttacgtcgccgtcgcacatcttaaaacaaatttaatacagagttgaaagtttcagacttaaacagaatttacgcaagaaagttttcaaagtcctaaagtaaaaacgcgccttccacagccatttctttgttcaacaaaaagttttggcccttactgctattggatacttggcaatccgtctttcgttatgccagatgaaacaaattttacaatagaagatattgagcctaggcctgatgcccttcgaggtttggacacccagttccttcaagacaacacagcattagtacaagcatatcgtggtttagactggtcagatatttcttcgttgacccaaatggtagatgttatagagcaaacagtggttaaatatggcaatccaaatgattcaatcaaattggccttggaaactattttatggcaaatattgcgtaagtaccctttattgtttggattttggaagaggtttgctactattgagtaccagttatttggtctcaagaaatcgattgctgttctggccacctcggtcaaatggttcccaacttctctggagttatggtgtgattatttgaatgtgttgtgtgttaataacccgaacgaaacggattttattaggaataattttgaaattgcaaaggatcttattggcaagcagtttctatcacaccctttttgggacaagtttatagaatttgaagttgggcagaagaattggcataacgttcaaagaatatacgagtacattattgaagttcctctacatcagtatgcgcggtttttcacatcttacaagaagtttttaaatgaaaaaaatttgaagacaacaaggaatattgatatagttttacgaaaaacacaaacaacagtaaatgaaatttggcagttcgaatcgaaaatcaaacagcccttcttcaacctgggccaagtgttaaatgatgatttggaaaattggtcgcgatatttaaaatttgtgacggatccttcaaaatccttggataaagaattcgtaatgtccgtttttgacagatgtttgattccttgtctttaccatgaaaatacgtggatgatgtatattaagtggctaacaaagaaaaatatatccgatgaagtggtagtggatatataccaaaaagccaatacgttcttaccactggatttcaaaactttgaggtatgattttcttaggtttttgaaaagaaaatatcggtcaaataataccttattcaataacatattcaatgagacagtatcgcgttatttaaagatttggcccaacgacatattacttatgacggagtacctttgtatgttgaaaagacattcttttaagaattccttagatcaatcgccaaaggaaattctagagaaacaaacatcgtttactaaaatcctagagacatcaatcaccaactacatcaataatcaaattgatgccaaggtgcatttacagaccttaataaatgataaaaacttaagcatagtcgtggtagaattgataaaaactacatggcttgtacttaaaaataatatgcaaacaaggaaatatttcaacctttatcaaaaaaacatcctcattaaaaattctgtaccgttctggttaacttactacaaatttgaaaagagtaatgtaaattttaccaagctgaataaattcattagggagcttggggtagaaatatacttgccgactacagtaatgaatgatattttgacggattataagactttctatttaactcattcaaatatcgtcacgtatgaatcctccattatagattcaaatacatttgaccctatcttgtaccctgagctgaaaatgtcgaatccaaaatacgatccagtattaaatactacagcaaatgtagattggcataaaaagacggaatggaaggaggctggtcacatcggcataacgacagaaagaccgcagatatccaacagtataattgagtgcaattcaggaactttgattcaaaagcccatcagtttgcctaattttagaaacttggagaaaattaatcaggtcaagattaatgatctatacactgaagaatttcttaaggaaggtaaatgaaattaatcataaatcataaattatatttaaaataataatttactcggccggaccccgaaggagtacccaaatatttacttgtttataatttattattgaaaatgttttattctatattggtagagttaataaataattatataataaattattgtatgataatataaataatagtttatgtaatattttaagttattatttataataaaaaagtaactattgaacctgttaaattaaaatatattcaaaaaacattagaggttggtaagattctattaaatcgcagaaatcaaataatatgaagagtaaaacaggtagatgaaataaatttattattaatttagtttacgtaaatcgaaatgacaggccttttctgtgttttttgatggttatataatcagaaaaatttgataaatattgtttatatgtaaagactattaatgattgtttctatcgtcaggatattttgaaaacgtccaaatatgtaaaacaacttctaaacattaaatatttttggtgaattaaaaaaaaatatgcgcaagcccggaatcgaaccgggggcccaacgatggcaacgttggattttaccactaaaccacttgcgcgatctttattggtatttgttggaacatagagttaactaaccatatataacaacttcttaaatgcacagtacagtctattcaaaactgtagctatgcgctgcatcttgtggcaaactcgaatggaattgtgggtttgctaggtctctgtccatctgtaaacaatatttcccgggaacgggcaacaaaggtaatgtttatatgtgttggaataaaaatccactatcgtctatcaactaatagttatattatcaatatattatcatatacggtgttaagatgatgacataagttatgagaagctgtcatcgaggttagaggaagctgaagtgcaaggattgataatgtaataggataatgaaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctaattacccaaatatatctcatggtagcgcctgtgcttcggttacttctaaggaagtccacacaaatcaagatccgttagacgtttcagcttccaaaattcaagaatatgataaggcttccactaaggctaactctcaacagacaacaacacctgcttcatcagctgttccagagaacctccatcatgcctctcctcaacctgcttcagtaccacctccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtcagatcactgatgatgaactcaccttcttgtataacacttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgccaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatccgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcatcttaggccagaaacttactgaatctacagtaaatcatactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacggtctgacggcactgtacttgcacctatcgtaaaatatggagacttttactgggtatctaaaaagtacttgcttccatcaaatatctccgtacccaccatcaataatgtccatacaagtgaaagtacacgcaaatatccttatcctttcattcatcgaatgcttgcacatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaaaagtgcaccatcctatttcatctcatttactgatgagacaacaaaattccgttgggtttatccattacacgaccgtcgcgaggactctatcctcgatgtttttactacgatactagcttttattaagaaccagtttcaggccagtgtcttggttatacaaatggaccgtggttctgagtatactaacagaactctccataaattccttgaaaaaaatggtataactccatgctatacaaccacagcggattcccgagcacatggagtcgctgaacggctcaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcaatcgttcattgcgtcaaatgagatccaacaatccgatgatcttaacatagaatctgaccatgacttccaatctgacatcgaactacatcctgagcaaccgagaaatgtcctttcaaaagctgtgagtccaaccgattccacacctccgtcaactcatactgaagattcgaaacgtgtttctaaaaccaatattcgcgcacccagagaagttgaccccaacatatctgaatctaatattcttccatcaaagaagagatctagcaccccccaaatttccaatatcgagagtaccggttcgggtggtatgcataaattaaatgttcctttacttgctcccatgtcccaatctaacacacatgagtcgtcgcacgccagtaaatctaaagatttcagacactcagactcgtacagtgaaaatgagactaatcatacaaacgtaccaatatccagtacgggtggtaccaacaacaaaactgttccgcagataagtgaccaagagactgagaaaaggattatacaccgttcaccttcaatcgatgcttctccaccggaaaataattcatcgcacaatattgttcctatcaaaacgccaactactgtttctgaacagaataccgaggaatctatcatcgctgatctcccactccctgatctacctccagaatctcctaccgaattccctgacccatttaaagaactcccaccgataaattctcatcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacggacaaccttaagatacgatgaggcaatcacctataataaagatattaaagaaaaggaaaaatatatcgaagcataccacaaagaagtcaaccaactattgaaaatgaatacttgggacactgacaaatattatgacagaaaagaaatagaccctaaaagagtaataaattcaatgtttatcttcaacaggaaacgtgacggtactcataaagctagatttgttgcaagaggtgatattcagcatcctgacacttacgactcaggcatgcaatccaataccgtacatcactatgcattaatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgataaaacagtgtggtatggaagaagttcgtggatggtcatgcgtatttaagaatagtcaagtaacaatttgcttattcgttgatgatatgatattgttcagcaaagacttaaatgcaaataagaaaatcataacaacactcaagaaacaatacgatacaaagataataaatctgggtgaaagtgataacgaaattcagtacgacatacttggcttagaaatcaaatatcaaagaggtaaatacatgaaattaggtatggaaaactcattaactgagaaaatacccaaattaaacgtacctttgaatccaaaaggaagaaaacttagcgctccaggtcaaccaggtctttatatagaccaggatgaactagaaatagatgaagatgaatacaaagagaaggtacatgaaatgcaaaagttgattggtctagcttcatatgttggatataaatttagatttgacttactatactacatcaacacacttgctcaacatatactattcccctctaggcaagttttagacatgacatatgagttaatacaattcatgtgggacactagagataaacaactgatatggcacaaaaacaaacctaccgagccagataataaactagtcgcaataagtgatgcttcatatggtaaccaaccatattacaagtcacaaattggcaacatatatttacttaatggaaaggtaattggaggaaagtccaccaaggcttcattaacatgtacttcaactacggaagcagaaatacacgcgataagtgaatctgtcccattattaaataacctcagtcaccttgtgcaagaacttaacaagaaaccaattactaaaggattactaaccgacagtaaatctacaatcagtataattatatccaataatgaagagaaatttagaaacagattttttggtactaaagcaatgagactaagagatgaagtatcaggaaatcatctgcacgtatgctatatcgaaaccaaaaagaatattgcagacgtaatgaccaaacctcttccgataaaaacattcaaactattaacaaacaaatggattcattagatctattacattatgggtggtatgttggaataaaaatccactatcgtctatcaactaatagttatattatcaatatattatcatatacggtgttaagatgatgacataagttatgagaagctgtcatcgaggttagaggaagctgaagtgcaaggattgataatgtaataggataatgaaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctaattacccacatatatctcaatatgctatgttctttattatcaatatgcaaaatattactctatgaagtataaatatatgtactgcttatatacatgcatgctttttaattacacttaaaaacaaaaaatgttttaagtttccctagttgaaaccaagttattaaagtttactagtttgttcactcacttgagtcttcatcactgtaatgcatttcgtccaacccgttgtcctccggcgataaatccatcagctgcgtatctagaaattctgcatttgtttcatacacgtctccaaaagagttttccactgaactgttatcaatgctatcatatacgttggctacatccctctcttgaatgtcttgtgcttcgccgtacagtcttgactcgaagcttttcagttgattttcaattaacctgctagggacggcaaacccacctttatctaagcaaatttttaaaaacgttctcacgtagtgaatatgttttataacctggttgatctttatgtctctatccaaaccaattaggtcattatttttgttgtcattgacaaattgcctcgacaatgtatcggccttcaataaatgacaagatgcataaatgaaccaaacttcagcgtcttccataaacggaggggtcaatacccattctgatatcttatcaatcaattcttgtagtaaatcgttttccgtatcaaaaggtttgtcaatgatgtttgatgatggttccatagatttttggcaattaattaaagaagaccaaaggtacgtgatagcaaatttcgcagtatgtgttctagaaccggtttgaaaaggagggacaatggaacggtaattgatgttctgaacaaatcttgactttgacgaatagatttgacacatccattgtaagaagtcaagaccacttgatgaatttgataaattatccagtatttcaacgccaatgccccaaagagacttgatttgaacccctgggatccttattaatgtggcgaatattttatatgcaagcgaccagttatgtcttgacacattcaaatgcaaaaggtcggttaatgttactatatgtcttgtgcggtagtttctgacttctgatgttgatgtttttaatggctctaaccctctagatatagattggaagtaaagtttattttcctttgtacaatgcaaaagtggaatttccattttccttaaaggaatcttttcaatttttttaaaattatgatacgtcattttttgtttgttaatgggctgtttattttgtgaggacactgttcgccaaatttcgaaactcttctcaggtttttcgtattttttccaaaattttctctcctcatcactatcttccttgtctatcccggtgtcatgttcgccaccttcctcagtttcctcctcttgagagtctgtttcgctttccgtagtagagtaaatttcaccgaccacactcctccaatgcctttctcttcttcttttcttctgctgtagtactgacctcctatatgtgccggcttcactgttttgaccttcttcttcgtcattattttcagctgcagaattttcgggcgttggcaaactatctgtggtagtagatttcttggaaattctgtcaaatcttctagaaatgtaatttatgtattgatactttaactttcttctttgagcaaacttcctattagttaaagttatagggacttcaaacatggtttatgcatcatattagaatttaattctaactttattcgtgcttcaatttctttcttctttttctttaaaacacttttttattgaagaatgctcaagtataacccactcaaaaatataattggcaatgaaaatataacttttttagatgttagcgatgctatatcatctgagatgagatgagatgagatgtttattatgatccatttcttttctttttttattttttttttttttttttttttcatttttcaacgcgggtaatagagaatacatccactgtccgggtaaattatgttacagttagcgcttaatgttcacttcacagtattatgagctgtttttgtaataaagacgactataacataacaaaaaaaatcaactctcgctagaataaagtaacataattactaaaaggtggctaagcaacatatcggtccaactttttcacctcttctcaacgctgtttcagagtacatttaatttccgccatatactcgaataagtggctaagggagagtccgaagagcgtgctaccaattcttcatctcgttaacaaactggttctccgttaaaaattgtgctatatgtcctataagccaactctatctatatcttttcttttagtcctactttggatactgttaccaccattttagattgctttttcttttgccgctagccttacaatatttggcaaactttttttttttagccgccgagactcttgatctatggccgggcgaaagggcaaatgactgcttatccccgccatcacttccccccgcccaagggtttagaattggggattaagtaaaaacgaatgactattcctctcaaagtcatccttgttcgacaaaaagaatggaatataacatattggaacaatttcatcctcttttccccattttcgcatataagagcaactaaacgccggtgagtaaagtgcccttccctacagactcttttactcaggtatatatatatatatatcccttaaaaactaaaaagaaagcactcatgaggatctgtcattcgagaactctctcaaacttaaaggatcttccgataacgtcaaggagagcaatgcattcggccattgtcaattactccacccaaaaggcccaatttcccgtagagacaaataatggggaacactattgggcggaaaagccgaacaaattctaccagaacaaaaggcccaattttcaaggcattacctttgctaaacaacaagacttaccatcattacccgtgcccgaattgaagtctacacttgacaagtatttgcaaaccatccgcccattttgcaatgatgtagaaacttttgaaagacagcagctgttatgtaaggacttctcggagcacatggggcctatcttacaagaccgattgaaagagtatgccaacgataaaagaaactggatggccaagttttgggatgaacaatcctatttacaatacaacgatcctattgttccatacgtctcttatttttattctcatatgccattaccgaatcatttatcgaagatcgataatgatcctttgattaaggctactgcgattatctcaaccgtggttaaattcatcgaagctattaaagatgaatctttacccgtagaaattatcaaaggtatgccattttgtatgaatagtttttcattgatgtttaacacttcgagattgcctggtaagccagaggataaccaagatacaaatattttttattcagtttatgagaacaactttgtaactatcgcttataaagggaagttttacaaactgatgacccatgacgggaatgacaaaccgctttccgaaaacgaaatctggaggcaactgtactctgtggtattccaaggatcgcagtccgatcccaaactaggtggcattggttctctcacctctttacctcgtgatcaatggcgtgaagtacatctggagcttatgaaggatcctatttctcaggattcactagaaacaatccataagtcttcctttatgctatgtttggatcttgaccaatcccctgtcactttggaagaaaagtcaagaaattgctggcacggtgatggtattaacagattctacgataagtctttacagttcctggtcaccggtaatggttcatcaggtttcttagctgaacactcgaagatggatggtacgccaacattgtttttaaataactacgtttgtcagcagttgaataaactagatgtggatgacttcatgagaaaagtaattacgccatcatctacggtggcaatgaaacctatggaactgcccttcattatcacaccgaagattcataaagcaatcgaatctgcccaactacaatttaaggaaacaattggtgagcatgacctacgtgtttggcactacaacaaatacggaaaaacgtttataaaacgccatggcatgtcacctgatgcatttattcaacaagttatccaactggcggttttcaaatatctgaaacgacaactaccaacttacgaggctgcttccacgagaaaatacttcaaaggccgtactgaaactggtagatctgtgtccaccgcctccttagaatttgtttctaaatggcaaaatggcgatgttcctattgcagaaaagattcaggctttgaaacattctgcaaaagagcattctacgtacctgaaaaatgctgcaaatggtaatggtgtcgatcgtcatttcttcggtctaaagaatatgctaaaatctaatgatgaccaaattccgccccttttcaaagatcccttatttaattattcttcaacttggttgatctccacatctcaactatcttcggaatattttgacggttatggttggtctcaagtaaatgacaacgggtttggactggcatacatgttgaataacgagtggctgcatatcaatattgtcaacaaaccagccaagagtggagccagtgttaacagattacactattatttatctcaagctgctgatgaaatttttgacgccttggaaaatgagaataaacgaaaagcaaagttatgaatttttcacctttcctcttcaattaatttgtgaatatttttgttaagtatctacacttacatacgtataaataggggagaaaaaagggcttacgaatacatactgatcattactatctatttctgcacctagtttcattatgcaatttaaaacaacttacagaacaaatcttatttccacaattaacgcaacttgaaatactatcgtagccaccgcaaatagagcatgtcgtaattaggggtaacactttgaagtatcgtttattgtaaacattgtggtaaatgacattcttatccatcaagtttagcagcgcagaatctaaaaacgaatgtaaatttctttttgaacttaaaaccttctttaacgccacaatacgattggtattcttcctctttggtttaggtagttttgtagatttatacgataattgtatttcccgtaaggtttctggtttaagcacccaaccatgaccatacttggaatgctcttttacaaaagaagaaccacccattaatgcagagagaccatccgaggtctgtgagatcggtttggttgttgattcaattctatctcgtggtacgcctgtgagatcacttaataaagtcggtacatttggtaaatccgagaaattttctgtgttaagttccataaacctcctgtccgactggagaatctcttgttgtgtgtacctttcttcaaatgaatgggaattcttactatttcggtcatcctgtctgcttatactattgccatctccctcagatctcgaagtatataacctggcctctaaatctgccagtgagtagtttatgcgctttacgggcctagaggtggatattgtgccttgcttattaatcttctttgaagtatatcgacgtgcttgaggatccaatgacgtgaaatatatgtcaggattgtaagttttcttatcaatctcttcaactagcgccttcatttcgctgttatgagtaagcgatccgttctttttcttcgatctatcaatgatatcgacgttactatagattgaaagggccgcttcgacttttgttaatactcacaaagatcatcatgttcattataaaaaaagtagttattaattatctattacccggatcaaagttatttctacagaacacaaatattttattgattgcttcgttacataaagcaacgactaaataaatataagctctctagctattccaccgacttcacttccttaatgaatggtcgtttttgtaatactccaaaaaaaatatcaaaaaaaggggcgagctgggaattgaacccagggcctctcgcatgctttgtcttcctgtttaatcaggaagtcgcccaaagcgagaatcataccactagaccacacgcccttgtgaacttgtgaatcttagccactaaggaatcaccgaatagtaaaagttttctgacaactacaatattaagcccttaacaacaataatgaatattgagtgcataatgttgaaatggaactctaaaatatcatttgtttagtagtattcgtgttactagttgttggaatagaaatcaactatcatctactaactagtatttacattactagtatattatcatatacggtgttagaagatgacgcaaatgatgagaaatagtcatctaaattagtggaagctgaaacgcaaggattgataatgtaataggatcaatgaatataaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctcaacattcacatatttctcatggtagcgcctgtgcttcggttacttctaaggaagtccacacaaatcaagatccgttagacgtttcagcttccaaaacagaagaatgtgagaaggcttccactaaggctaactctcaacagacaacaacacctgcttcatcagctgttccagagaacccccatcatgcctctcctcaacctgcttcagtaccacctccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtcagatcactgatgatgaactcaccttcttgtataacacttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgccaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatctgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcaccttaggccaggaacttactgaatctacggtaaatcacactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacgatctgacggcactgtacttgcacctatcgtaaaatatggagacttttactgggtatctaaaaagtacttgcttccatcaaatatctccgtacccaccatcaataatgtccatacaagtgaaagtacacgcaaatatccttatcctttcattcatcgaatgcttgcacatgccaatgcacagacaattcgatactcacttaaaaataacaccatcacgtattttaacgaatcagatgtcgacaggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaaaagtgcaccatcctatttcatctcatttactgatgagacaacaaaattccgttgggtttatccattacacgaccgtcgcgaggactctatcctcgatgtttttactacgatactagcttttattaagaaccagtttcaggccagtgtcttggttatacaaatggaccgtggttctgagtatactaacagaactctccataaattccttgaaaaaaatggtataactccatgctatacaaccacagcggattcccgagcacatggagtcgctgaacggctcaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcaatcgttcattgcgtcaaatgagatccaacaatccgatgatcttaacatagaatctgaccatgacttccaatctgacatcgaactacatcctgagcaaccgagaaatgtcctttcaaaagctgtgagtccaaccgattccacacctccgtcaactcatactgaagattcgaaacgtgtttctaaaaccaatattcgcgcacccagagaagttgaccccaacatatctgaatctaatattcttccatcaaagaagagatctagcaccccccaaatttccaatatcgagagtaccggttcgggtggtatgcataaattaaatgttcctttacttgctcccatgtcccaatctaacacacatgagtcgtcgcacgccagtaaatctaaagatttcagacactcagactcgtacagtgaaaatgagactaatcatacaaacgtaccaatatccagtacgggtggtaccaacaacaaaactgttccgcagataagtgaccaagagactgagaaaaggattatacaccgttcaccttcaatcgatgcttctccaccggaaaataattcatcgcacaatattgttcctatcaaaacgccaactactgtttctgaacagaataccgaggaatctatcatcgctgatctcccactccctgatctacctccagaatctcctaccgaattccctgacccatttaaagaactcccaccgataaattctcatcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacggacaaccttacgatacgatgaggcaatcacctataataaagatattaaagaaaaagaaaaatatatcgaggcataccacaaagaagtcaatcaactgttgaagatgaaaacttgggacactgacgaatattatgacagaaaagaaatagaccctaaaagagtaataaactcaatgtttatcttcaacaagaaacgtgacggtactcataaagctagatttgttgcaagaggtgatattcagcatcctgacacttacgactcaggcatgcaatccaataccgtacatcactatgcattaatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgataaaacagtgtggtatggaagaagttcgtggatggtcatgcgtatttaagaatagtcaagtaacaatatgtttatttgttgacgacatgattttattcagcaaagacttaaatgcaaataagaaaatcataacaacactcaagaaacaatacgatacaaagataataaatctgggtgaaagtgataacgaaattcagtacgacatacttggcttagaaatcaaatatcaaagaggtaaatacatgaaattaggtatggaaaactcattaactgagaaaatacccaaattaaacgtacctttgaatccaaaaggaagaaaacttagcgctccaggtcaaccaggtctttatatagaccaggatgaactagaaatagatgaagatgaatacaaagagaaggtacatgaaatgcaaaagttgattggtctagcttcatatgttggatataaatttagatttgacttactatactacatcaacacacttgctcaacatatactattcccctctaggcaagttttagacatgacatatgagttgatacaattcatgtgggacactagagataaacaactgatatggcacaaaaacaaacctaccgagccagataataaactagtcgcaataagtgatgcttcgtatggcaaccaaccgtattataaatcacaaattggcaacatatatttacttaatggaaaggtaattggaggaaagtccaccaaggcttcattaacatgtacttcaactacggaagcagaaatacacgcgataagtgaatctgtcccattattaaataatctaagttacctgatacaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacatttaaactattaactaacaaatggattcattagatctattacattatgggtggtatgttggaatagaaatcaactatcatctactaactagtatttacattactagtatattatcatatacggtgttagaagatgacgcaaatgatgagaaatagtcatctaaattagtggaagctgaaacgcaaggattgataatgtaataggatcaatgaatataaacatataaaacggaatgaggaataatcgtaatattagtatgtagaaatatagattccattttgaggattcctatatcctcgaggagaacttctagtatattctgtatacctaatattatagcctttatcaacaatggaatatcagcaatcatcagatgaatgttaaaattgtgtaaggatgctcattctgtttcgttaactttccagttttctcgaggacttctggttcattatacgtgaaattatttacctaaccaaaattatcaaacaattcttccttacttcagctaaagattcggcgagacagaggttgaacacaatgcaagcgcatcgatatttttacggccgcagttgaatggatccaaaagcattggccaatttaaatgaaagaaataagtaaatttctaaagatttatctaagtgcctcttctttcctgtattcaataatttagtgtctaaaacgcaaaggtataaatttgataatgttcttttattaactgtcaataaagtatatatgaaaaagtgtgaagaaccttcgtataaaatctatctagtaaaatatttttaattatgtgcggatgtattgtctattcccatgtgctttgcttatgtcctgttagaggacttttaagtatgctgtatacatgttttaaatttttgcctttattctttctctctcttactatatcgctctcagacctgctgggatgaacgactaacgttttgagcaatcatatcaagctcatactcttgatttgttaggtcgacactaatagaatatggtgcgattttcttgcttcctaactgttcgaagtcttgaaatccctttaactcgttacgattatcttgtgtcgaaactgaatgatatttttgtaatagatcttgcttatatctgaagtaattataatagcatacatctgccataataataagcattcctaaccaattgtaaaaaccacttaatctttcagaaagaataattataccaaatattaccgtcaaaagttccttcactatacccacaatagatacggtcagcacgggcgtttgctccaaaatactaaactcacaaattgtcaacaaaaagactgcaaaaccaggtaaaattaacaaaacaatacccctcacaatggataggacggtagtttccgtgccgacaccgccattgctcgtatcaagcctaaatatgctagagctgaatataccaggaaatggtttttccacaagtagcgaggtaagcaacagagtaatgcccattataggagctaactggtggattgtatgaattgggtgaggcttggattctccaaaattctccagcattttgttattggcgaggttaacaacaggttcattatcgacattatcttcattttccgtgaaaagggcaccatcagattcctctactgctgcagcggtgttagtttgaattgggttgttcctaagcatcaactgcgtataaacccaccttaacccagaaagacagctacttgctaggacaagaaagctgccaaaaatgaccaaggcttggtcgtttttggtactggtggaatcgcttggtttgaaaaccattaatgctacaccaacaaacataattattactgaaagtgccaacttccaatgaaacttttctagcttgaagatacagccgaataaaaggacaaaagctatgctcgaagatttgataattgtataaattgtcaagggaacatactggaaggaaacgttactgagcccgatatcacctgcagaagcgactgccgtagggagtaaaaattttagaaaaaaactccagttaaaaccattattctttcttaaaacgtttttcactggcttatgcctgagcttaatgtatatgccggatagtaaccataaagtagcctgatggaatgttgtcaccaacacgggatacccaatacccaatccgtccttcggatcgaacatccatctattgtatatggagagagctattgaacagaaataccatccaaatacaaatgccaaaaagacagtcctattcatagcaaaatgtgacacgagaattgaaggtataaacactcgctgtaacaacttcaagtgatcgtggaagtgatgaaaatgcagttatgagtataatcaggccaattgacactttaaaaaaacagaacaacagcttctcgtgatgccactatcccttatatttccagttctaagccatctccttctcattctcgacaaaaaaaatgggtgtgattattttgcgctttattttttggcgtctcgtcgccgatgactctaatagatgttgaagcctacaagcatctattatattttcttctttggttgtaatgggatgaatgaatctagagttaatgaaggagtgctggcaatgctgggctcgctggatggatgataactagattgtgcaggtacctgttcaaatccatcaccatcatcatgttcactgcatccagtgttagtaactgcgggctcgtgtactttgggttcagcttgttgatcactcatactctcttgctttgattggatggtatttttatcactgaaagttgtatcatcgtcaggtgataggccagatttttggcttacctcatcctgaatttcatttttggcctctataggcttttcggatttcttttttgaacctgatttagaaccagaatggccccaaaatccaaaaaaactcttccttttcgacttatttttctttgtcttatcaccgtctgatttcttcttttctttgggcaattccttaacaacgaatttctgtagcgggtccactttgaaatcggaattagcccacgtagaaggtttcttgccatcagctgtatgtgcctcatttctctcaaatctttcttccaccatccaacttttgctattgggctttatacacttatcaatctcagcagaagctctatcaaataactgactggtagtagtaattttgggcttgttgcttcctctgctcggagagccctgcttgaaggttgtatttatagtttcttgatgagaagtaggtgctacattatgactccaggaaaatagaactggcccatccagctgtaaagcgccagaattcatagttatggttttttcctcatcaatccaatctctttgtatttgccgacatttcccatcaagtttgtcggtactcaatttattccccatttgcataggtgaatgaaacaaacagttcatcaaccgcctaccgttcgctacttcatctaataacccatataacgacacatctccatttttggcttgctcggagtcatcttgcggtgtgtattccttactgaacaactggtcgattattttgttttcgtccataatttgtccttcccaaaaaataaccagcttagattctgacaatgcttgtttctttaattgatgatctgtaatattcgttgatcattaataccattgatttcaatatttcatgtttaatcttttgcgcgaaaatttcaattgcaaaccaaaatatacatcaacaatcttttatcggtcaacaaatttgtcgatataaccaaatatacgtcgtcgctgcccattatacaatcatcatggtagtatccatcataccgcaatttcctgatatcaaggtttcactagcattgtttgaacaggttaaaaatgctaaagaaatacgctctaaaatgagtgaattgtcgacatcctttgcctttattgacccccggttagtctgttcgggggagcagatgtattctgcaatttacaagaccttaatagaagtgaaatataacaagatgagaacaagaaatttgaattccgagtgcgtactatgtctttcacccacttccaatattagtgatgctttcctcaaattcggaatcaaagacgattcgtcacagttaatatgccttaagttccatactaatactgacgatgtagacaaagagcaattgaggacgattatgacttctatagtaaaaggacaagagatcgagtttaatgatgacaatttatcgagattttatgacgaagcgctcataagaaaagtatgttttaataataaattcgaggtaaaaacttcaacagcctcaccagaaacacattgtactaacttcacctttgttttccttttattttgtttttacctattagatctataaattaagtgatgatttcaagccccaagacgtaaatggtctctcaagagctttggtagacgctattcaattgaggggtgtgtagataagagatatctaacgataaaattataaaaaaaattctttgattatttttcagattagtattatttgttctccgtgaagtcagtgtatcgaactgccaaaagttctccttatatacatgtgcgcgtataaccatcacttttcttcaatggttctcttgaaattggcaaaatgattaactaattccagttcagttgataatgtatcgtatctgtagttaattctaatatcaggaacatttgttctaaccacatcgttaccttcaacaccactcttgtcaaaatctttccctatccaatgttttttgatttgtgcttcccacccactttgcaacacggaatttcttgccaattcacacatatctacattagacaatttataaatttgtgctgcaactgagtattcttcgattaatggttctctggtatatgagaattgtaaaggatcatctgtggatagtgagacattcaaacctcttttaaagtatctcggaaatgggtttttatcataggtcaaaaataatgcgttattagaaaggggtgacattgcgataccaacctgatctaaatagtataagtattgaacaaatggaactttcctcaataaaataccatgtgatataccatgtgccaatagatatgctgaaacgagatgctcggggtcaccggcttcaccacaatgtggtctcaaaaccaaagtgttaaaccctctcttagccctccattgattcaaagacgcgacatttgaatacaaatagtacaggtaataggaataaggagggttttgaggagcctcccagagtgatggcttgggatatttcctatgaaagcggcgatcaaccttggattcatcatcgacagaatcaaacccaattactctctgtaaaaatacatgcaattttggatgagactgaggatttttggtcacttcaaatagtggctgaaacagattcttacagatgtcctggaagctttgaacaatgccagttttcttgtaaatatcatataacctcggaatttggactaaccaacgaacattatgggaaataactttgttgtcaatcacccagctagctagtttatcccattcatcgagagacctgccataaacagaaattctatactcacagttttggtattttgaattctctaaatcgaatatgacttgtttggtaatgtcagccaagtaggtacccttgatgtagttgtttgtcttcaaaaaaatttctctgagacgagattcaccgatagggttatattttaagttgaatttatcgaatctgtggaatgtatccttatgtgcatgcatatctaaagtatcgatggataaatcatatccagtcaaatgcaaagaacggaatacttcgtctaaagttagtagtttcccgtccctgaaaataaccttttcatctttggaatgtctcaatttgtgtttaatgaaacgtaataagtgcttttggttcatacaagcagaatggtgaacgtgagtgtccactttcctaacattataaaaatccctgtgtgggtttcttttggaaacgctagtttcttgatattcgttcaagagatagtaaagattccagcgtgcttctaggtattgcagccttctataagcaaatgatttagcgggaccgtctgatgagatggaaatcattttttctagatccagatagtagtcacgaagggtagggatttgagcaattaactcatccgtcttacctgatctgtgtaccacgtacgagtcgtcatcgttgagggtaaattcccaatctggatcctcaccaggaatttcacatttcgtaaaatcgaaaacttccgcatccggcttgtttgttactggcacaacagtcttagtgtctgagttgtatgaaggtttaggtggtggtggatagactacccagcctggcttattttttgggttttgatcatcgttttgcacagatatggtctgatatttggctctcaaatttctacactctgccactttggaatacaagtcaatcaactcggaagagggatcatcaagaaactgctgtgaagcatcatcagccaacattcccattttataggaggcagaggtacgtacctgcttattcactaccggagcgccggcaaatgacttgagcgtctctggcaagatatgctgagcactagcagacaaggtcctcggtttacccccggaattttgagatgcatggtctgccgagtcatggcccttattcatcgctgctatgttggaagagctacaattggtagaatgcgatggttgctccaagatggcagagtgagaatcatgctcatctagggccaactgtttggtgccattttccaacaactgctgattctcgtgatacgagaaattagcattccgagaatcagcagctaaactttcgtgtgaatcttgctgctctaaggggggtgtctcatcatccactacgacaccagcttgttcatcaccaatctttctttgatctatgtcaatgactagtcctgaaccatcttgttcatcgtgtgaaggagctggttctagagaaaggtcgttaagcctctgtgtagcctgattgtccataattttttttagaatgccccctttttatttgttatataatttattaatctggcgtactagcagttcaatcgagttttgctgaatcaaaattggctatagcagggagactataataaaaatactattaatatccgataattgactagtatacgagaaacgctgctaattctgcctgtagagagagagaagaaaagtcgtcaagagatgccttttttttttttttaaaatttatctattttttgataatatcctttaaaccttgtgctactagaactcctttctcatcatcgccaggcgcaaaaaaaagatgaaaaaggaatgaaaaaagaaaagagaagacccccacgtgccctaaaaataaagttagggcatctataaaataactaggatatatatattgatcaccctgaacggaaatcaagggttttaaagagccctcaaaattactgttttaggaagccccctttgtttttgttttggtttcaatttgtggtggctaatctggacatcgatctacttgtatagctgtcaatatactatgcggaatacatggaagagaaatagtcctcagtcattattaatagtagactgagaccatacggagtgaacgtagaggccagaacaacaaacagtagaacggtagcagtactcagttagtgccgcgatgaatagtgacttggagtatttagaggacggttttgatccgaattcaatgaaagttgcgactttgaggaggatattggtagaaaataatgtcgatttcccatctaatgctaggaaaaatgcgctggtggggctgttcgatgaaaaggttaaaccgcagatcccgcagttacggaaaatgtatctgaacgttcggcccagcgatgaaggtattgtgaaaatggaccgtccctcatcttccccatctatagcttcccctcgtagaagtagacgagctcgcagggagaaatctgcttcccccatggccaaacagtttaagaagaatagaatactggatgatgtaagtaatgatgatgatgatgatgatgatgatgatgatgacaatgataaaaaagacgatcctttaattgtacctagtggaacggataccgatgaagtggacgatgaagaggatgatgtgataacatcaagctccaacaaatcagacaccaatgatttccagcaaaattccgatactcgtaagaaaaggaaagaccctgattctgacgactggtctgaatctaattcaaaggaaaataaaatcgataataagcatttgaacctcctatcatcagattcagaaattgaacaggattaccagaaggcaaaaaagcgtaagacgagtgatttgaaccaagagcatggaaatggctctgccattttaggaaaactttccgtcaaaacaccaataaagaacacaaatagaaagccagtaagcatggataattttaacgattcgttgacttcaagcggtacggaaaatgatccatttgtaccgaacatacgacacaatccaaaagagctcggaactgccaatggaacaggccatagcacacccttgagtaagttaaaagtttctgcctcatttgcggataaattgcctcaaaaggaggtaccatctacaatactggttccagaagtggaacagcaagaaccttctcagagtgaaagaacaccgtctttgttttcgtccgaaggctctggctcagagtcggaagcacccttgcttccagagatcaccacgccaggtcctcatcagcctatgggtaataccagcaataatgtggtcgaaatgatagatacagatagtagtaacttggtatcggatgaagatgaagttttagtgcctacaaggatcgagactccccaattacccacagagaaagacgtcgaaaagtgtgaagcaagagtgcaagaacttcaagaggaagtaaatgagcaattagagcatgaaaatgggagtgaatttgatgttaagcaaggatctgggaaggtcgggaacaggcataagttcaaaagagcactcaaatttttgagcaaatcattactggcgctatttttattttgcatattcattgttattcctctcttatttggcctctggtatagagagcaaagactgctcataggttactgtgggcatgaagtaccatcccatcgagttagtggcaattccttcgagtttattcaaaaactggataatttgttgcaggactacagaccgaaatgtatcccttgtccacccaatggtatttgttatccttatttgaaacttaaatgtaagccagattacaagttagcaccatctagacttgactttttggaaattattcctgcacaaggcaaatgtgttaaagacgacaaaaaacagcagttagtttccgaagtggttgaaaaatctttagagtttctgagagccaaaaatgcacaaatttcatgcggtgacggaaaagacgacatcgagagtggtatgacggaagatgccctctatcaaatatttaatgaggctagagctccttggattcgcgacgatgaatttgaggacctgtggatccaagttatcaaagatttaactgaagaaccagaaatattatggaggcaagtgagtacaatttattatcttacaaaaattattaaacctgttattatatgataacagttttaattttttttgaatttttttttgtttttgatttatttactaacatcttttcctaattttctctagttatcacccactgacaacaacattggcggaaattccaacaacatcattaaaaccaatgacgttccgagacagaagagacatcttccagaaaaattcatctccaagacgaggaattttcggtcgacgtccaagaaatacattggaatgaagtgtcgatttgaaagagaaatctaccaaacgtataaaaaatttcaaaggccaatatggctaatgtttttactgatagtcattagtaaagtaatcgagatcaagctgaagaattattatagaaagaaggcaagaattgaagaactcgttactcaaaccatggaaaaattgaaattccaaaagattaaatcaatgtccgatccgaaagaaaacgcgtatttgagcatagttcaattgcgtgacatctttctttctgatattgtcgatctgaaatacaaaaatcaattatggtcagaagtggtaaaatatttagagcataataacagtaatattaaatcgaacttaactgaaattcgaggtgaaataatgaaatgttgggaatggataggtccgatggaactcaatgaacctaaggattccgctgaaaacaaaatataacccacaaaatgaaactcaaacgtagttttctcttctcaaacttaatgatctattgtttttccgagttgccatatttgtatagtttattctatttatacggttatcctaatatctgttatataattctttatgtaatacttttgtaaagttataatgaatctaatcctgaaaatgacttgtaaaataataagaattttttattcgatttaaagtaaatattaatacgacacatggaggaaagaaaaactagacgatataggaagaaatacaaataaaatcagaattgaaagagtaactagaggattttggagtaataaataatgatgcaaattttttatttgtttcggccaggaagcgtttcaagtaggcttgcgtgcatgcaggggattgatctttggtcttccaacttctcttcgtgtcgatctttgttgcggaacggctggcactgcaccatttccattaggatgtactaccttagaaggcggcgcaaaccgtggagcagctgcaggcggaaaagctgtagcgttcgttttaattggtgtggtttcacgcggtacttgattcccagccccttctagcatatgaggccccagttctttatcattgttcttcatgctcaattgttttccctttggtgcaaatttttcatagacagaatccctcgcggtggtcatcgttttgtcttttagcacactcgctggaatatgcttggacgtagtctgatcaacggtgtgcctaatggattgtgcctggtatttgggatcaaaaatgctctcttcaccaatataacgttcattttgtacggaagttgcagccttagctgtaacaaaggtgatttgttctgcctctgggtttgagctagcagttgggctttgcttagctacaacgggatccttctctgtcgttaaaacattactgtttgtgttgcccatatttatcaagtcgtcgtcttgaaaatcatcgctaaacataagagaatcatcgagaaggtcatcttgatcctgtttggaagcatcgagagatttgagatcagtatctttattactgctgtttttactgttagcctcagcaggtgcggccatcattggggtacctcgacttactgtattttctattttcaccaggttcttcgtcgagtcgggattggtatttgtaactttagtcaattgccttcttttattcgggtattgttgttgttcttgattttcatgcaaagtattcgttcttgagctttcgctgatttcatccgttggcctaaacaaattgttttcgtcaaaatctggcggatcgaacttcaccttatcgatctttgccagaaaatctttatcgtaaagacaatttcctagagcattaccaaaccctctcaaagatcttttcaaggcatccgtaacggcagatttcttggccctttcgaaagcggcaggtttccgtctttcgttctccacggtaccatacccaatatcttccctataagtcccgctagtcaacgtaacacgaacaattgcagtacaccctatgctaaactttccctgtcgctcatccaaaaaatcgataactacactttttacctccgtagaccagccattatatccaaagatttgattagcaagattaattactctccaaccttcgatgtatgcaatcctgcttgttccaaacccaactctcttggagatatactcaggtcctaatttcttgtccaatttggtctgtatgtcctcggaatggttaccgaaaacgggcttcttctcatccatatccataatttcattcatcaacaacacaccaaagccaccagaaccttcagcagttcttggcaacctccttgtttgcatttgttgattctcagtggcaaaatagcttaaaaacgccattcgataccggtcgcgtaacccgcccgccgctatatttttcgtcttttcttaacagactaaagaatataataacatcgagaatcactaacgggaagagcagactctttggcgatgagtaagtgtgattgagaagacgaaaggacattacagggcaagcagatgatacagacgccaagggagttgttgaatccacggtacacgtaccataccatctttagcgacgtgtgcaagacccgattcaaccatttagttacgaggttgtttttcatatgttctattatccaaactgtggtgatttcactgctggcgttgccacactcaccgttatgggaactggcattggcatttattcccaatattttagctcttaacctagtttcccttttgatcattgtgacaagaaaaaattacatgcatgtaaagaattttgggttcgctaattcacttactttcattctaggccaattgttatcagtaaagtttcttgtataccagggagtctatagcatgggcagcatccttttatcattcgtactgggtgtggttttcggacgtggcggatctggatggaagccatactataagctgtttatttggctagtcgttcccacgatttacaacctacaacatcatgtcactgacgctgacaaattgtcgttcaactgcgaaaactttttccaggccccacaagactacgtattagagcgtgtcaagaggattatggagaagtcagtcattctaagtgtaatcagcatgttcgtattaccaatctttaccacagtatttttttccaggcaaaaatcgggattatttgattcatttacgaatggcgtgctagctgtcacaaatttactaataatctcctgcattatcttcatcactttcgaattcataaatatagcatttgacgcacatatgtccataggttgtctgcacaagggcaagctaatttcgaatttgtcgtcgacgccgatggaaaccctgcttagtgggctttctgcagacaagccatttactaggttgactgcctaccaggaactagcgtatagggccacttcactggatccatcattgcgagcaccaatatatcactccaagttcagaagcagtagtggtaatacttggtcattaatcctcaatgaatgcttgaagaccattcagataaacaatgaaaaggttgtgcagtacctaagatcagtacaagatcttgggggctctgcaactgctagacataaaaaaaaagtagaaaatctagattatatgtatgagaacgggaaactaacaagcgccaacgaaagactctttgggaaccgaccctctatgatggcgccattacgggataacggcttattagatgaatcaccaaacaggctgagggtaagaactgacgatagtgtattgcttaaccgcggaaacaagaaaaggcataggtcctcgtattacgacaacgatttagatgaaacgacacaaacttttaacggctctattttcacccacgaaacaacatttatgaccgctatgcgtctgatgttaaaaaaactgaaaaattctataatgtcgtttattttcccttcctacgcagaaagacaatcatctgatgaaagcgacaattacagactattaccaaatggctccaacaaagcccaaatctcgataattgacatatggtccatttccaagaaaaggcaagctgagaagctggttccattgcccatatgccacgcaaatagtgtggtagcactgacaggactgctgatccgatcaaagacagaagatccaaaaggcggtatcattgcatccgttggggatattcttaagactttggagaggtccatctgtgcactgggtgaatttgccgattgggatccggaatcgatggcatacactgccttccaaacacaaaggacagcccaagatagagtacaacaagacagtgaagacgaagatagcatgaaagacactactgacatgatcagtgttctttatcagctgtccaccagtgcttttatggagattgtacttgaatacaatgttgctctgaacgacgtatatttggatgcagacgtggccaagttggcgaactggtttctagaagtgtacgcctcaggcaaccctaatgctacgtaatacaattcaaccgaggagcacccctcctcccatttcatgtaagataaatacaataataaaaattggaataccgcacaaatgctttagtagaggcctaatatgagcaaaaagagcaaaaagctacctttatcgtttccgggtagcgaatcaaggagggcccttttatgcttcaagaataatagtaaagaaaagtatagagaagaggaagcaatgcttcctatcggaattaattcaattcctggtactagaagcgataacatcacagttatacgttcaagatgtcacgcatgccatctagtttcgatgttacggagagggatttggatgatatgacctttggcgaaaggattatataccattgtaagaaacagccattggtacccattgggtgcttgctgactacaggagctgtcattctggctgctcaaaatgttcgtcttggtaataaatggaaagctcagtactacttccgttggcgtgtgggtctacaagcggccacactagtcgcactagtcgcaggttcatttatctatgggacttctggtaaggaactgaaggcgaaggaggaacaattgaaggagaaagccaagatgagagaaaagttatggatccaagagctggagagaagggaggaagaaacggaggcaaggagaaaaagagccgaattggcaagaatgaagacccttgagaacgaagaggaaatcaagaacttagaaaaggaactaagcgacctggaaaataagcttggaaagaagtaatttggctcttcgatttgctgtaaataaattatgatgagagacaaaagaatgaacagctaatttcgactgtaatgaagaaatgtaataaaaaaattcatgatgctatgtccagtattcaagaaaaataattacaaaataacagcgtacatatgaatattctttgtttttatcttgtataactatcacttaaaacatatttatatcgataggtaaatgctatatcaatcgctctatttacttgatttttaatatgtgggtttttttttgcttgacacatacgtaacggtaattgccagctaacgatcggtacaattttcagaaaaattgaaacagagagaatccaccaaatattcaattgcaaggtgacgtacttcagataaacactttattgtaccatcttaagcggctatataaagtgtcatatacacccttcaccaaatacgcaacatgtctgaatatctagctcagacgccctgcaaatttactatatggtcaagcgagattgatcttatcagaacaaacctgttggtgaacgctcaccctttaagcacggttgggcgactacttcaatatatccattatcaaatatacaagcaattaagagctatctatcaaccagaggaacagtgcacgaactcggaaatacctcacacacccttaaatagtatcaacacttacttcctaagttacgaaggcagagagttatctgcaacgtgtttattaaaggacatcacgtcatctagccacccagattcgaaccatttcataagactacaactggaaaagcgtacttctccttccggttcagcatttgacttggaatatgatatggagggcgaatttaactcgatgaatattcaatttgagataaatacactatcttctcaacgtatattcaattccatggaaccaaatttgcctattggcactacattggctagattagagaaactggcattggaacgtataaaggattttgaaaaatcagcagggaatctctgtggtattaaagaggaccattcagtgtctgatttgcagggatttataataaaggggaaacagacacccatgtttttaaattatggaagtgattctgattactataaagacttgaacctggtagatttgataggcattgattttgccccggcacacaattcttttttcacatttttgttcaagatgaatcacgaacagaattcacatatcgccaacgatgaagagagatttgtgttggaattcatatccgatgccacattatctataactcaaatgaatgttaagcccgataccacggtaaaacaagtgaaagatttcatatgttctgtttacactcactcattaaacttgaggagaaatgatatcaagttgatttataagggacagttgcttcatgaaaataattttgcaggcaactcttcaaagatcagcgagtacattaaagagccacatgaagtgaaggtccatgtacaaatcaaccaagagtatacagaatctgggcctggattttggaatgaagtgttcaacaatccgaatattttccaattcatgcctccagatacaaggtcacagtcacctgttagtttcgctccgacgcaaggacgatctcctgctgcaatacgtggcgaagaacggggtataccatacgtaaccgaatctggaaatgacatcgtgcccacagatgagctttataggaaatgcattatcaacggggatgaagtagtattcattcctgttagcgaactaaatccacaatcgagctatttgtccgtgatcaaaggcgattacggtgaaattaaaatccccatatctagtaatgactacagaattaatggcgataatattttgctatcaccatctgcgatagagcagttagaatctgctttgaacttcaaaatcgagagaccacgggattcgacactcttgcatccgtctggtgagcatgttcgagctgcagataatacctcttcggcaaatgataataatacagttgagaatgacgagtcagcgtggaatagaagggtagtgcgtcccttgagaaacagcttcccgctgctattggtattgataagaacattttacttaattggctataattcattggttcccttttttattattttggagtttggaagcttccttccctggaaatatatcattttactaagcttgcttttcatttttaggactgtttggaatacccaagaggtgtggaatttatggcgagactatctccacttgaatgaaattgacgaagtcaagtttagccagatcaaggagttcatcaattccaattcattgaccttaaatttctacaagaaatgtaaggacactcaatccgctattgatttactgatgatacctaatctacatgagcaaaggctatcggtctattctaagtatgatattgagtacgacaccaacacccctgacgttggacaattgaatttgctatttatcaaggtgctatcgggtgagattcctaaggacgcgctagatgagttgttcaaagagtttttcgaattgtatgaaacgacaagaaacatgaacacactatatcctcaagactctttgaacgaattgctgctgatgatttggaaggagtcccaaaagaaagacatcaatacgctacccaagtacagaagatggttccaaaccttgtgctcgcaaatagcggagcataacgtccttgatgtcgtactcagatacataattccagacccggtaaacgatagggtgataaccgctgtgataaagaacttcgtgctcttttgggttacactactcccctatgtgaaggagaagctggatgatattgttgcacagagagcaagggaccgtgagcaaccggctccatctgcccaacagcaggaaaacgaagatgaggccctcataatccctgacgaggaagaacccaccgccacaggtgcgcaacctcatctctacattcctgatgaagactaattgcaatgcgatgtggccacgttatataatgcgtttaaggtgtacgaaaacccatgctgttctggcccgtcgggttttctgacaaattgtcctttagggatttttcggtttggctcgggttggcaaagtcggctggcaacaaaccaggacatatataaagggaggtaattcgtcagatcaatgccgaaccgttctcaacgggccttcccctcgttcaattgctcacaaccaaccacaactacatacacatacatacacaatggtcgctcaagttcaaaagcaagctccaacttttaagaaaactgccgtcgtcgacggtgtctttgacgaagtctccttggacaaatacaagggtaagtacgttgtcctagcctttattccattggccttcactttcgtctgtccaaccgaaatcattgctttctcagaagctgctaagaaattcgaagaacaaggcgctcaagttcttttcgcctccactgactccgaatactcccttttggcatggaccaatatcccaagaaaggaaggtggtttgggcccaatcaacattccattgttggctgacaccaaccactctttgtccagagactatggtgtcttgatcgaagaagaaggtgtcgccttgagaggtttgttcatcatcgacccaaagggtgtcattagacacatcaccattaacgatttgccagtcggtagaaacgttgacgaagccttgagattggttgaagccttccaatggaccgacaagaacggtactgtcttgccatgtaactggactccaggtgctgctaccatcaagccaaccgttgaagactccaaggaatacttcgaagctgccaacaaataagacgcttgcagagttgtctaaatgactacttatttaaaattcactctttacgtttatacctatctatctatatataaaacccataaacttaatgctattcactgacaaaacgatacactaccgtctaagaagctattcacactagctcagttctaataacaatcatcgtctggctctaaaacgcgtaaaccattcactgccacactcactttagctctgttgctgcccttcatacgctgagacgcgacgcttcttttctttcatatgatttcccttctaggcgacacgccatgccccaaacggggaacaccgcgaattccttctggtgcccggtttcctctttgggaagggcgtcaaaatggtacagctcgctatagtcgccaattactgcagatgcttaaaggcttctgcaactgtatgtccaacctagtacgtggaaacttcaaacgcgaacaatctgtatgctgtttcgggctacttattgctctatacggtttttagtggacacgaactcttgtaattattatatatatatatgccttggcattttaacaagactctatgttgtgatttcagtatgatttgggtgaaaacacagtggtgaccacagaacaacgaggtaacagttccagaccactacctttccccttcaatctttgtgatttgatcaattcttgatgtcacaagaaacaaaaatgctaccttctctatctagtcttctatcgggaaccgaaatctcgtccagccccgtatcaccaagcttcactaatccaagaacgagttttcacctcgatgatcgcggaaccataaaattaccaccgctaaacaccagtatcaatcgtccaagatctgtggaaagcgccttgagacacactgttacatccttgcatgaaaatagcagcgcttatggtgatgacatgctcaagcacacgcaatcagactcagccctctcatctcagttgaatagttctcaagaaacagttgatgaatcacacgaaaaccttctactgactcccctaaatagcaaaaagagagattattcggtttcttcaaagaaaaacgacatattaacaccactctctgcagcgaagtcgattattatcccctctgcctctaaggaaaaaagacgtgcatttgctttcatcacacactcgcaggagaccttccctaagaaggagcctaagatcgacaacgctccactagcacgccgaaagagaagaagaacctcgtcccaggaactatctattcttcaggctgaatttgaaaaatgtcctgctccatcgaaggagaaacgaattgagttagctgaatcttgccatatgactgaaaaagccgttcaaatatggttccagaataaaagacaagcggttaaaaggcagagaatcgccacttcgaagtcaaccactataatacaaacggtatctccaccatctccgcctctggacgttcatgctacgccactagcatccagagtcaaggcggacatacttcgtgatggaagctcatgttctcgttcttcctcttcttcaccgctggaaaatacgccgccaaggcctcatcattccctaaataggcgctcatccacaccaagcataaagagaagccaggctttaacattccatctaaacccacaaaagaagacgttgactcccgtgaaaacgtctcccaacagcagagtaaataaattgatcaatagcatagatcattctccatccaaagccaagcgtccggtaagcaatccctccggctcccctaaaaggaagagaaaattcggattcaagatcgtcgatcaacaaccgttgaaggatcttgatccgaacgctttccgtggttgatctaatctctagtcattatttattcgcaaattcatttccctatacggcattcatacatatcattgttcacttcagtcctagcatatatcataaaatatacaattgttttctaattaccttacgttttttaaaagacttctataacacctcttttaactttacatgtagtcaaaataaagtgcagttccatcgatggtactttctcaccccggttgagtgatgttaacgatgtttaccgtataaaacttaattatattatatctttttttgcttatatgttatacatagaataaaaagttgattaaacacacattggtctgaaaacacgtgtagtactttctcctttgaagaataaaaaaagaaaataaagataataaaaacgaaaatagcgtacaattattactgataatttccttaattgatttaagctcttcttctaccagtggtcttggtgtgttgacctctaacacgtaaaccccagaagtgtctaataccacggtgggctctgatcttctttaatctttccaagtcatctctcaacttggattcgacgttgttagccaaagtgtggtagtccttaccatcagtaatgtcgttttgacggtttaagaaccaggctgggatcttgtaatgagttgggttttgcatgatttggacaattctttccaattcttcttgggtcaattcaccagctctcttgtgcaaatcaacatcagccttcttacagaccaagttggagtaacgacgaccaacacccttaatagtggtcaaagcgtaaacaattttaatgttaccatcgacattggtgttcaacaaactgattgtaatgggcgcacaaaaaattgtacatcttattgttagtaatttatttcacaccactgctaggttcttcgagaaattttcaacatggcgcatcattttggaatggcgtacgaacatggagggacgataaatatgaatttgtcaagctgtattgactgaaatttttaaattcgcattgagtcatatattgtattttccaataaactgtgtattactttaaaatctagtgataatttttatagtagcgtagagttaattcggcctcgtatttggtaacccgtgacgtttattattccatcggagtgcactcacatattttcaatcgcaatattaagctattatcccatgtaatgtgaaactctctcaacatatctgcactgtactcgtaaaacataccgtaaaatgtgttggaaggaaccttgttcttgtacaactaaagacatctttaccactttctgctctattggcttttcgtaagatcggtttttcactaatagtatatctttaacaatgttaaagtacctgatattgttattactaaggaccttttccagttaggatagcaaaggtgtcagaattaccatagcccaggcatcaaccagtttccgcgcaagaattctcctcctcccggaacaagaggcctgcggagacgagttctttgcctctgaaaggcgaatctctggaaggatgagcttggatggccccagtaaacgcatttgcctaggttgagccgagctaggaggacaccccgacggataatttagcccttttccaatttttcaaaaaaacatgaaatttcaaaaaaatgtatggatgtaaaattcagtagtgtgtacggattttacagtttcttgaatgagacttgcttttacgtcaaatcattctgaattatacaattctttcattgtgagattgatatttcatgggcttattatttacagattattttttaaatatgtagatggaataataactggatggggtagaagaaggggtcacttgtatgtgtacatatgaaaatcagttagacacggagtgaaggatttctttctgatgggccattgctagatattcaagagcttccaattcgataaaaacagcttgggctcttagtatgtcatttacctcaacaagttctttctgtataacatctactttttgtttgtatggatcagaactctttatcagcccttccctagtcttgtctgtaatgaaaagtaatctcttacctttaagttgaaattcctccaagaattttctgaagatgacttcgccctcaaaaatctctttgccctcaactgtgtttgtattcacaagatccagcctgttcaagtcgagttctggtgtgggagatattaagtcgaccttttcaccaccaataacaaacaactttccacttttatattggtggctcaaagcgttgttgaaagccatggaataaaccttggatggtagctctgtagtatagtcgtttggtgcagttcttgccaatgccctaccaccattatgtcttgttggagagttagcatccccgactcttgccctaccagaacccttttggggcatcaatttacgtctggaaaacccgttttcacttctcccgggaggatttgaggcgcctactcttctattatcgttttcataaactacggctctccatagtatatcacgccttaatggagcagctacagttgatgtggggaccggcacaaatgtcaatggttctaatgatggaaaggagcgaacggtaactaaggcgtatttgggaggaatggctgcgtttggcagagggtttaacgtggattctgcatgtgcggtggcagtggtagcttggtagcgtatagattgtaaagtctattgcataaaatggttgtaatgttagtatacggattcatcttcagaaaatcgacaaccaaatggaaaaagagcgagggacgatcctctgatacgtactttcaccaaatttctttttatcgtcattattattatttcaccctagttgaacgaaagattattcgcattggcgtcctttgaatgtatctcccccattattaatggaacctctgtattatacttttctatttcgaactttttgagactcattcttggtatcccagggtgacccagtaaccttttttccggtttaacatccgtgcattacatccgtacattctattttttattttccaaaaaactgggagttctacttaattttttggccccgtttgggaatctgctttgccacaggaggcggcctgtccaggaggacaatagaccaatggcagagacgaggtttgttgggtacgtgcaacagcgcctgggctcagccggcttgctgtgggcaacggaatggtgcttcctaagccaatctttcatgctgtagctatcgtcgtgatcgcttttactggcatattagcgtaatatgtatgaaattaggtattaatcaagcattaatcgacttaattctaagaaaagtcaagatctcgagactagcaataacaaaatggtatgttaatatggactaaaggaggcttttaaggacacgtaatattgagtcgacatgcgcaataaagtcatacaataaataagttaaagaaaacatatgacgatattttcagacgatatggaactgcgataccgaaaaagtggtgtgattgaaatgatactcatgttttggctatagttgcagtggctttccaaaaaattgggagttaaaatgcctatagcagtatcaccggagattcagtctcttgtggatcttctttttgcatagttgaacaagggataatatggcgccatgaactgcctctacacattataatgtgtttttgatatcagtatactaacaagttgaattgcatttacaaactttttattttgtattgcttttcgtcattttaatagggtagagttagaaccaagaccgtcaagcgtgcttctaaggctttgattgaacgttactatccaaagttgactttggatttccaaaccaacaagagactttgtgatgaaatcgccactatccaatccaagagattgagaaacaagattgctggttacaccacccatttgatgaagagaatccaaaagggtccagttagaggtatctctttcaaattgcaagaagaagaaagagaaagaaaggaccaatacgtcccagaagtctctgctttggacttgtctcgttctaacggtgttttgaacgttgacaaccaaacttctgacttggttaaatctttgggtttgaagttgccattatctgttatcaacgtttctgcccaaagagacagacgttacagaaagagagtttaaaattaaattagaaagctatttaaaataatttactattcaaaatatttgccttttcttttttaatttttgtttattctttaatgtataattaaataaaaaaatattattatatttactaattaagagcgaagcgttttatgtagctccttggccatacatacattgcgcgcaatgtttatgctttgataccaaagggctatcatctttgacttggaattatttatattttttaacattgactctgtttcctttcttactcattatacttatccagaaaaaatagaaaaattagttacttattctataattacacttttatcatgaacgccaaacatttgggagactatgggatacaataaaggcggatcatttcctaagttaagcgccttggcccactgtcgcctccctgaatcatttttctcaatcgcatgtaacatttctaactgttccttagcgtctaatatcgcttcggtcccgatcaaatgcagaagatatcgtagtaggaccagtaggcagacgtcacacttttcaatattcaaaacggcttcttcatacgaagcttggctacattgctcggtaaaagcaaaacattttgatttaaccaaaccgataacttcgttgcaaaatgaaacgccatctgataaattttcgactagcgttaaaataacgacacattcctgtgtgtctttgagtatctcagaaagggtaccttcagctaataggggtataaaataagactcttgcgacagattttcagtcataaaaaactttttgaactgcaggatatcattaaaagaagccaacgtccgtgagatcccctggataacatcatctgcaactattctcggagtaatcaatctatgtccatctggaactcttagtaatagtttgaaacatgacccaatcagtttcctccgcaaagctaatgatttttgtgatttgtacaaaggactacatttaattgtgggaatatacgtatcaacaattgtgttttcaccattatatacgggatgaaccggcgttgcataattgtcggatggcagtttgtaatcacaattgagaaatacatattcggaaaacctattcgcaaaattccttgtatttaaagattcaaaaaaaactgctaacggactctcagataagcgttgaacgaacaaggatttgcttacattttgggcgacttcatgctgtatgaaataatcttgtctacaactaaacagatcaatgagtatttcaagtaagggcatccaaatctcatggcttgataggaacagaggtgtgctttcttgcagcgagttagacaatgtccataaaatcatgttaataaattctccaggttcattcagtttcaaattcaataagcgattgcccaatatggtatttctttgctcaagacaactaatatacgacctgtaaggatttttaaaagttttagcctgatccaactcgggatctacactagcattttgcctatatgttacaccactttcagatttcgttctcctaaatctatcgaaaccccacttttgcttttttggtgtcaacgtatcgattgccaagaaaaactggcatcgcaacaactccaagtcatacaaattgtattgctcagaatcaaactctttcagaatcgccagatatttctgcaatagtttcaaagctctcctacttaaagtttccctggacgtgttatatggatcatttgccctcaatatcggctccttataatattcagataaagtcgataacgtgaaaagaactaatatgatatcgaacgggataacagccaaattgtgagatttgccgaactggcactccagaaacaacagcacatgatcataattttctaagagacacatggaattgagcatctcaaacgccaatagatgtttctcagtgagttcaacaaaataatgtgcaccattgcgtggactcacgtataaaacggaatttatcaacgcaccatccatactcagactaccactacaatcaccatttgccggcaattatcttcatatatctataattttattgccaacctactagtagtggtcttgaattagttttgaagggctctctatgtgggaaaaaatcgggccgcgcaatgaaaaatttttggcattataaattcacctcattgggaaggtaaaatgcatcttgcgtctgactcaatatccataaaatctattttcacgcattttgcctgcttcaaagaaatctatcgcaaatattcctactaatcatgtctatagcaagttatgcccaagagttgaagttggctttacatcaatatccaaacttccctagtgaaggcattctcttcgaagatttcttacccattttcaggaacccaggtcttttccagaagttgatcgatgctttcaaactgcatttagaagaagcttttccagaagttaaaattgattatatcgtcgggttggaatcccgtgggttcttgttcggaccaactttagctttggccctaggtgttggtttcgttccagtcaggaaggcaggtaagctacctggcgaatgttttaaggctacgtacgaaaaggagtacggttctgatctttttgagatacagaaaaacgctattccagcaggttccaacgttatcattgttgatgacattattgccactggtggttctgctgctgcagccggcgaattagttgaacaactcgaagccaaccttttggaatataactttgttatggagttggatttcttgaaaggcaggagtaagttgaatgctccagtgttcactttactgaacgctcaaaaggaagcgttgaaaaaatgatatgtttcacgtcctgacccatattcaagcttcctttctgccggtttcaagcaatttatttttcttacttctccttactctctcaatttggttgtataatatttactttttagattgaaaaatattcaatccacttttctgctttgtgccacaaagtagtctatttagttttttatctattatatgcttttaaagagtttggaaatcgagacctgcatatgcaatagtaatattcaagggtcctttgattctgactctaagcgagcatttgcctcctgaacttctcttaatgacgttccaggaacaacactccagtctatcattttctctccgcgggtattgtatagccaatcgtttatcattttgaaatggttggtaccaaaaaatcctctacttgcacttaatggagacggatgcactgacttcatcaccatgatattagggtacttactaccgcttccaacggaagtagatcccaacagagactctactaatttgatagcattgttcccccataagaggaatactaaactcttaccgtcggcctctctgtcctggatcaacaactgaactaccctttttgtaaaagtttcccaaccatgcttagaatgcgagtttgcattatgtgctcttacagttaacgaggtattaagcaataaaaccccttgtgaagcccagtgagttaaatctcccactttattatcttcaacaaaatcaggatactcttgcttcagttccttatatatgttctttaatgacggtggtgctggtgtagggggtttgacgctaaaagccaagccatgcgcctgattaaagttgtggtagggatcttgaccgataatcacgactttaactttattaaaaggcgttagcctggtccatgagtaaatatcctttgcaggcggaaatactgtatgatcagcttgctctttagtgacaaactgtttcaactttacaaaatatggctttttaaattcatccattaaatgtggaaaccacgaatcatcaatcgtttctagctccagcgacagtagtgtacgtaaattgctgctcaagttcttcgaatatacatcttttgcatttgaattagcaggatatttgtccgtgtttgcctcctttgcgaccgcctttgtctctgtcttgatagctgcgccatttgttatggtcatgaaagtagcgcccgatttacctttcttattgggcgcctcattagtgcttttctttgtaccaaagaagtcttcgatcgtagtttgctttctctttcgagccaccgtcataactgaatttgttggcaatcttctcatgcaccacatgtatgtgaacggcttgtgtacagcttctgataatatatatcattatggatgaattacgcgttgcggacacattccaggttttgacaatagggaaaatattgagtttatatgtaaagctttttacaagtcactaatgtgaacaacgtgaggtaattccatggaaagttcatataagaatagttcgaaaactatcttttttattcccaccagtcactagattcggctttatacatatagtgggcttatcactgctcttggatagcacttttgcactacaaatagacaccattacgaagaattggaagagacttatatacagagtaccagtaggtagaatggtcacgactccattgcattcctcgccgaaaagcagtctgaaatcttcaacgacctcactgcgctcagtacatactcagtctggtcgtatggggcctagtgagcctaagcacagaacaaccaaatcctggtctatatggggaggtaatgacgaggaagaaccggagttatctaataaaaataaaggaaaggaaaccgcccaagacaacagtcaagaaaatgacaatgtttcaaatgagggaacacgcttgcacgataatcaacaaacaacgattttaaaggaaaccaccaggatcgagaagggtgagaaggacaaaaaagacagaaatgcagctatagtagaaaaaaacacaagaccacgagcatggccattcttttggggccgtaacaaaaaagatccggagccgacgcataacattcccactgatgcggataataacactttatcacgtttagcaaatagtctaaatccggctcctctaaccaacacttacataccttataaacctgatgctatattgatcagagataaaggtgtcaaaactgctaagaaattaacagatgacataggcaatcagtttcctaacattgttgtaccaagtttcgatattttaccgaaacaaaccatatggaatacagtcacatccacaatttggaagtggaagactgaatactgggatagaagaccttcatcaagggtacgagagggggaagaacaggtgcagcactcacaaaatcagttaaaagaggaaacaaacacagttgcaaacgaggcaaaagatgaggagcggttggaacacaacagaggatctctatttagggttgatccatggaaaaaaataaaccttctatcagattaccaatctaggcccatcagagttctcattgtcggcgttcatgggttctttccaacaaaaattattagaccgtttattggtgagccaacgggtacatctaccaagtttgtcacagaagctgaggaaatagtgaaggaatattttgatcaacataaagtacccattgaaataagcaagatcgctcttgaaagagaaggagagatatttgatagagtagatttcttctacgaagttatgaagcattggagcaaagaaataaacaattctgattttatttattttgttagccattcgcaggggtgtccggtaaccattatgcttttagcgaagctgatcaaaaacggcataataaaccttgataattctcaatttttcaacgatgaaattcagttttgttcgtccaaaaaaattatctcggtcttggccatggcaggtatcaataatggtccattctacggtgcagatcaaactttgtttgttcgtgcttaccagacgattgaaaaagactcattgagggagttattcgagtttcaaaagtttgattccaaacaatcgcaaagcttcatagaaggcctaagaacaatcatatcaaataacgttaagattacatttgtgggatccatcaatgatcaactggtccctctgtattcatccacatgtctttttgccaaccatcccaatatatttcgggccatttttattgatagaggatcacaaactccagcatttatcactcgcatagttaaaattgctggttcactcttaaacctgggttataacgatcacggaatcataaaggaaataagcggatctctggcgggcaccctgacaggaggtggtcactctaccatttataatgagaaacaggtctaccatctgggcatcaaatttgcattagaaacaaccgatttgtccgaaatgtatccaattgagtactcaccatataaattgtctgagttaggagccaacccctatcgtctgccatggtgtatgaggggattgatgtacgagtccaacaagcatttcagtaatgaagaaatcaagatgttgtttaaggaatttgaggaatgggagcctgagacaaagcaattgaaggacataaaaaacaggcttaatggtttgaaatatcgactctgataaaaaatacatccagcatgataccagcttgcttccgcaaacgaaacataacttaaggtaccgcaattcaaaaaggcattcatacgtacaaatattaactatatctgacattatttagactatcacaagcagtatttatttatttatttacttatttattcatttattcatttcctttttagtcttttatgccagtgagctactgtcgcgaattgaaaactgcaaaaaaataaaataggaacttggattcagaagttttgataataaaattgcatgtagatgagagccgcgaactgaatcatacaaaaaaaatatgaagtggtgtagcacatacattattatatggctcgccattatattccataagtttcagaagtccacagccactgcatcccataatatagatgatattctacagttgaaagatgacaccggtgtgataacagtgaccgctgacaactacccactgttaagccgtggtgtcccaggttacttcaatatcttgtacatcacaatgaggggtacaaacagtaacggcatgagttgccaactatgccatgattttgaaaaaacctatcacgcagtggccgatgtaattcgctcgcaggccccacaatcactaaatttgttttttacagtggatgtcaacgaagtaccacaattggtcaaggatttaaagttgcaaaacgtacctcatcttgtggtatatccgccagcagaaagtaacaagcaatctcagttcgaatggaaaacatcacctttttatcagtactctttggtacctgaaaatgcggaaaacactttacaatttggcgattttctggctaaaatactcaatatttcgataacggttcctcaagccttcaacgttcaggaatttgtttattattttgttgcgtgtatggtagttttcatctttattaagaaagtaattctaccgaaggtaactaataaatggaagcttttctccatgatattgtcattaggcatacttctaccaagtattactggttacaagtttgtggaaatgaatgctatccctttcattgcacgtgatgctaagaatcgtataatgtattttagcggtggttcaggatggcagttcggtatagagattttttctgtatcattgatgtacattgtgatgtccgcactgtctgtgcttttaatttatgtgcccaaaatctcgtgtgtaagtgaaaaaatgagaggactattgtcgtcatttttggcatgtgttctattctacttcttttcttatttcattagttgttatttgataaagaatccagggtacccaattgttttttaattttgagaaaatgcgtttttcagtttcattataacatgtatatttgcatttctttctcacggcaaagttagtgacaaagaataaggtttgtatgaagccaacgagatactttttctcttattgaaaattcttttggcctctgttttgttagtctggatactgaaaaaaatgtttaagattattaaatcacacaggaatgaaattgttattagaaaaattataatatacattctatatagggaaaaatttcttctgactttgaaatttagatgctaatagttttttttattatttctattttttttttttttaagatcagttgtttgctgctggcacctccactgattcgtaattgctagccgttattgagttctcaaaatgttcctcctcagagcttttgttaatgatgaaaaatgagcctaagatgagggtagcaccaaataaatagagcgcagacatggttttgtgcttaaagattacatcaccaaacattgctaggggtatcgttatgctcaatcctacggtgacggttaaaggactcgttagtaacatagcctttgcccaacaaaagtcgctaacaaatgtgatgagacaattgacgaagattattaccacaactttaggatctttgggcagagagaatggttcccagccaaaaaagtccaatacaatcagtgatggccatagaaaaagtaaattaaagagaccaacaaagccaaaaaaaatcttcatgttaacacgagtctcatctccgacttctctcttcaataaagtactgtagacaccgtaaagtacagcacctgcaagtgccaacaagttgcctatcagaacttgcacggcatcgttatcatcaccactaacgtccgcgatatggcgttggtagcgctgatgagaatctgatttggtgaccatgattatgcctacaaaggaaatgaacgacccgagtactttggacttgctcaacgattcaacatgacaaatagcacctatgaacaaggtgaaaaaggaagaagtagtggagaggattgtctgcgatgccaccgatgtgaatgccagcgaggcattggtcacaaggttagctgtgaaccaaagtatgcagaactcagcacttaacttgattgtttcatataacgttagcctcttcttttggttggcatgcgtgcctgcttcaaggtttgtaagcagtgggctagtcatatcaaccgagcgattgctatcactaccagtaccttcttcctccataattagttcgcggtgaacgtttgcacggcctgtgtccttgtaattcaccacaacggcctttgcagttggaaaaagataaaagataaaggcggcagtattggtgtacgtgataaagaatggttttctatacgagtcatcctcgaagatcaaatttatcaggaaggacgataaaacccacaaaataatgactagacccaacatcagaagacccaaggtccacctcttattaaaggacgtttgatccttcgacaccatggctctgttgaacttttatctgagagaggaaaaaaaggaaggaaaaaaaagaagaaacttcctttatttatttgtcttaaccacaacacacaatgcaataagatgcaatataatatcaaagccaatatcttatgttgctgatcctgagaaggaatatatacaatttatgtagtaaaataccttttcttctgcgagttgcaagaaatagaaaagactccgattgcgcatcgccagaataaaatttcacaaccacactttttggctgaactttttattacctgattaaacagagagagaaaaggtagaggtcaaaattttttaagcaaaactaaaaaagatgcaaaatcacgtgctgaaaatctaacataagggttaagattagagttttataggacttgttttgtaatatttcaaatacgagctaaccctactgatttcaattaggtctaatttagggttgagctgcactgaaatttcggaaattttgggttattttaaatgagacagaagaactacagagatacgttcttcagactttaaagcttatctccacaaagaattggtcaagaaatcatcctagaaaaacacgtttgctcactcgatcttaatcacatagagtgctggaacgggaagaaatgggtatgtgcctcggtttttctcattaaccccttttgatccataacggtcctcttttgtttccttttttttttttgttttagtattttatgtttactattttcttctgtttcagtcatacgtaggaattattgcatgaaagaggatataatattcatgtggatttttaagaaaatagatcaagtttaaatagccactaacaattgaacaatgctctctcttggcctcttttcttcttttttatcgtttctctaaaaatcaagctgattagacatggtcttgcaatgtttttgctttctctaatcagcttggttttccgcaaagaagagaaagtcacggaattgtctacatatgtttctattcaggaacaaataatacatctaataataatggcactacgaagaaaatgtccctagaagaatttctagggaacgacactttaggcgagtcagtatgggatgaggaagatattaatttggatgctataagcaatactacgaatattgacatcttgaaacaaaccaaggcaggcgaacatcaacgtgatggtcaccaacagcacccacacggtggtcatggacccatgaacagatcacgtttttctaatgcagggccttttggtggtggtagcatgggggactttgcaaatcatcaccacccgctgcagcatcagcaaggtcctccttatattgtgaagttttctgatttaccaccgagattttccaactttgacattgaagatctttttcaagcaaagtttaccaagtttattaagttcaaactgttttgggagataaataaaaatccaagtatttctactttgaaatcggggtcaatctttgatcaaaatttcaaacgtgactcgaaggtagcatttgtcgagttatatacatcccgtgatatggacaaaattttgaactattggaccactcctttgaaggaaatttaccacattacaacagcgcccgcagaattcgaagattttaaggattacagcacgaaggtgaaattattaacagaccctaaagacgatgctggcaaaccattcattactaagactcagcggtcaaaatccaatccttttggaagtgctaaaccggttgatacgcaatcgaagattttggacattgaagaaaaaatggaaaatttacacgtggaagatacaacaaccctgagggcatcattaatccctagtagtgattctatggcaaccactgcaacaggcagcaagatcacaatcttgaaaaagcagacacctacagaggaggaatcacattctgcaaccccaactcccaaacctttaagttactctgaagtagttgagagatctgtggtcaatgaaacttccaagaaaggaactccattaagcaagcttgactcaccagctcttgaactacaatctaagcccgataaatcggacgagttcaaaggtggcgatgaacaaggctttgagaaaggtggcgacgataaagctcaattagatgtctcaaatgataaagataaaggttcagaaaccgatgttgataaacagttcactttcaagaatgtggaaagggaacatagtatgagcagaaccaaatataacggaaaccataataacaataatggcaattttagagggagtaatagatatcgtggaggccccaatggcagcagttataaaggtgggcataacaatcgtggtaatcgcggcggatatcgtggtggcagctcatacaacaacaacaacaacaacactaatgataataataataataataataatagtagtagtaataataataacggttcaagatatcatgatcgacaaaacaatgaagaagggttaacctcggattcatctttagatgcctcaggaaataaaaagaatgatttcacgaactcaacatccaatacacaacaatattccattttcaaaccagcaagtgggttccttggccaaggtaataatgattctataaggaacaatggacgcggtaactataacagcagcggtatgaatggaggttcgagaggaagaggatttggcagaggaaggggatttggcagaggcgcatataacaatcgaggtagtcgtggtggacgtggaagcagcggtaactactccaactacaataacagaacaacagacatgcctttatgagtcatgtactgacccattaattttcttttctcttttttttttttttttttttttttcctctatttcctttttttgttctagtcggttacgcagttctgagtaatgtaatatagcgttccttttcctctcagatttttttgaccttattttgtttccactttttactacttatgctgctttttgtccatttccccttcagttgttttgaattttttttttaaaaaaaattcgtctttctgattaatcaattttgattatatattttctcttgattagttcacaatttttataggcccttatttcttaaagaagttttatgaagtttcgtaagtattgggggggttgaaaataatctctcacgttatacgcaataaaaaattaaaattaaggagaaccaatctatagaaacgaaccattgaatttagctatatgactatataccattacgtaatttatataaacagcttaatatagcgaaagcaaagtagaacgaaatttcggagagttctagattgtatagagcgaatgagcattcaatacacacgcgaaggcagtaggcgatgaaaggaagttttttaatgtcattaagaaaaagatagggaacttctatttcctgtctttcatatatatatatatatatatatatatatatatgtgcatatgtacatcgttgagttgttcatgaaataatgaatataatacttctggattttttagtcagtaaatttactgttgagattcgttatcatttgtgatgcttgtttccatcatttgctgttgttgattagccagttttctttcctgtctacctttcttcataacttgcttcaaagctgcactatctagtggatctaacaattcaaaagagcacaataaaccttcgctgacgctcattacagccccccaattatcaaattcaccacaataatttggcgcggaaaacaccgtaacgagacttctatcattgaaaaattcataaccgtcttccacaaccatgtgagctctacaaaccaaatcaaacccaaacttgttcaagaatttgttaattgccaccttattataacagtaacttacaccacgttcgttatcctcccattcgttgggtgaatctgtgggatcggaccacaaaagatcattaattaagccaaaatctggtacatcagtaggcctaactacatgtctgatttcatccatagaatttaaaactggcgacaatccaccatgaacacaaaaaatctttccggctacgatagcagctaatggtaatgtattaaaagtatcgatgaatgtcttccagatcttgatgttacaacgacgtttacattcatcataaaatccataaacccttgtgacgttagcacattcatggttgcctctcaataaaaagaaattttcagggtattttattttgtaacaaaacaatagtaaaatagtctccagtgactgtttaccacggtccacataatcacctaggaataaatagttcgaggatggtgggaacccacatttggtaaaaagccttaagagatccccatattggccatgaacgtcgcctacaatttttacaggaggtgataattctaataaggaaggttgagaaagaaagatttcacgagccttgatgcaaatctgtaaaatttcattgttcttcaaacaaacattttttgttctcttagcagcgtagcccgcatccagtaatttttggatagtttcatcaatatcgataggctttttgaatttttttggagcgtttttgtttccggaagattgcattatatcattaaattcctcattcggatcttttttgctatctgttatattattatttttatcattaacattttccattgatgcatggatattactcaattgagatgaattttcaatgtcatcatcattgctgatgtgtttgctcgggtaaatatcgcgacttgaatggtgattcaatgaggaggttgaattagaggtaaagtattcaccagagtgatctgttagcttggacaagcctggagagtttaatggggtgctgtatgcggtattaccatctgatccaaacgaagatttcctactgtgtagcgaagatgcatgagaatttgaccgggttaatgcctgaacgagataattctcctgattgttagaggagtatgatccattgttaggctcttcatgggtcacatctgatttccttcttgacactgatccgcttcttatactggacggacgagaattcgaagatctagaaaaccttttagtgtgcgagatgtcgttgtctttatcatcattgtcatcatcggttaaggcgttctcataataggtagatgagtatgaagatttatgcttggatacgtgtgtgctactattgtttgtttttaaaatgggtgacttgggttccatttggatcattgaaggtggtaaatcagcagcagccttagtattataacttgatcttctagaagtagaaggcctcttagtagaggatgatgaaggagtagttaacaattcgttttgagaatttgaatgcgagtgtgagctagatgggaaatggtaacgattcgtgtgagagctatgtcgttggtgattaacctcaagattgggctttgatggagtggagggatcagggacgtttgaattagtattcgtagtggacgaagaaggaagagatcgccttgatcttgaagatttatttgattttgcagacttcacagaatgggaagtctcggttctcgacacttgaggacgaggatttctcgaggaggaattcgaatgtgaatcctttttcgaagattttgaacttgaattacccattttgaaaaggaaggaaagataagcagagagtggttgatttgttgttttatgacaaagcctctaggggaaaagaagcgactataacgatgaaataaaaataaaacgataaagaaaagtataatcaaatgtattccaaagaagtacttttatatataatctttatatttaacttgaaagaaaaagatttaacatgtattgccaaaacaaacaaaactaataatggaagctattgtattgtgcttttatgttacccacctgccaatggttcacaagagaaagctgattaacagaattagaagatctgcagtaatcgttttctttttttttttttcattaatttatatgctatccttttaaaaatagacatgtcatttcaaacgacatgttaaaaattatatatatgtttatatatagattgatatatgttggagccgttggacaattatgggcagctatctgaacatggatccctgcccttctccttgagttctccagtaagcgttaggcaaagtgtccgactgcagacggtagagtctccacgcctcacggatgtgttcgggcaataagggactgttgttatatttctcgatgcttacatctagtttgttgaattggaggacgagcttattgtactgctcgatgagttgtagcttcaagtcctgtgaattatggtctgattgctgtaaggatttggactgtagcaacgagttgcccagcgtagtttcgcgcttgtctacttcttcatcgtcgaagtagaaatcaggttcgtcttcgggaacgctatcggattgataatcttgcttgtattgctggttttctatgatggagaaagtcaatttttttagatattttttcaatttatagcctattttggtcctcttatcaaactctatgcacatttgacttgtcaaccacttattcttcacaatcatggccaattcgattatctcaccagcgtatatttttcccaccgcttgcagaaaaacacgaatattttcacttatagtttgattagctactgtgctagccagttttttgacctgggttttgtttagggatgttctatggaaaacttcaaaccgattagtttgatctttatccaagttggttaccaagagcttgaattgttcgtcctgcgcaagtttttcattttcatcttcgttggtattggtgtcttcgtaattgctattttgtgtttgctgttgtaaaatgtcttgtggaaagatcaggttttctgggactttgttgatagagtccgggtcttgctgatttatcctggttttctggtatttgtattttggatatttatttaattggttgttgattgatgtaccacccgttcgcaggttttgcaatttccacgtaacgtagtcctggtcctcactgatgacttggtcaatcatttgttttgtggaaaaatagtttgctattgtcagtattggcggatagttcactttcgggatggtgtccaaaggaccttgaggttcggtcatcgttgcgctgttgaagctcaaacttactttgtgctcttcatttatatggataattatctctatatacctcttcttgatttttcaatttctttcaacttttcagtcgaagaaatgggaataagagaaaaaattcggtaatgaactgaacagagatgaggtctcgaagagccaagaaataaaaggttaagaaccaacatggagataaaccaagcggctgaaaaagaacaggagtatgttcacaaagtgtataatgagatagctccgcatttctcgcaaactagatataagccatggcccatagtgactcagttcttgaagactcgcccaatgggttccatcggtatcgacgtcgggtgtggcaatggaaagtacctcggagtgaaccctgatatatatattatcggttcagatcgctcagatggtcttattgagtgcgccagaggaataaacccatcgtacaacttactggtggcagacgggctgaacttaccacacaaaaacgaaacatttgacttcgccatctcaattgctgtagtgcatcactggtctacaagggagagacgtgttgaggtgatcaggcacgttctatcgaagctacgtcagggcggacaagcattaatatattgttgggctctagaacagggcagctcccgtagaggttaccatgaaggtatggagcaagatgtctttgtcccctgggttcttcccaagagtaaatccaaaccaaaaactaaatcaacgccgcctgctaaagtcaagacaaggccaaagccaaacttaatgaatattcccccaaaggagcgttccgaatacttgcagcgctggaaggaggaacagcaacgcagtaagtctcttgatgataacgacgagaagcaacaacaagatcaagaacaggaaagagaagaggtaaaataccgatactatcacttataccgagagggcgaattggctgaggattgccgccaagctggggctgccgttcatagtgagggcttcgagcgcgacaattggtgggtggtggcccagaagagatgaaggtgatatataggtagacagtgtattttgtagcagcaggtattacgatagaagtatgtaatagctttcatagtgtaatcgaagatgccagtagtcaatcatgaggatagtgaatttcacctttcgcacacagaagaggacaagttaaatgagttccaggtcatcacgaatttccccccagaagacttgccagatgtggtgagactgttgaggaaccatggttggcagttagaaccagcattgagccgatatttcgatggagagtggaaaggcgaaccagaccagatgggagagcccactcaaacgtctacacccatggctgagaccttggttcctcccgcgttgggacctagaccgttgttatttacagcctcactgcccgtggtcagaccattgccagcgaacttccgcaatgatttcagaacaattgggctaaatggacgctctaacactgtgtggtccatgtttgaatcttttagttatgatggtaacccctttctttttattttactgttgatccctcggataatcaataggttatctgccacaatattcacgttcttttgcactctattgtccctgcattcgataagtggtggcggtaattcaggaaaacccaagatctccaaggttccaaaggcaccaaccagagaaacccatatcccacttgcagaaatactgggtgacacgaaggacaaggatgcattttgcgaactaaaaagctttaaaccagacatttccttcaatgaggccttgcgtattgcaaaagaagagtttaagtttatgttgctcatcctagtgggcgacacctacgataccgatactgataccgtagatgttaattctaaactactattggaaaagattttgttaaacaagaagactttacagtacttgcgcaagattgataacgacctgattatctatttgaaatgcgtacacgagttggaaccttggctggttgctcgccaactaggtgtcagaaacaccccggagatattcctcattgccaacgtggctaataaggcttcccattcagaaactttgccctcacaaagactctccattctcggcaagctaaaggtcaattcactgaacagattcttgcagtcgttaacaaacgtggtggaaaagtacactccagaattagttgttaataaaactgaaatgcacgagctacgcatgtcaagagaaataaaaaaactgcaggaggatgcgtacaaaaagtcgctagaaatggacagaatcaaagctatagaaaaggaaaagagcttgaaacacgctcaggatttgaaattaaactcaactgctcggcaattaaaatggttaaaggcttgcatcgatgagatacagccgttcgagacaacggggaagcaagctactctgcaatttaggacttctagtggcaaaagattcgtcaagaagttcccctccatgactacactttaccaaatctaccaatccattgggtgtcacatatacctcgcggtatattctagtgaccccgcagaatggtctaacgccctccaggacaaaatcaggcaattatctgcagacgacgatatgctctgctttaaagaaggacaactcgaaactgctactgctaccactatcgaagagctcggccacatcatcaacaacgagcttacctcatttgatctcgaacgtggtaaacttgaattcgactttgaattggtatcgcccttccctaagtatactgtgcatcctaacgagcacatgtcggtggaccaagtgccccagctatggccaaatggcagtcttctagtggaagcactggatgaagaagatgaagaagatgaggaaaatgaagaacaatgataaaatagcatatcgttaaaaacgacaaacgcgtacaaagagtttctggagtttacttttttttcatttttcgtttttactctttcgtctccctaatgattttggccaaccgttggttgttacgtgttatatgtttgttttaggagctggggcctacctttatagttagttgtataactcagttgatctcataagtgaaaagcaaaaaaaggatgcaggtgttacagttatggttgacaactttgatctctttggtggtggcagtgcagggattacatttcgacattgcagcatctacagatccagaacaggtttgtattcgtgattttgtcactgaaggtcaattggttgtcgcggatattcactcagatggttctgttggtgatggacagaaactaaacctcttcgtgcgtgattcagttggaaacgagtatcgtagaaagagggactttgcaggcgacgttcgtgttgcgtttactgctccatcctccacggcattcgacgtttgttttgaaaatcaggctcagtatcgtggccgttctttaagcagggccattgaattggacattgagagtggtgctgaagctcgtgactggaacaagatcagtgccaacgaaaaattgaaacctatagaagtggagttgcgtagagtggaggaaattaccgacgaaattgtcgacgaattgacttacttgaaaaacagagaggagagattaagagacaccaatgaatctaccaacagaagggtaagaaatttctcaattttggttattattgtcttgtcctcgctgggtgtttggcaagtcaactatttgaagaactacttcaaaacgaaacatatcatttaagcaaaggaagaggaccacaccatgcatttgtgtatcagcttaccctataattgcatatgtactcgactattttctacatatatatgaatagattccagaaccgaataaaggagaaaaaatatttgaatatggatttgttcgcttcacatctttaagtaacctagttttcccaatacgcaaccaaagtccaagtatgtcatgaaaagcctcttgccatcagtagcacaactaatcatttcaatggtcccagaactttggtcagccccgatgagattggagattttttgaaggtcttttacgcttaatacatgatctcttaaggccacttgcgggaaatccacgtctctgccacagtttctaataagcatcgaccataaatcatctattactgttaaattattcatcagtatcagtaactggcatgtgcatcgtaccagtttcgtgaaatctattacgtcagttccttctataatgacgtcttcatttctcaccagtttccaaattgtgggctctagttgcaaatccttgaagaaccttggtagttcattaacggtcatatcatggtccagactggattccgcatatttttccagaatttcatcttcaacttcgataggtactttcgggttctcgaatagctctactctttcataactaacgttagtggatttgctcattgaaaaaaaactcggaaggtatttaggtgaccttgcggcttcttaatgctgacacctgcatgcgtaattgttattatatatatatatgatagtatatttcatacttgttccttctaaaggtgacccgcctgatatgcgacatagaaaaaaatttggatgaacatgttcaaagattggtagcattgacaagaaccattcatacaagtaggtaacagcagaaggaaagaggaacgggtgttgtgataattatgagtgacaactcggacacaaacgtgagcatgcaggaccatgatcaacaatttgctgatcccgtagtggttccgcagtcaactgacactaaagatgaaaatactagtgacaaagatactgttgatagtggcaatgtgaccacaacggaaagtacagaacgtgcagaaagtacaagcaatattccccctttagatggggaagaaaaagaagcaaaatctgagccacagcaacctgaggataatgcagaaacggcggccacagagcaggtttcatctagtaacgggcctgctacagatgatgcccaagcaactttgaatacggattcatccgaagcaaatgaaattgtcaagaaggaagagggctctgatgaaaggaagagacctcgcgaagaggacaccaaaaacagtgatggtgataccaaagatgagggcgataacaaagatgaagacgatgatgaagacgacgatgacgatgatgatgatgaggacgatgacgatgaagccccaactaaaaggcgtcgtcaggagaggaacagattcttggatattgaagctgaggttagtgatgatgaagatgaagatgaagatgaagaggattcagagttggttcgtgaaggtttcattacccatggtgatgatgaagatgacgaagcaagtgctccaggcgcaagaagagacgatagattacatagacaactggaccaagatttgaacaagacttcagaagaagacgctcaaaggttagcgaaagaattaagggagcgttacggtagaagcagctccaagcaataccgtgctgctgctcaagatggttacgtgccccagaggtttctcctaccaagtgttgatacagctaccatttggggtgtgcgctgcagaccaggtaaagaaaaggaattgattcgtaagttattaaaaaaaaaattcaatttggatagggcgatgggtaagaaaaaactgaaaattttatccattttccaaagggataattacacaggaagaatctatatcgaagcccctaagcaatccgttattgaaaaattttgtaatggtgttccagatatttatatttctcaaaaattgctaattcctgtccaagaattacctctattactaaaaccaaacaaatctgatgatgttgctttggaagaaggtagctacgttcgtattaagagagggatctataagggtgacttagctatggtcgaccaaattagtgagaataatttagaagttatgctgaaaattgttcctcgtctggattatggtaaattcgacgaaattgatccaacaacacagcaacgtaaatccagaagaccaacttttgctcatagagcaccaccgcaattatttaatccaacaatggctctaagattagaccaagctaacctgtacaaaagggatgatcgccactttacttataagaatgaagattatatcgatggttatctgtataagtccttcagaattcaacatgtggaaaccaaaaatattcagccaactgtggaggaattggcaagattcggttccaaagagggcgcggtagatctaacatcagtttcacaatcaatcaagaaggctcaagctgcaaaggtcactttccagccaggtgatcgtatcgaagttctaaatggtgaacaacgtggttccaagggtattgtaacaagaaccacgaaagatattgctactatcaaactaaatggctttacaacgcctctagaatttcctatctctactctgaggaaaattttcgaacctggtgatcacgttactgtcatcaatggtgaacatcaaggtgatgctggtttagttcttatggtagagcaaggtcaagtgacatttatgtcaactcaaacaagcagagaagttaccattacagcaaataatctgtccaaatccatcgacactacagctacatcaagtgaatatgcgctacatgacatagtcgaattgagtgctaaaaatgttgcttgtattattcaagctggccacgatatcttcaaggttattgatgaaactggtaaagtgtcgacaattacgaaggggtctatcttgagtaaaataaatactgctcgtgcacgcgtttctagtgtcgatgcaaatggtaatgaaatcaaaattggtgataccatagtagagaaagtaggttcacgcagagaaggtcaggtcctgtacatacaaacacaacaaatttttgttgtttcaaagaagattgttgaaaatgcaggggtttttgttgttaaccctagtaacgttgaggccgtggcatccaaggacaatatgttaagtaacaaaatggatctaagtaaaatgaatccagaaatcatttctaaaatgggacctccatcatctaagacattccaacaacccatccagtccagaggaggtcgtgaagttgcactcggcaaaacagtaagaattcgttctgctggttacaagggtcaattaggtattgtgaaagatgtgaatggtgataaagctactgtcgaattacactcgaagaacaaacacattacaattgacaagcataagttaacatattacaaccgtgagggaggtgaaggtatcacgtatgatgaattggttaatagacgtggtagagttccacaggccagaatgggcccaagttacgtcagtgccccaagaaacatggccactggcggtattgcagcaggtgctgcggctacctcttctggtcttagcggtggtatgacaccaggatggagctccttcgatggtggcaaaacaccagctgtaaatgcgcatggaggctcaggtggtggcggtgtctcctcatggggtggtgcttccacttggggtggccaaggtaatggaggtgcatccgcttggggcggtgctggcggcggtgcctcagcttggggcggccaaggtactggtgctacttctacttggggtggtgcttcagcctggggtaacaaatcaagttggggcggtgcatccacttgggcgtcgggtggtgaatctaatggtgccatgtctacttggggtggtaccggtgataggtcagcctacggcggggcttccacctggggaggaaataacaataataaaagtacaagagatggcggagcttctgcatggggtaaccaagacgatggaaataggtctgcttggaacaaccaaggaaataagtcaaactatggtggtaacagtacatggggaggtcattaatcaccaaaaggagaaccaatatcacccaagaagaaatcaataaaaaagactttaatattaccacgttaataagaatagttatgaagatttcgatgtttcgatgaaatactgaatctcgatctttttttttcatttatgcttgcatttgtatgtcacgagttttccttgattctaacttttacatatacgtatgtatgtatgtatgcatatgtgtttttgcatatctaaatgaaatatcaactttattatgagggagttgattattgtaatgtaattttatataacttctttttcgttagcggaatttctttccgtttgaatcgtatacaaaatgtatgtatccattacttatttacaggataaatgaaaaaaaatgcgtaacgtctgcgtattcgatgggcttacatgccggggctcgtgcttattcatatttcttcacttggctgtacgcaagaaatccaatggctttctttctgccactttccttttctttgcttctttgaaaagcacatgccgtttcaccacaggatcgtatctgacctgagtaaccaaaggtgcacctttcttaatcgagatgtaacgagagtatccacttgccgctgtagacaatagctttataacactattcttagatttcacttttaccatatcggcacataaatatggaaacagttacgatgttgtattcttactatcttccgctgtaggggagcagtcaatacgtttgtatgcagtgaattatagttttttcttattctgatagaaaatactggtcgtttgccacgacatgatgaaaaaaaaaaaagccgaacttgaaaatcacaagtgggataaattgtggggtagtaaaggcatcggacagtctgtttgtaaggcctgctagcaatgaacgtgctatctttttatctgcatatataggaaaataggtatatatcgtgcgctttatttgaatcttattgatctagtgaatttattgagttgcttcttgggaagtttgggagggggtttcggcgttttctggcttcctagcgacgaaaagcatcattggagtgaataacttggacttaccaccggcaactaaaccaaccgcagcattttctagagcagcagtaacttccttggaaccttctggggctagacctaatttttccattacagtaaccattgctgtagtaaattgtctacccaagtaagaagttctgaaaaatgtggccaaattagctaagttttgaacgtacttccactcaccagttaatgggtaataccaagggatttcatcatcattgtccgccaggtcttcgctaacgaggacttcgaaaccacagttcttcaatgctttcctagccacgtcgacatggaacatctttgggataccatcacctagttcaatttcataagcgatctttctatgttcaggattgttttcgtcatatttatcagtcattacccattcgtaaacagcaaaggtaccacccggtttcaaaaccttgtagatttcgctgtatacaccttctaattttggagcgtgacatgtggcctcaattgcataaactttgtcgaaagtgttttcttcgaaatccattttcatgaaatcaccctttacaaagtccatttggtcactcaaattgtattttttagcgtaatattttgccttggcaatttggtaatcgttattgtttagaccgatgacgttacaaccggtaaatcttgcaatctctcttgctgggcccccaacaccacaaccaacgtcgagaactaaatcgcctctttgaataccagccttgtaagctaaataatgttcatgtcttgctatcgaggcagcgaaactctcacctttataaaatctgctgaaatggaaagaggaaccccaaccatattcatagaaatctgtaacgacgttatagtaggaatgtgtggcttcattataatcctcaagacgacgttcttcggcatctttatcggttctaccatcccaatttctcaagtacttctgaacggcttccttttgggcagagttgttcttcgacatcaatgcactcaaacctgtctttttaccaatatcatcaccatgtaactccctagtgaattgggcctgtctttttctcaattctgtttcactcatcttatgctgcctactatattattattttattcttgtttttttaaattatgtaaaacttaaatcgaaagtaaaacagataagggaaacttgaatgaaaattaacagcttataaattacaaagacgaatggaaagaaaaagagagcagcagaggataggagaaaacacccgaactatataaaaagcaatgaagaagttatcggcaacagcaagtattggaggtttctcaccaatcttcgcataaaacgcatgcttcgtaaggcgataaaaatgaagtgtaccattgagacgaagtggagcagtttacagtgaataatacattgtctgctcctcacttactctcgcttctcgaaaacttttttgtatttatcggaaacggcagtaaacgacgccaaaaattgaaaataagtacgggaacgaggtaccatatacgaagatcggggctttgttcggccctaaattttgctgatcttaccctgttgcatcttttcaaaaatagtaaccagccctagctgtttggttgatttgacctaggttactcttttctttttctgggtgcgggtaacaatttgggccccgccaaagcgccgtctttgtcatgggaaccggaaaccctccgatgaagagtaggagggtggcaactgatggatgcgtaaggtcttaagagatacatttgcttaatagtcttccgtttaccgattaagcacagtacctttacgttatatataggattggtgtttagctttttttcctgagcccctggttgacttgtgcatgaacacgagccatttttagtttgtttaagggaagttttttgccacccaaaacgtttaaagaaggaaaagttgtttcttaaaccatgagtgtgtctaccgccaagaggtcgctggatgtcgtttctccgggttcattagcggagtttgagggttcaaaatctcgtcacgatgaaatagaaaatgaacatagacgtactggtacacgtgatggcgaggatagcgagcaaccgaagaagaagggtagcaaaactagcaaaaagcaagatttggatcctgaaactaagcagaagaggactgcccaaaatcgggccgctcaaagagcttttagggaacgtaaggagaggaagatgaaggaattggagaagaaggtacaaagtttagagagtattcagcagcaaaatgaagtggaagctacttttttgagggaccagttaatcactctggtgaatgagttaaaaaaatatagaccagagacaagaaatgactcaaaagtgctggaatatttagcaaggcgagatcctaatttgcatttttcaaaaaataacgttaaccacagcaatagcgagccaattgacacacccaatgatgacatacaagaaaatgttaaacaaaagatgaatttcacgtttcaatatccgcttgataacgacaacgacaacgacaacagtaaaaatgtggggaaacaattaccttcaccaaatgatccaagtcattcggctcctatgcctataaatcagacacaaaagaaattaagtgacgctacagattcctccagcgctactttggattccctttcaaatagtaacgatgttcttaataacacaccaaactcctccacttcgatggattggttagataatgtaatatatactaacaggtttgtgtcaggtgatgatggcagcaatagtaaaactaagaatttagacagtaatatgttttctaatgactttaattttgaaaaccaatttgatgaacaagtttcggagttttgttcgaaaatgaaccaggtatgtggaacaaggcaatgtcccattcccaagaaacccatctcggctcttgataaagaagttttcgcgtcatcttctatactaagttcaaattctcctgctttaacaaatacttgggaatcacattctaatattacagataatactcctgctaatgtcattgctactgatgctactaaatatgaaaattccttctccggttttggccgacttggtttcgatatgagtgccaatcattacgtcgtgaatgataatagcactggtagcactgatagcactggtagcactggcaataagaacaaaaagaacaataataatagcgatgatgtactcccattcatatccgagtcaccgtttgatatgaaccaagttactaatttttttagtccgggatctaccggcatcggcaataatgctgcctctaacaccaatcccagcctactgcaaagcagcaaagaggatataccttttatcaacgcaaatctggctttcccagacgacaattcaactaatattcaattacaacctttctctgaatctcaatctcaaaataagtttgactacgacatgttttttagagattcatcgaaggaaggtaacaatttatttggagagtttttagaggatgacgatgatgacaaaaaagccgctaatatgtcagacgatgagtcaagtttaatcaagaaccagttaattaacgaagaaccagagcttccgaaacaatatctacaatcggtaccaggaaatgaaagcgaaatctcacaaaaaaatggcagtagtttacagaatgctgacaaaatcaataatggcaatgataacgataatgataatgatgtcgttccatctaaggaaggctctttactaaggtgttcggaaatttgggatagaataacaacacatccgaaatactcagatattgatgtcgatggtttatgttccgagctaatggcaaaggcaaaatgttcagaaagaggggttgtcatcaatgcagaagacgttcaattagctttgaataagcatatgaactaaagcgggaactttatggaaaactgggtaaccgaaagaactttttctataatgttacaattaaacttttttaacttaccttgcttcgccttttcgccgaaagtaggtagattgtatcacctcggtatttttttatgtacacaacctatactttaaatatatttagactatgtatgaattctctgtatcaccttcaatgtcaatatagaaactggtaagtgcaatagtaccaataatgattataattataatacaagtatatatatatatctatatatagtggtaaagtattctttacatgatggcacaacgctgagatttatccgtacctgcagaaccactgtttttatgattcttaaacctattcatctggaatttccaacgctttctatccttgttagtggcatgagtagggttatctatgccgcttaaagactttagtaatgtaggtaaaggcaaacttttggacctttccacggcactcatagcattgatggaactctttatctttttcaactcatttttggaattactttcattgttacccttggaattaggtttgtgagaattttttgtcttcaaagaatggctaaaattcgaggaagtcgtattagagttcgacagttgtgtcattggatgaggttcacttgataaaactgtactttcacctgttttagagttatccaactcgttactattacttttatcgatttttgtaacagaattatgtctattgaatgcccattccccgatactgtttacggttctaatagaacgatgtgctgtagtaacgttagattccattctagttggtatgtacatttgtgggcctgactgttctgataaagaagcatcgtcaccatcgtcttcatcgtcttcatcgtcaatatagtcgttgtaaccgttattatatgcagtcgggaaatattgttgcgggtcgttagttaatgataactcagaatctagaggttgctcttttgatattccttccctattatcataattgggatttttgaattcttcttcaacctgtttgccggagtttgtcacaataaccattgtgtaaaataaaatttttggaaatgatctcttgatatctagcaaatcttgaagtgttagaatttgtaaattattcattgaaaaattggaatcatacagcaaccaatcatcggtaacgcttgccattgtaggtttattgtttgactgtctaatcgcagtaaaaatttctttggtgtctggatcctgaattaatatagattgcaaaactagcctaaaataccctagagaatcacaaattgagattgacggtagaatggatagtactgagtaatcggaagaagaaagatcttcatcatcataaacctcttctccatcgtcctctcctgatccatacccttgggcgtcatagttatgatgaattaaattatcctcctcctctggggttgtcgaagtagttaaattgtctatagaactcgttatacttgacaattcagagacataggtggcattcgtgtgatcgatgttttcacgttttggattacctcggctgctactgcttaaactgtagtgggcactactactattactgctactactatagctagtgtagctgaccgaactttccatgctataacttgcttgatcgatactctcgtcacctagatcatgtgagactctgctataatgatcctcaacttcatcctgaccactttcatcctcgcgcctggcagtagttaaactcaggtcttgtccgggatatgtggatgatacgtcttcgccagcaaaactatctattgacattatctcggaatgtgacggtgtatagtcttcattagtgtatgatggaaaaattttgggtagtctattaggctttgaatctactgttcgcgaatgagaaaaatttaggactatagaacttgtggcatcctcttcatcaacttcgttttcattatcttgaggcgtatcattattattgctttgactattcacggatgtaacgtttatatcaactgtgtccggagatgtcaaagtcctcgtattcgtattagttcgggtagctgttgaagtctgggtatttatatttgaccactgatcatccgaaacgtttgattctagcttcccgtttgaagcttttgatgaagatattgtgggtggtggtattgaatttctattgttattgtttaaagccttggaatttttttgaacttgccaacttgtactcgcaaattctaaaaaggtagggtcttggaaattgttgaggttgtccgtcaataggtaatgattttcatgattgtagcagtgggagtgagttaattttgagatttgaatgtgttctaatttttccagatgaaagtaatctttgaggaagatttccaatatggagatatcttcatgaacattctctgggatggaaactaacaaaatcttcttgtttggcctggccgaaatattgttatcaccataaaaatgactattcagaaatctttttaacagagtgtattttaattgattgcctataagttcttcaaaatcgcctaatctgaggtttgttaagtaccacgaccacaaaccattgtcatcattgtcaaaatagtcgcccactctaacggatttttgcattatatttaagtaacagagtgctttttgatggtttttgttaaccgtctttcgagcagttgaaggatgagagtgagtgttaatgaggggttatttctgcaaaacttctgccgatatattctgcacttagttcccgctgttgttcagccttcacgttccttagctacacaagtcagttaaatctggtcctgccaaagtgaataagttgaagatatttatctagcttgcgatggaaaaaactacaataggaaaaaaactaattaaaaaaagaaaaaaaaagagaagaattcaatgtttagggatataaattcgatataaaggtttaaagtaaataaatttcgtgtattactatgcaagtaatgtttctgcctgcaccggcttcgtagctggtggagtgcgatagcgatgatactacctgaaaacacagaggaaggccgtcagccccgcgctaggaacgatgaggagaaaccagttggcgaatcgccacatgccatttacgtaaaagatgctgtgtaacctaacagaaataatcgatggtgtgaactaaagtcctaggatgcacataagcaagcgaaaaagtgaaaacaacatttccagagctaaaaaaatgcatttgccgatccgaaataatctcaaaacgaaaaaatgattatggacgtaaacaaaattaccgcatttcgctctcctattatcataacaagcatgagcgcaaaacttaaaaatccatcaagaggcaaaaaataacgacaactgcaggactcgaacctgcgcgggcaaagcccaaaagatttctaatctttcgccttaaccactcggccaagttgccatactaacttgattatttgtgtattctgttttcttgtgattccttctggttacataattacattgtctatattcatatttgattctaacagcaggtaatattggtctatcggctactcgttcaaaaaattaaaatcgttatcaattatattccatagtataggttgttaaaagatggaattaattaaagtagagtagtagaacagggatcacagtgttattagattttggagcaactgatgtgtgtgagtaatatataaggatgaatcgaatgaaagtattatgagaaaaggaatcatcgttgtgtaaagttgttcatttcgtatttctgggtactgtgaatgagatgaacttgctgataatcgttggcatactattatttggaacggtaatatttttgcgaatacaaagtatactgtagtttttccccgaggatttacgaacccacgagaagtgatcaatatttctacacagtagcattatgatctctctttattcgcttatgtgtcgccattcactaccctatcataattcggatccttgtgtttcagctcccattaagtttgacgaccgttcgtcatttatttatattcttacaccgtacacgataatatacttatgcgaactctagtcggtcgatggtgattaattttcatttcaatatttacttatatcggcgataagtcttaagcatggaatttatagtcattctgtcacccctccgaaacagaaatgaatttgtaaatgtattcactaagtttagccgttttagacatttgaatgtcgttcgtcatcagcgcggccaatattgtttacatgaagaaaatgttgttaatataggcactctatttggtttcattatgagaagtatcttgctgcttgatgtcttcgcactttttttttccagatttttcaggtgatgaggtggagctggaggattttacaatattactcaaataatttgtagacaacgttagcgtgaatgagtgacgaaaccatgcctgtagaatttttagttagtgataaaagactgttgaaaaccataaaagttaaactggaaaccaacggcctttttgttactcctatctattccgataatgataacaaagttataaaatcttctattgaggatctcaatcatccattggctgtcgaaattaacaatatagccggtgtgaaggcacgattccatgaaagtggtaacttggaacgtagtgaaggacatttgaaacaccaaagtaacagcattacggaatttacgaagagctttttaaaagatcatgggcttgctaatgacaagatatttttatctcatttattagatcatttacctctaaaatatacaatatatccaccagttgtattgttcaataattctacagtgagatcgtttaatcacccaatctggcaaaaagcattccaactgaaactcttcgatccaaatgagtattatcgtgagctgctatgtttcctttcgcccggcaaaccaagtaaaggcacgagtcttcatcctaacaatcgactactgactcatctggccataaataaccctatcacagaggcagatgtattgcgaagaccgttcaatatccaaccgctttatggcaaattgattgatgacagtattttggatgataacgataatacgttatgggaaaatcccagtcaagaacaactaaactcaagcatatggtgtaaggtcatacaaaatggtgtaacacaaatctggtcacccgtttttaccatgtttagtagagggaatatcaaggagaagaaaagagttttgactactttcccagatatttgcaataatgatgtggtcgatttatacgcaggaataggttacttcacttttagctacttaacaaagggcgctaggacactttttgcatttgaactaaacccttggagtgtagaagggttaaagcgcggcttaaaggcaaacggattcaataaatctgggaactgccacgttttccaagaatcaaatgaaatgtgcgttcaaaggcttactgaattcttatctcagaatcccggatttcggttacgtattaggcatattaatttaggtctcctgccttcaagcaaacaagggtggccattggccatcaaattaatttacttacaaggagcttctttggaaaaagtgacaatgcatatacatgaaaatgtacacatagatgcaattgaggatggaagtttcgaaaagaatgtcattgtagaactcgacgctattaatgagtcaattgcattaattagaaaccgtggcatcaaacttcagtttgtgagatctaagcttgaacgcataaaaacttttgcaccagatatttggcatgtatgcgttgatgtcgacgttatagtaagtacttaaatacaaaatataaataataattagtgtatgaaaagtcaacaagaatggtcattattgtaaaaaaaaaatactaacctcctattcatttcaactttttaggcaatcaaaccatgaggaacgacttcaatggaataaccatcaggatccttcaaaaaggcaatattcttcattctgccttggttaaatttaggagaccattggatcttatcgccgtatttcacttcaatttctttacaaagggcgccagcgtcatcacaacttatgcagatgtgaccataaccctggggctctgagttaccgttatgatagtggaagtttggatcattctcagttccccaattatgagttaactccaacacactttcacatgaaaaaacgctgtcggtctttggaacgccataaccaagaaagtataacgtaaattttgcactttcgtgctcactagttcttaataatttcatgcccaacacattctggtagaattctaaagaccgggttgggtttttaatacgaatcatggtatgattgaacttgttacctactgagccctttgggtattcctgaccctctctagaatatgtgatcaactcaatccagtatccatcagggcctaaagcaaacgcaatgtccttctgtcttccttcagagagtctcttcttgaatttgacaccctgagattctagctcttcgcaggttttattgatatcggatacagaaaaacagatgtgcccaaatccacgatgaggttcctcattcccgttgttgatcttgtagtctgggtttttttcagtaccccaattgtgagttagttctaagacaccgtgtgcgctaaaaacatcaggctctccattcttatttttgggtatgtcgtcttttggaaagcttaaaaagtacaagctaaattttgcttcttcaaaatcctttctgcttaatagcttcataccgaagtgttcggtgtagaacttaacggtccttgctggatccttgactcttaaacatgtgtgattaagcagaagggttggatcattcgaggctttctcaatctgaattggatagcgtgtactatcagtggacattgttagtttgtagctggtggcgtatctggtctgaagtgtcaaaaaaaaggcatggaaatgttattccgattttttttctccctatttataaacgtcactaactagaaatacgggatatcaactactacgagagagggacattctagtatcaaagaaacttactatgacgcagtttaggatccctgtggtgactacgtatccaggtctactactccatcgtaaagccccttgtttattcagtgtccagatcatatgcgggatgtgtattttgtgctgagtggaaaaataagatcatatgctcaagaataaagggttaaagggtatggaaatttcagttctccctggctcaagaacattgtcagtattcctataactgaagctgagtggtactaatgcaccgagatgcaaagtccgaaccacccccacccccctctttacctattttttatattttgtgataaagggataactcgtcttgccttcactgcgcttcgattctactttagctaaactaagcgttactttgtttgagaatctctcagccgttaaatcaacgtacttgtatactaaacagtatattcacgtgataactttgccttacacctatgatatagataaatatatacatatatatgagtgtgtgtgcattgcgtcactaaactatgtttaatatgacagaaggttttcgtttaattttgccgctacccgaaaattttggcagttgcaatttataactaaaggaaccaccttattgtaaattcctcaacggaaaagctatggcttagctagggttgacaatgtcagtttaccatttaccaacgctgttgaacccgctggttaatgctatatttaactgtcccgaaccagaaagatccccattgaaaaagcttttcgctaatttaaaaacccgtaggtttatcctcctagcacctccttcagaataccttttgaattaccacgatgtcaagagcaaactgccgttacatgacctctgttataatgcagagtttattaactcttacatattgttaatgactgaaaactcttacataaatacgaattcaagggacagtcattatgaaacgttagatggtaagaccgttgttattcaatggaagaataatgtgatccatgccttaaatggatttcatataaggcgaagactaaagattctagagacaaaaatattacccaattttaatgactactttgaaggggcggctgattttatcatactattcatagatcaacctttaaattgcgaatttgtacctaacgactacttacagtgttttcacaattatgagaaaataccaaaaaatgcacatgctatgccaaatctgtcgatagattcttttcagcaagaaagatcgtcattcgagaatatattgcacattcatcctgctcgattaacacagcttggccaattgttttcgagttacagaacgctcgctcctggtgatgatccatctagaagtatttttgaaagcatcgtgcaacaagcatttgatggaatgaaatcggattcacttttcaagaacttttctaatctttacgatcttatacacgactattttgaactaaatctttacgatgatatatggtctaggcttactacacatttcaaaggccacgaagtagacactgaaaaaataaatatttttcagtgaaccagttgttgacagatttttactcaaaagattatggggaatttaaattacacgacatcactcttattgaaaggcgtctccatctagcgtccaaacatcttcaaaagttggctttgacccattcatacgctgaaaaatctaaaatattagttgaaactctacagaaattatcaggtactaccgaaatggattcacatcaactagaactaccagacggattgaataacatgacgatggatgcagacactttaattagcctttttgtgctcgttgtttgcagaagtgaacaaaagcaccttaaaagtcatctttactatttgcaaaatttttcgaataactcttcttctacaaaattcggcattctagggtatgctgtatccacactggaagcagtggtttgttatttcgaagacttcaacaaaaatacaggcaacgtggcgaaagctaacacattatgtgaaaaaactaagaatttattagataagttgtcatgtgaaaaccccacaaatgaagtagaagatctggcaacatacaaggatattttgacctacagaaatgagcaaggacaatccattctatccatatgtataacaaatcataaaaactacatcttattagatattctttctgaatatgaaaacgactttccagtagaagaccttttagaggacgaaacgattgatggttctacgctgcttatagaatcgataaaagcaggaaatttagaagccgcgaaagttctcataaagatcatgctgttcaattgtactgaagaggagctggtttcttatatcaataaaacagataaatatgcacgtaccgtggctcattatctaacccatgaaatggatatacttaaaagcatcggaaattatattgattggaaacgaaaaaattccagtggacaaacgcctttattttccatctttagaagttatgatcaaccaaattatgaagaaatggtgaagaccgcatttgatatcgcaaatacttggtatagaaagcacaacagtttgtttgactatctagaccacaccgataataagggcaatagcttgttgcatgttttgaaaacaaacattccaatccttttacaactgactaagctagatattaatgaggaaaattataagggattgacgccattaatggtatatgtgaagtacaaaagactaagtaatattgacgccatcacgaaagaccgtcgacttatattagagaaggttcaaaactcgaccttcttcacttgttttgattatgcaaaagatcactcggtactaagcaagataggagaaaggggtgtcaaagattcactttttggattaatatattttcattctttgcgatatcataatttaaatgcgacaacaaatataacatccgtttcaaatgcagagaaacctttcgccactactgttattaacatgaaaacaattcaaggcttactacgctcaattctgaaagacaatccgttcacctttttgccattaaatacctatatcgatgaaatatcgcacttaaaccgttctgatttaacaataatcgggaaaacagatgtcacatcgttacttcaccaattaactaactgcttcaacgttcttttattcctgaaaaaaattccagaaaatttgttcactgatgaggcttctatcttatattggatgcgcataaacacttctaaaagaaaccagaaaccctcaggaaaagaaaatccaaaaacaatggaacccgaggagattaatatgatacaaagctttttacgttttaattttgatgagatttcatcatttaaggcaagcttgaatattttgaggaaagtcttaatatttattaatttgaaatccgatgatttcgaggatgcttataagggtcttaacgaaatgggtagaaaattaattaatagtgaagcatccagcgcatttaaggggattataacaaatcataatatgttcagtgaattatcgctagcagcactactagaaaacgtgcgtttcttggaacaatgtactatccaactatctagtttcgttcagataattttatttgaaaaaattccgaactggtggaaacattatggtgagtttttagctttacataaaagctatcggaaggcttttcctaacatggttaagccaaaaagtgcatcagatacctctagtcgtgctccacttggtggttttattgaaacgaagcgtgaacaatcggagcaaagactagcggttcagataaaggcctcttcaaaaatgctcaaagaacttggaagcgaaatttttgtagctcacgaaaggttggccgaggaactaagcaattatatggagttcaggaaggcgtgcttagatcagcgtagtcttgtggcatttgccacaaccaacattagcgttcttcaagaatgtgtttaagattgactgagcattgcaatattttaccttcttctcacttgttctatagaattttttacccaaaaataagagataaagagtttgaaagaaacatcattacatatatatatatatacgggcagctccgtaactcgaaaagagtgacagctgttttactctgtaatagctgacgattcttcagtgattggaataacctcagaactcaccggtacgggtaacgtttgtatctcgcggattaacttttcgcatttcgacctactgagagaagaagttccttttgttaatctgtacctttatcttgaaagcagtcgttacagaggaacagcattgggaatcaccaacaaaataagaggaataagctcatccagtccacttcttatccatatagaaaccccttctgtatcaattcaaattaagtgatgtcttctagaaaaaaaaatattttgaaagtaatcatcctaggtgactctggtgttgggaagacctccttgatgcaccgttatgtcaatgataagtattctcaacagtataaagcaacaattggggctgactttttaacaaaagaggtgacagttgacggtgataaagttgccaccatgcaagtttgggatactgctggacaggaacgtttccaatcactgggtgttgctttctatagaggtgcagattgttgcgttttggtctacgatgtgaccaatgccagttcctttgagaatattaagtcttggcgagatgaatttctagtgcatgcgaacgtaaactcaccagaaacatttccatttgttatactgggaaataaaattgatgccgaagaatctaaaaaaattgtatcagaaaagtccgctcaggagcttgctaaatcattaggcgatattcctttgtttttaacaagtgccaaaaacgccataaacgttgataccgcatttgaagaaattgcaaggagtgctttacaacagaatcaagctgatacagaagcctttgaagatgactataatgatgccatcaatattcgcctagatggagaaaataattcttgtagctgttgagctgtactacttaattgtatcttctattatgtaatcctttatagcgtatccttaaaaaaattaataatttaaaactactaaatatatttagggatgtgatggccctttcaatatgaggctttcgattaccatgtgcaatctgtctatgaaccttagttaattaacacaactgttaaataaagcgatttactacacttgagataatataactcaacaaaacgtgacaaaaaatcacatgactacctaacaaaatatttatttttcttttttaatatttgaaaatactaaaatatttttgttgttttttgaaaaaaggatttttaatgtgtatgcgttccgaactttaaatataacgtcagcgtaaaaataatttttctccgaatgtatatcgaaatctcaaattgctcttagagatttagatttcaacgacaggataaattggctagagttgaaaaaactgcacagagtatataaaagatcttgcaatggatgattaaaatttacggtatttcatttttccaatgaatggcttttctaagagaaattaatttcgcaatttgttgatgagaagttctggctaccttagtcactatttattttactatggcggtataagtttctcccgccttgaaaaaaggaatacagtaataaaatgaatataaatcaggattttttggattttaactaggtaacaaagaattagcaaataactgcccataatagtattcttaagtttgtagatacatgtcaagtaagccagcttttgataaaacttaaaaattggtaaaccgcggatgtaccaagtgaatagctttcaaaattaatgttgtcactcttccaatgggcacctgtaagaataattaaaaagaaatctaggttcaaaacaatatttttgagaaaatctcaggaagcgacaggttatcatcccatacatacaatatgaatacaaaagcatggcaattttgaatagatatagctctagaaccgctcaggcgaaaaaaaacgctatatgagaactattgaaaaggaagaactaacatgaaagatgtttgttcatttcgtacctttagaaaaagggtattaatgctaggggtaaatattatatattatcttcgttaagggcaagaccatttattttatttagtattagttattaatggggcccaatcaatggactggtaatttcgtattcgtatttctttctactttaatattggtttaatctacggtaacaattgtggacttctgcttcaaaccttcctttatcaaagttagtttctctctaaagttactttctggatatcctgggatctcgccatattttagtacttcaactaagggatatgtggtgctttcatgggagggagaaatgtaggtcaccaatttacctccgtcggatattgccattttatgatgatctttgaaattgaactggaaagtaccatcacttagttcaaacataacaaatggtttataccttgtgtatcttctcaaaaatacatcatctttatgatattcttctctgccaaacgtagatactcggctcaaatttgccttcatgtacttggcaaaaaaatcaactacttctaaatgtctacttagctctcgtggtttttcgctcaataaataatgacttgctacccaaccttcccgatcgtcataactaatataccaaaactcttctgcatctgccaatcggagaactgtggtgccattattaaataagacaccaatatcctctgttgataactgataggagaatccgtgtttgttggagtagtcgacccacttggtaactatcattgggtgtttaattttaggcaatcttgatttcggaagacctcccattttatactgagcttctgcttctacaatgccattcaaagtaagatgacactcactggctaatattctcaaggagatttctgatttaatgacattggtcgatgtagctattaattcttttctcaaaacggcctgttgtgctctacgtatccttgcttcacgagccaaatcgtttaatcttctttgtgcctctatatcaacaacctccttatatttctgtttcgtcccgccaggggataaagaatgtggtaaaaatggtctgttttggtggtactcttctagtttatcgatactagatttaattgaagaaatataatccctcttttgacgctgaattttatcgctgctcatgctttctaatagtagagatttttccatgcaatctttgaagttaaccagtgactgctcttcaggaatatcctcaaaatttggtgcttctgacatgaccgtcgaaggaatagatggtgggaaagttcccctaaaccatacataatccataatttcagtcaaagagggcctttctattggatctaaggatagaatgtctcttattaaaatcttaccttcatctgagattggtttatctcttggaaacgaaaaatcacgacatttgattctttcataaatagtgtttacatctcttgcttggaagggtggcttaccaatcaacaaagcataaagcataacacctaatgaccaaatatctacttcaaatgaatgtccagaatgcttacccatcaacacttcaggtgcgatgtaattaggtgttccgcatatggtgtatttacgttcactttcattcgccaacacagctgccagaccgaagtcaccaatctttaagttatagtttgaatcgaagaagatgttaccaagttttaaatctctatgtataactcttcttgaatgcatatacttaattgcaccacatatttgagtggtgaaaaatctaacttctggttctgttaaaacttttcttctttttagtaattccattaatgaaccgttggggcatatctccaataagatatagacattgctatcatcctcaaaacaatcaataaactgaacgatatttggatgggacatacttttatgaatttgaatctccgacaacaacttttttcttgtcttctctgatttaattgaggctttagcaactgttttggcagcaaaaatttcgcctgaatcgtccttaatttggaaacagcgagcaaatccaccttcacctaaaaaatgacctcggtgatagtcttttcctcttgttttgattaatgaaggtggtgttttacacaaagctgataacttttcccttttctttttttgagctggctggtggtgatgatcattattcggatctagtctctttgtttgtttaaagtgattttcttttcctacgaggtctgcggtatttccctttattggggtgtgaactaacttggaacgggtattcaattgcttatcattgatagctttaagaggacccaacgacatctttattcgacttgatcttactctgttctttcttctccacggctgtgatttttattctctatgaataacaaatgtaacgtttatcgatgaatgaaagagagtatatatagagaagatataagaaagccaatgtttttgtgtacaaaaaataatactcagctcaattatacaaacttgactatgcagtttagcttttttgtcttttcttttttaagttttcttgaaagttaatgtagtatatgccacaaaattgaaggatgaaaaaataggaaaaaaagcagaatcagaatttgacacaaaaggcttattgttctttgaaactgccgcttgaattggatttactttctcagtgattctatatgtattgtacgaaagttgagtagcacaagagtaactgttcaagatatgccttgtttcaaaggatgtacattcaaagatcatcccaggtcctcgagatatttattcgttctatattttggattttctttattgggtttgttttgttttgacccttttaggtaatatcttttgacagagaaaagtccaaaagttcttccgggtgatgctacataatgccctacccgggcaacatatagaataaggtatataaagtaataatatgcagtgaagttaccaccgggtaacgcatctagaacagctgagatgaaagaggataggcttgatcgcagattttgcccgccctatcttttcaatgttccttcaacaataacataaattttgatgtaaaaatatgctggcgtcctcgtacgattccctcttcatttatcacagaagatggtgatgattctacacatctggaaggcaataacagtgcaacttcattttccgaggttcggttatgtcatgtgtgcttttatacggcaaacgccaccttgaacaaaggtataaaagaaaagcgctttttcactccaccgcaatctccgcgacctatataagcctatcactcgtacagtttataacctttaagaaaaaggattaatatttcgaacaaagaacagaacaagaaaagcaacaacagcaacaaaattctaaaatatggcacgttcaagaggatcatcaagacctatatcgagatcgagacctactcagacaaggtccgcttctaccatggcggctccagttcatccacaacaacaacaacaaccaaatgcctattcacaccctcctgctgcaggtgcccaaacgagacagccaggtatgtttgcgcagatggcctccactgctgcaggtgttgccgttggtagcaccattggacacaccctaggtgcaggtattaccggtatgttttccggatccgggtctgattccgctcctgttgagcaacaacagcaaaatatggccaacacctccggccaaacccaaacggaccagcagttgggaagaacttgtgaaatagacgcgagaaactttacacgttgtttggatgaaaacaacggcaacttccagatatgtgattattacttgcagcaactaaaagcctgccaggaagctgcacgtcaatactaagtttaaaagctcaaaaatttagaaaatattcactaaaatcatacatttcggtaatgttcttgttttaaccatgtcatttgacttatttttttttgatggtttttcacagaatcgcatactccacgtgagaacaagaaaaaatgaaaggaataaggactaaatgtcttatatatatggatatttatttgttttattttgtatgtaaataacttttataaatcaaatcatccaatttattgacttcataatcatttaatcatctgcacccccaccgcgcggtgtggctgacatttcctatgaagttctcaacaggggagggtaacgtagtaccttcgaagagtttgtttatttactatattttatgctcttcttcagaagggcctgtgatacgcatgtttctcaaaaagacacctagtgcagctgaaccggcaaagtaaagcttctgaaagaagacatgtcaatttctctattaggtagaattgtttcacaacaattctccggcatacgggcggctgagccagggagatctctatatttaccgtttaccttactattgaaacagcccggtgcttacaaggtgagcctacacagatatgtacatagcacccaaacgaagagccacttgagctttttaatgaataataacgatataacaccttttcaaaaatttacagttaaagttctcaaagagcagtgcaaatcaagagggttaaaattatcaggtcgcaaatcagatttgctacaaagacttatcacgcacgattcatgttcaaataaaaaaagtagtgtgaagataaatgaacccaaaaaaaagaggatattaataaatgatccaatcaaaatcacgaagaaattggttagtgataaaacttttagaactattgaaaaaaatatttcttcactgcagaacacacctgttatcgaaactccctgcgacgttcattcacacttgcaaccaagggatagaatattcttattaggatttttcatgttatcgtgtctttggtggaacctcgaacctcaggaatctaaacctaccattgaccattagaaatataattctagcactgtaattaattgaactgtatattctttcataatttattaagacacttttacttttctctacgctctcaataagttattgttgatccagatcatctcgatattgccgtcattttcggttaaggtaggcgcttttacgaaacacatgccagaaaaaaaagtgaggaaggaaggtacaatgaaaacagggtgaacgccacttcttttcacccaagttgtaagagaaataatagtaaaagcaatcgaatttggattctataaaacaccactgaggcgaaaaaaaaagtaatggacaattacgaaggcagtgatccttggaataccagttctaatgcatggactaaggatgatgatcacgtcgtttctaccaccaatagtgaacccagcctcaacggaatctctggtgagtttaacaccttgaacttttcaacacctctggacacaaatgaggaggatactggttttttaccgaccaacgatgtgcttgaagaaagtatctgggatgatagtagaaatcctcttggtgcaactggcatgagccaaactcccaatatagcggccaatgagacagttatagataagaatgatgctagagatcagaatatagaagaatctgaagccgacttacttgattggactaacaacgttagaaaaacatacagacctctagatgccgacatcatcatcattgaagagatacctgaaagagagggtttacttttcaagcacgcaaactatttagtgaaacatctcattgctcttccaagtacctcgccttctgaagaacgtactgtcgtaagaagatactctgatttcttatggttaagagaaattctgctgaaaagatacccttttagaatgatccctgagctacctcccaaaagaattggatcccaaaacgcagaccagctttttttgaagaaaagaagaatagggttatctagattcattaatttggtaatgaaacaccctaaattaagtaatgatgatttagtgttaacatttttaaccgtacgcactgacttaacaagttggagaaagcaagcaacctatgacacttcaaacgaattcgctgataaaaagatatcacaagaatttatgaaaatgtggaaaaaagagtttgcagaacaatggaaccaggctgcatcttgtatcgatacctcgatggaattatggtatagaatcacgcttctcttggaaaggcatgaaaaaagaattatgcaaatggtacacgaaagaaatttttttgagacactagtggataactttagcgaagtgactccaaaactatatccggtacaacaaaatgataccatattggacattaataacaatttgagtataattaaaaaacacctagaaactacgagtagtatctgcaaacaagaaacagaagaaatatcgggaacgttatcgccaaaattcaaaattttcacggacatcttactttctttgagaagtttatttgagagatacaaaattatggctgcaaataacgtagttgaattgcaaagacatgtcgaattgaacaaagagaaattggaatcgatgaaaggaaaaccagatgtcagtggagcagagtacgacaggataaaaaaaatcatacagaaggatagaagaagcataatagagcaatcaaacagagcttggttgataagacaatgtattttggaagagtttacaatctttcaggaaacccaatttttaataacacgtgccttccaggattgggcaaaattgaactccaaccatgccggtctcaaactgaatgagtgggaaaagctcgtcacaagcatcatggatatgccgatttctcgtgaataaattttacggagtgaagactaaccacttagtctgccaaaacattattgaaggatatccaacagatgtaattgacgtactaaacagagaaataattaggtaaatagagtaaagatatgtaccactataaattgttatttatttgtttttcaattttaaatacagtgtatgaagcctaattcggatattataggttcccatatttattagaaggtaacaaatctttcgataatttggattagatagccttataatatgccggacaaacgacgcccgctaaaaatgtgtattctccagtattcaatattcgtcataaatgatcttaatttgaaaaagtgaatgaactgaacatcgataagtcgaatgtggtccgtgtaatagctcaaatgggaaagtttttctaatcagcattctgtataacctcacctgcacgtaatctaaagtgcttttatcgattggtagtgcacatattgtctttcggcatcatatcacataatggcaaattcgccgaaaaagccatctgatggcactggagtatcagcgtcagacacgcctaaatatcaacataccgtcccagaaacgaaaccagcatttaatttgtcaccaggtaaagctagtgagctatcacatagccttccgtcgcctagccagataaaatcaaccgcacatgtatcttcaactcacaatgatgcggcaggtaatacggatgattctgttcttcctaaaaatgtatcacccacaactaatttgagagttgaaagtaatggagatacaaacaatatgttctctagccctgctggactagctctaccaaaaaaggatgataaaaaaaaaaacaagggtacgagtaaagcagattctaaagatggcaaagcatccaactcctcaggacagaatgcacaacaacaatcagacccaaataaaatgcaagatgtccttttttccgcaggtatcgatgttagggaggaggaggctcttctaaattcatctattaatgcctcaaaatcccaagttcaaacaaataacgttaagatccccaaccatttaccattccttcacccggaacaagtttccaattatatgaggaaagtcggaaaagagcaaaacttcaacctgacccctacaaagaatcctgaaattttggacatgatgtcaagtgcctgcgaaaactatatgagagatatcctaacaaatgccattgtcatctcccgacatagaagaaaagcagtcaagataaattctggtagaagaagtgaagtttctgcggctttaagagccattgcactaattcaaaaaaaagaagaagaaaggcgtgtgaaaaaaagaattgcgttgggactcgagaaggaagattatgaaaataagattgattccgaagagacgttacacagagcatcgaacgttacggctggccttagagcaggtagtaaaaaacagtatggttggctaacttcatcagtaaataagccgacgtccttgggagcaaaatcttcaggcaaagtcgcctccgacatcacggctagaggagaaagtgggctaaagtttagagaagctagagaggagcctggtatagtaatgagggatttactctttgctctcgaaaataggcgcaacagcgttcagactattatttcaaagggttatgccaagatcagagattaattgctcatctcttatactgtctataatatttaaaggtatagtgtttcaaataaactaggatataaaaaaaacaagattgactaacataaagaaggccggttggtgtcgcttagtcaagtcatcgccaagctattgaggaccattcaacctttttgctttgttcattttaactttataataaggaagatatatcaatccttgaagttaggcatccttctaccaaaaatagcggaaagaggagtgataatcgggaaaaaaattttcatattaatacacatttttatacatttacttgtcattatccttttgggtgaaaggatgtattatgtattgtttctcagaagggcttctaaattagtccaaataatgctgttatggcacctaacaaactcattagagtattagtgttcgcataggaaatagccgcagcattcgctttgtttgccgtagaggaagaagaacgagctgtagaggaagaaattgaagaggatgaagaatttgagtttaaagttgtatttgacgaagagtttgagttagaagtgacatttgatgaagtcgaggttgttgagtttgatgtagtatttccggaggttgatgaacctaagagagccgttattggaataccgtcagtagcctcagagattgcagaggcaatagcaccgctttgatacgtactatttcccgatagttcaggattagctgaggtacttagtgtgccgttccagcagtaatccgcaaaacatttggtacattcagggggcaaggtggcatttaggctttcttgcttacgtctaatgatggcacaacctatgcaacctaaaaagttagagtcatccgtaaagttgcccattgtagcagcttcaaaaccatttctgatcattccaagacgttctgtaacattgtagttcatcttcaaagtactttggttaccattgaatgaatgttttgtgtttgggatatatacaactaaaggtggaatatactccaagtccgtcaaattttttgcatcacaaccaaaaaacgttggcttattagttaagcccaagttaaggaaggtgttaacgtctggaacatatgggaaagccattcctttaccttgcttagaatactggcgctcataagtgttcgtcatgcacacaccacttggccatgattcatcagtattgtcggatatatccaatgcgaacaccacatccaagtcacgttccttcttgattagtggaaccaacggcaaattttggccgtcctcaccaccatcaactaaaaacaaatcatcggcatcaacaatactggaagtgtaattgcggtcaacaaattctgtatccttgaatggatttgcagcgtaaattgcaatatcatcgtcatcttgggataggttgttaacgtacttgttggcaaaactattaatcattttataataggtcgaagtggaagcttccagggaaaattcgttgaataaactggcggatgtggcaattacaaatccagcattatcgtaaccagaaacgcattgatccttgttgaccggtttaccatttgtaacgttggtacctagatatttcacatccgtaaaagcgttcaaagaaggatcccaagaacccatttcaaatggagtgaactcgaaaagagtggcattcaagtttatcacggtggtacctgggtatctaccatctgcaacagtaattggtaaaggcatttcaccgtttttgaacacatcaacatctctcaaagaggaccaagtcaaagcggagccagcatctggcaagcttggaaagaagttgtaagaaagtgcacgggcccacaaatccgacaaagatatattgaagcctgcatcagacttagcctgcacttcttgtacaatggactcccatctttcaattgtgtaggtcaaattagagccaccagggttcacaatggatttcgtgatattccagatggaatcgctctcactcatatggtctacaatttcctgtacagaggtccaattgttccatgccaaagtaccagtcaaccagttaccaccggacaaacccgatagatacgtggaactttgtagtaaaccaccaagaccatgctcgttagcaccatcagtacgattgtccatagcagcaatcataccagcaccacccaacatggcacgataaccaccaccagagcatgcaataccaattttgggtacattggaagagttactactgaaaagagtggatagcaaagaagtgtcactgaagttagaagtagctctgcttaagaaggaatgtaaagcttctttagtgtacgcatctcttttctttaaccaatcagtttcagcggtagataagccagacgcgtttctaactaaagaggtatcatcactgggacaaggaattattgatggagcataaccatcaccagtagtggacgacgaatctgcagcgagcgaaagtccagaaattagcgagctagcctgtaatatgttccgtaattgcatctgcgtaagaagtgttactttaccagcgcgagtgaattttaactcacttctaacccttgataagatttgaaggcacactaaggaaaaacaagctaaaagacatttctaacgccttgtaaagataactaattgtgctcatatataaggtatattctactccacatgagatacgaaaagaagaagattctcagactatttaactctttgtcctttttttaccttttttttgatttttttttcactttcttctgttggtaaacaatgccaaggtggagaatatgcggaagaaatgtccgcaaggtaaaaaattgttgaaaaaggcgacgcgtccctttgtaggagcttttcgaaggcgtatacgagccaagaaaaaccttatttcccagtttggccagaccggctgcattgggtgcgacggtaaattctctataggcatcaccattgaaaagtatgtccttaatttagtcgtgagaatcatcattgtgttcgccctttgtcgtataaccgaattgagtgtctttgattcatctctaaggtgtaaaagcagaaaaaccagattatctaaagctgcaagaaagaaagaaactgatcattttcatgaacagtgcagatatgtggaagtgaaatttggcctgcagatggcatatctgcaatcctagctttttccttctgcactttaaacctatctatatatcttcgatgaaagtactgcatgaacatatctgtatagatagatatatgtagggaagacacccggtatgtaaatgttaatgctcgtaagatttcgagtttgtaaaaataagatgcggtatgcacttgagatctcgtaaactatttgtatgttgatatttttgcgcttttctcactctcgtattcttttagaaaagaaatagaaacgaagaaagagcctaaattagaccgaagacggcactaatgacacttaagacaccaataaaagtgttagtgtttaagttagaataattcaccaaagcattgcccgcatttttcttatgagtggaagacccagaagcagaggcagaggcggaagcagaggcagaggcagaggcagaggcagcagcggcggaggcagacaaggaagcagaagaagaataatcatcatttcctacacctgagactgacctgctgtcaatagtaccgttccagcagtagttggtaaaacactggctgcattcagagggcaatgtagcattcaagttttgttgcttacgtctgataatggcgcaaccaacacagcccaagaaatcagaatcatcagtaaaattacccattgtggcagcttcaaacccattcttaatcataccaagacgttctgaatcggagtatgacatcttaaaagtactttggttaccattaaatgaatgtcttgaatttggaatgtaaacaattaatggtggaatgtactccaagtctgtcaaatttcttgcatcacaaccaaaaaaggttggctttttgttcaaccccaagttgacaaatgtgttcacatctggaacatatgggaaagacaaattgagaccttggctgccaaattgacgctgataagtgttaactaatgaagcaccatctggccaatagtcgtcagtatcagcagaattgtctaatgcaaaaataacatctagttcacgttccttttgcaacaatggaactaaaggaatattttggttatcttcaccaccatcaaccaaaaatagatattctgattcgataatactggaggttgcgttcttttgaagaaaattagcttccttgaatggatttggggcgtaaattgcaatatcgtcactattgtcggataaatcttccaggaaatcggtggctaagttagcaataaatgaaggtaaatcggtagaattcaatcttagtaaaaattggttaaacaacgtagatgaagtggctgttatgaaaccagtgttatcaaacccggcaatgcattggcctttattaactggtttaccgtttgtaacgttggtacctaaatacttcacatccgtaaatgcgttcaaagtggggtcccatgaacccatttcaaagggattaaattcgaaaagagtggcattcaagtttatcacggtggtacctgggtatctaccgtctgcaacagtgatagggaagggcatttctccattcttgaagacatcagcttcccttaaagttgaccatgtgtaccctacaccaccacggtgtaagcttggccaaaaattgtacgcaagagcacggccccaaacatccgccaaagagatgttgaaaccggcgtcttttttatcctgaacgtcatctgatatgtcgtcccatctactcccagtcttaaagatgttaatgccgtctggggtaagaattgaatgagagatgtcccaaattgagttagattctgttgtattatccacgatagcttgcacagacgtccagttgttccaagccaaagtacttgttaaccagttaccacccgacagacctgccaagtaagttgcaccttgcagcagcccaccaagaccatgctcatttgcgccatcagtacgattgtccatagcagcaagcataccagcaccagacaacatggcacggtaaccaccaccagaacaggcgacggcaatcttaggcatattggaagagttgctaccaaaaagagtggatagcaaggaagtgtcactgaaattcgaagtggccctattcaaaaaagaatgcaaagcctccttggtgtatgcatctctttttttcagccattctgtttcgttatctgacaaaccagatgcttctctgactaagttaatatcatcatcacaggttacgttcgcagggacgtaactgttatttggtgaccaagcgttaacgttctctgttagagaagtcaaaactgcagcagaaaccaacaaactctgcaacttcatggttttgttttattttctttcccgtttgcccttaggatggatagcttcgtgtaatttacgttatatgaacgaaaaaagagagaaatgttaagaaaagaacgaagaattgattagttagtataacctaataaatgtagaaccttacagcgaagagacgtttccgttggttaaatgtggtggaagcgtctttatatattagatgatgtagtttacctaagcagttagaagaaaataaagtaaccaagtcatcttctaagcaaaaataggagacgtaaatgaatgttgcttaactgagaaaaatatgcgggaataagcggacatgttactgtatgaggttatttccctttatagataagggcgtaaaccgcatataatgaggaaaggcgaagttagaaacggactttttaggtcgctttgaagaagtccgtgcaggaaacccatgcgtccacttattttagcactatgtggcatgagaaagctttggaaggaataaacgttaggaccccactgcgccgcttttacgcagggcaatttcggggacaaagggggctgaaggaatacaattccgatccaaggcaacaagtaggtcagaaccctttattaacctgcgcttgttagtggcttcctttgtactctgtccgtaatccagcatagcgctgaattgctgaaagatatgggtagcggtcagatgagaagggcaatcgtcaggacttctgttgaaaagcggactaaacataggcattatcattcttagagttttacgagcaaatagaatcgagtgacttccgtcgttgctaacaggcgcagtaataataaccgcggacgaaagccacgcaggcaaagaatgctttcgctgaaatatcggagtcttgctattgttcaggctttgccggtgcgtaaataataggctgaagcgaatttgatttcccgcacaaaaaatttttgctcgagtaagtcatacatatatcttgcatgcgtaaaaaaaattgcaattgctgaagattgaacgaccgcccaccggtattttcatctcttctagatcaagactaactgctcgttcagtacaagtattttacgatagtccatattactcttcaattaatattttttttttatattctggcccgtttttgacacaattttttccttctctttttctccctataaactatgcagaagtagcgataatcacgatcttgttaatgattcacatgtgcgcaagtcgtattgtctgtctagatagtgagatgccttctaaataacaggagagaggcaagatagcataacggcgcaatgaaggtaatttctgccagttttctttgcattgacgactgaaagggcccttgtaagagccgctcgacagggcgacgccacagtagagtcgctaacaccgaaatatgcatattgaaaaacatcaaagtataaaagaacaaagagggtggcatctgcagatcaaaaaaaacaataaccaccaaacaagacactaaaaaaggtcgtaaaaaggtcaaaagttagaatggttaaggtatatattcatgacaacaaggttgactccgattatcgcgcaccccacaattctggaacagaactttccctggatgaattagccaagttaggagtgatttataaatactgtgcaaatgaggaagaagtgaatgaaattgctaggcaaagagaatataaaaatagagatgtggtcaacatctgcgaaggttccttcaaaagtgaagcagagtttaatgaaaaactagcaacattctaccaagagcatttacatgaagacgaagaaataagatactgtctcgagggtgctggatactttgacgtcagggatgcttccacaccagagaactggattaggtgtttggtagagtcaggtgatttactgattcttccaccaggcatctatcatcgtttcaccttgacaactagcaaccacatcaaggccttgagactgtttaaggacgagcccaaatggcaagctatcaacaggtcaaatcaggctgattcattgcctgtacgcaaggactacattgccctgatcaatcagtactaaatactgcatcataatacattattcttaatgtcttacttctttatatctttaaagtagcgtagggtgacttccccgtcaagaatgatttttagtctgtgaaataggaaaagaaaaaaacaccaaaagtggaaaaagaaacaccggaagtttgaacgattttcgtattatttttatatttagatgttggtcaagtattcatcttttcctccatttatttgcatacttcttccatggagaatagtgaaaagtataggccatagtcgtaatatcaaaaagcaaagccttatcactatttataaacatcaacaatcctgaaagccaaaaacgatacgacatttgatattttgatttggtttcagcgccctattttttttataaaaactatacgcatactgttgcattcctttctttataaaattcaataaaaaattaatactttccacagataaagctagagaatgtcaacaacaggtccgttagatgctactttaataagggacgttgcggttgctactgccaccaaagcatcatacgatatgagcgatactctatattcatatctacccaaggtcgaccaattttatattcctgaatggcttacaatgcaattcattgccaacaatttgatcagctttacccccctattttcatatggtaccacgatcattagcattgagaaatgcaagactgctttagggttttcaatagatatttgtgccacaatgttgatcgctagtatcctaagaatatcttactatctcattacaccgtatgaaatcactttgttgaggcagtcattagtgatgatttttattcaactgatcttgctgagaacaagcttaaaatatagacctgatgagtacaaataccaaaatctcaccgatgtagagtcattgtcacatttgattcacgacatatggttcgagttttttagctgcattaatagaccgaaatttttaagtgaagattggaagaatctgatcaaatctctttcgttcacaaatttactgaaattttcattcaaaatttttttggcatttttttataaaattttgaaattctttgacccaaatttcaaaagaattggagcgttttggcagtgggatgacgacaaaaatttctggaggtttttagctctttttgcaactgtacaaatattggtcacatttttcatctctaatattttaaattgggactcactagctcaaggactgggctctatcatagggtcgttgggtttattggtggagtcgcttttgccgttaccacaaatcgccattctttataaattgaagtctgttcaaggtttcaaattgatccttttggtaagctggctttgtggtgatacactgaaaatcacttacctgatatttggtgcgaaaaatatttctgctttgtttgttatttttgcattatttcaaatgtcattagacttttacatcggtggtcaatacatttactacagatactattatccaaagttaaggcatcaacatcaccctaatgacagtaattcgccatcagatgaagatgaaagcgaaatgtacgaattagatctttttaataccttacaaaaggatgtcgaaaaggccttgaaacaggatagtaatgatacgtcagattcacctcaagatgaccaagtgggtaaatctcaggcacaggcggtaacgctatagaaattttcaggtttgcaaataaaaaaagttgatagagaggtttttttatattttagatatatgcattcataattcgatatatacatgcatgcatatctcgagtacaatattaccattgttgtaattacttgttaaatatcgcctcttctattcatgtttgaaaggaaaagaatggtgtggttacacctcggggaagatattttcacgggcatatggaactaataaattgaacgtcacggtaatactacataatacagtattggctaaacaaaatgtgcctgacgatatcaaagtttctgtagtgatattcattcctggtttgcaggcatgaaaagattaatattgtcattgagcaatgttcaattattgccttttatttaataacattctacaacctctgtatataatacatataattccatttgtatccacaattctcttcatgttgagatatatatcttgaggggtattcgtatcgcttgtatacaatgataatcgaggtaaaactcatgtacagtagtgcggcatatttttcttatttagtttttgtaggcggcatagtattacttgcagatttttttaaagtccctgagccccaaagttccaaagcaacaaaaaaacataaatcctttgcaggaaaagtaacatttggcaaaatttcaacaaattatgccccccgaatttagcagtgatcaatgttaatttgcctacatgctgatgcagagttgtagaaacaaagaattttaccctgtatgaaaaattttctaccgatgtaatacaaaaatgaatcatcaaaattttatgacgtaggaaaagacagagaaactttctatttcttttctggagtaaaaaattaattatctattttacttaaacgaagatagggtttcgtaatcacgaaagaacaagcaaaattctagttgacaggtcagttaaggcacagaaaaagaaatattattcattactatcaagataccgtagaaaagaaaaagaaccggggatgaataataacaaaacgggctgctttttctttttctctttctttttcatttggtccctctccactctttctccacgtggctttgctttccccgtatttttcttcgtcagagagactacatgatagtccaaagaaaagaaacggggggacgaagaagaggagaggaaaaaccaaaatataattttccgtgaaatagattctttttctccactgcacgacttcttctcctcccacaaaaaatgacgcctcatagacagccccgcagcttcacttttaagtttctttttctcctcacggcgcaaccgctaacttaagctaatccttatgaatccggagaaaagcggggtcttttaactcaataaaattttccgaaatcctttttcctacgcgttttcttcgggaactagataggtggctcttccacctgtttttccatcattttagtttttcgcaagccatgcgtgccttttcgtttttgcgatggcgaagcagggctggaaaaattaacggtacgccgcctaacgatagtaataggccacgcaactggcgtggacgacaacaataagtcgcccattttttatgttttcaaaacctagcaacccccaccaaacttgtcatcgttcccggattcacaaatgatataaaaagcgattacaattctacattctaaccagatttgagatttcctctttctcaattcctcttatattagattataagaacaacaaattaaattacaaaaagacttataaagcaacataatgtctgaattcgctactagccgcgttgaaagtggctctcaacaaacttctatccactctactccgatagtgcagaaattagagacggatgaatctcctattcaaaccaaatctgaatacactaacgctgaactcccagcaaagccaatcgccgcatattggactgttatctgtttatgtctaatgattgcatttggtgggtttgtctttggttgggatactggtaccatctctggttttgttaatcaaaccgatttcaaaagaagatttggtcaaatgaaatctgatggtacctattatctttcggacgtccggactggtttgatcgttggtatcttcaatattggttgtgcctttggtgggttaaccttaggacgtctgggtgatatgtatggacgtagaattggtttgatgtgcgtcgttctggtatacatcgttggtattgtgattcaaattgcttctagtgacaaatggtaccaatatttcattggtagaattatctctggtatgggtgtcggtggtattgctgtcctatctccaactttgatttccgaaacagcaccaaaacacattagaggtacctgtgtttctttctatcagttaatgatcactctaggtattttcttaggttactgtaccaactatggtactaaagactactccaattcagttcaatggagagtgcctttgggtttgaactttgccttcgctattttcatgatcgctggtatgctaatggttccagaatctccaagattcttagtcgaaaaaggcagatacgaagacgctaaacgttctttggcaaaatctaacaaagtcaccattgaagatccaagtattgttgctgaaatggatacaattatggccaacgttgaaactgaaagattagccggtaacgcttcttggggtgagttattctccaacaaaggtgctattttacctcgtgtgattatgggtattatgattcaatccttacaacaattaactggtaacaattacttcttctattatggtactactattttcaacgccgtcggtatgaaagattctttccaaacttccatcgttttaggtatagtcaacttcgcatccactttcgtggccttatacactgttgataaatttggtcgtcgtaagtgtctattgggtggttctgcttccatggccatttgttttgttatcttctctactgtcggtgtcacaagcttatatccaaatggtaaagatcaaccatcttccaaggctgccggtaacgtcatgattgtctttacctgtttattcattttcttcttcgctattagttgggccccaattgcctacgttattgttgccgaatcctatcctttgcgtgtcaaaaatcgtgctatggctattgctgttggtgccaactggatttggggtttcttgattggtttcttcactcccttcattacaagtgcaattggattttcatacgggtatgtcttcatgggctgtttggtattttcattcttctacgtgtttttctttgtctgtgaaaccaagggcttaacattagaggaagttaatgaaatgtatgttgaaggtgtcaaaccatggaaatctggtagctggatctcaaaagaaaaaagagtttccgaggaataagagattatacttaaactagcactgatttttttaaggctaatggctactaatactttaatagatgatcttcatacttttttatttaacgatttttaatgatgtttttatttgtaccactcatttatctagatttttttaatactgatcaaatcttacggactcgacgttaaaaagttcctacatacgtctggtacttgaaacgctgcttcgaggtattgacactataagaatacgatccaaatacttacaccgcatgtaaaaatatgccgacaatatgaatacttgttgatgaatgatatttgattttaatccggcaatttacctcctttatataatccaataattgttgataattagtggttaggttgcagtactaataagaattaagacaaatattcttctactatataaaaggtgcaaacaaaacacacgccgatcggccatactaaacaagaccaacataataatggtggaaccatttactgtattttcaatgtaacgactcatatccttatacatgagacgtcaagtttctcgttgaagtaataatgaatctttaactttactgtgccacatatcacgtaatcatatattgtttttcgccttcaagcatcaatggcgtattgtggctgattacttcatatgatcactaattaactaattatgaaaaataataaataagtcaccaaccaagcaaggaaattagcttcaagtaaacagttggttctttctggcgagttagaacaaaattaaacaataatctatcgactagcattcatatcaccaatatatcgtcatatacagcgaaatgattgcatttactggattgaatggatacactttgaagatgaacctttatcatagttgaaatgggatagctgagaaacttgtgcatgatttgatgattgtttgggttcaaccgttggggataaggactataatattaggtacacagaaattccaaatatataagtagcagtgctttatgaaactataatgtcagagtagttatgtaaaaatagaacaattgatatgatcgtttctttaataactcgataaggagttctctacgaaaaatatcaacagtgaaatataatccgatatagtgtaacggctatcacatcacgctttcaccgtggagaccggggttcgactccccgtagcggagttttctttttgaagaaatttgaaaatttttttcttcacgtcgaccaaggttttttccggtcaaacatggccaataaaacggataccatttcttggaaattatacgcttcgaagtattctcaaaaaaggaaattgtctgcagtgaagattggatataaggttcactaaacacagagtagtaattgagctgtaatttgtttacagaacgaatcaaatcagcgtagtgttacagtttatctgagactgcatatctttaatctctatgagcgagaaaaaagaagaagttaaaaacgccaccgttaaggtgactgtcaaacttccaaaagaagataaccattcgcataatacgaaacatctcaaaaagacccaaagttcaaaaaataatgatatatcttttgaaatcggcaaggaatccaaaattcaaactgttctagatgtgttggctatgattccaagttccaagtacctgacaaacgttgggctgaaaacaattgaaggtgactcccagctatctgatgaaatgtctataaaggaaattgttggtgagaaaagcgagttaaaacttcaattgatactgaagccatatagcgcaagagaggctttgaaacatgtgattactgttcgcgatttcatcggatttgcccaagaaacctcagatggattatctgaatttgctatttctactggttcaagcttttcctcgttaccgttgggtcctatcaaggaacgctcaaaacaagaagaaaaagacgagaagagcgatccagaagaaaagaaaaatactttcaaagatgtgactgacgaggaaaaactaaaatttaacgagatggttcacgaagtgttttctagctttaagaattcttcaattaacaaacttctcacctctgaatccaacatcatcacgccgtgcgtcaggtctttgagtttcgcaccttacaatcctgtacctccattttatagaagtaaaggtcatctattttacctacaaattgtcactttggaaggtgagagtttctatatcactgcaattccatctggattctatgtcaataaatcaaactcaactaagttcgatccttctccaaaagaaaacactgacgagaacgcgcactcatccctgatctattacagtctatttgacttgattgcttctcgctctaaaaaattcatttctcatgtccaagcattcgagaaaaaactatctgctttagattctacaagctatgtaagaccaagcaatactttcttgcataaaccatggtttgtttcttcattgccaccaaataacccagattatctgaggttacaaactgccgccttggataccacgccagaaagaaactttaatgatgaatttcaagccattaaagatttgactacgtcaacattacaagatcgtattgaaatggaaaggttgttttctaaagttgtacatgaattttctgttactgcagcatcaggcgctatgtcaattttttacagtgatttcgttgcaatgaacccagaatctccaactcgggatcaaattttcttaaaagacaatatcttttattcctatgtttccgacgttagtggcaattatgaagggaaaggtggggatgaagctgcaatcgctgcttccaaccaagacttgaagacaatcaatattttgaatcgcttgcatatgcacgaagttcgttatcttttaacaactgtagtcgaatttgcaggcagaagaattttggctcaaactccagtacctggactcttagctaccatgggtaacaaaattgtaaaagatgctaataccggcgaagaggttaccgaagattttgtcaatgatattaatgtaaagtacggccttgatgaaggtttgggaaagattgtttatgatgctgactttgattctgttttagaaaaaaagtttgtcaaggcattccatttgaaaaagcacaaagtcaacggtactgaattagcattttcatcgcaatccaagggaatagttggattcgataagaggcgctatattttggatttagccaacacgtatcccttggacatcaactttgctagacaaaactttgacaacatcgaagagactggaaaccgttacccacacaggcaaactttgttacgtccggagttagtagaaaagtggtggaataataaagttgagaaggaaggtgttgaatttgaaaaggcctatgaagaaaatttgtttagttataaccctgatgcttaccaggtcgaaggtattgaggacgctaatgttgacgaaatgtcgaactacttacaaaaagaagttattcccagcgttattcaagattatttatctggaaatttgagcactccttataatggtgaacatttagccgatactttacataagaatggtatcaacatgcgttacttgggtaaaattatcgagctttctcaaaaggaattggactcccaaattgtccactacgaacaaaatttgaaagctgttgaacaagacaacaaagaatatgaggattgggaaaaatcttatctgcaaaaaattgagaacatgattaaagagagacaagccaagattaataagctggtacaagaaggcaaagaggttccaaaagaactaactgaagatttgaaattaaacgatgaagaaatcaaaaagcccaccgatggaaaacctgtggtcgttgcctatgatgagctagtgccattaattaaaatttccgaattagaaattgtttcgcgttctttgaaacatgttttaaaagatttgagtaaagatgttccggtcttcttggttccatcactggtagcatacgttttcaatatgttagttggtatcaactacaatgctgatccgaagccagaaccagtcgacgaattttatccagtcaataagtgctcatttgctaaattaacacgctccgaattgctggaagctgtctctaaacaagccttcttgcgtttccgtcatcaattaccatccaattggatcgaagcttacatggaaaatcctttcaccctcattagaagtgtttcttacaaatttggtattcaattgctcaataaagaatacttctttactagagaacaattggaaagttataagcaaagtcttgacaagaaaattaggaacaagtttgtcgaaccaccaactaccttcagtttaagcgatttgaccattattccacgtgttaagttctcagaatatacttcttcagttagtgaggaattttgggctcaaggtgcttctatgatcaacgaagacaaacaaagtgctttgactttactcgctcaatcaattacagtcttagaagatgttaacaatattttacatcccgccgttgctgaaaagtacttgtcattatctgccatttataataagttagcattataccctgaagctatcgcgttctgtcgtaaagcatgtactatttatgaaagagttagcggtattgattcttttgaaatgatgagggctttaactaatttagcaattctagaattctctaatgaaagtccttataacgctactgtggtttataataggctcgcagaaatcctaaaagtttatgagttaccaaaaatccatcacccagcccccacaagcattttcaaccatttggaacaattagccctaggtgttcaagataccaaattggctattgaagtcttgggacaactaagctcctatgttgtggaattagaaggcaaagattcattagcatatggctataccgagtcacgtttaggtaatttgtttgcagcattgaaggatttccaccgtgcattagagcacatcactgtaacccaagggattttcaccaagcaattgggtatgaatcacacgcactcagcccaatcaagacagtgggttaatggtttaagctcattaataatggatttaaaacaaaagaagcaacttgcacaagatcaaatgtcgacaacgggatcaaattcagctggccataaaaaaaccaatcaccgtcaaaagaaggatgacgttaaacctgaattggctaacaaaagtgtggatgagttgttaacatttatagaaggcgattcttccaactctaagagcaaaaacaaaaccaacaataaaaagaagcatggtaagaaatagagagctaacttaacaatctcgtttatttattatttttctttatatctatagcccatacttgtatatactacgtgtaagtactagatataaaacgaaaaaaaaatacttacaattatttttttttctttactgctctattcttttctttattctattcataaatgcaaacaattagttatgtaattttaaaagttgaaaataattgactttgtcaaagagtaattaatttttcacaaatcatcataaatgcaggtatcaaaatattgtcattaagcacactattaccttctagcactccactcagtgtacaaagggtaagcaattgtaaagtagttaggtggttaaaaattgcagctttatcaaaacgtaacaataccaaacaaacgataaaactcgttactataaacgcaagagttccctctaaagttttttgtgtacctttccaacgaatgcggccataccttttaccaataatagatgctaaggaatcaccaattcccaatcctattagacccattggagagttattcattaataaaggtgttgatattccgaagagtaaataaaggtatgatatgatcaatggcccgctgtggtccctatcatcagcaaaccttcttagttgtaattcaatagcagatcctaacggcggtaggttttgaaatcttatgtactcaattgataagaagactggtattgttccggacaatgcaattttcacaaagtttgaatccatttggaatgacggtattatgagtaagaaaatgatgaaatgccacaattttcgggaggtgttcaacgatagactgtccttctcgatcaatatacttggtatggacagtataagaattgaagaccaagcaaacaaaatcttttgacgaatagtagactctaagatatattttaccagccaaagtagcggattttcaccgtcttctaaatgaatgaaggtattggcaaaaagtggaagcccgatggcaaaggatattgacagcataaacggtttaaagtgcattacctttttgagcacatagttaattgaaattattgttgtgagagcaaggataatgcccttcaaaattctaaaatgtactgtgccagcctctgaaacgtacagaatattggttaataggatactaaaaagattagagtcgatattatctaaacttttcaattgcccaatatacttcaaaattaacgacagtaaagaatttattactatgctaataatattctttaacctgtcaccagcctcaaaattaaaaaatatgaggcagagctgtaaaatgatcactaccaactgagttcgccatctatatgaatttaataccgaaaggatcaaaatagtatttatcaccgtagatgatgtatcgaacaacaacgaaaccataaacggtaaatataaactgtaaatggtatcgaacttgggtaggcttttgtaaccatgttgccaatattttgtgaatatcagaccaaccattatcaaacacaccacaaagacatttacaaagatttgtttataagatatatcagcggtaacaatggaccacggctgaagcctttcaacacagtaaaaaaaagtgcccaacaatataacagtttgaacaaaattcgaataaaagcactcaaaatctcgagaattcccgcccacatcaaatttacgagtcctcatattgattttgcagatctcctcagttggcatttggcttccctcagttttctgggttagtttaattgtggtaaaggaagcatgaggtattatagcgaccatataggcaatgaacagaataacgacagtttattgcctcgaaaggagtctgatttactagctaaattctaatatttggcttactacaaactctatctttcatagaatacgtccttcgataccattttcaccatcttgactaacaacgtgtacaactcttttgaaaattacgtgcctgaaaacccaaccattgcggacagccctcaataacgtatcttagcattacccgcacacccatacatctagaacttttttcatttctgaaaatttttttttcttctaggattacttcgggtataaataagagacgcagaaatggttattggcaattaatgcttcctctctttaataagttacaatattagaatcctatgatttccatcacaaagatcaatacaaaagaaatattcagatgagtgggagctatgaaaggctgagagagaaattgaatccataaaacgtttttttccgtgttctttttttcttctttatcaaagttagtttttcagatatgtcttttgtcattatcacaggctaattattcccttgatgaccaaaataaatttttacaaactagagtttctgaatcttttgtgattagaacgtttattcttatttctgaggtttttaattagcaataaagaagaaaaaactgaaaggaaaagtctaaatagaaatacagtagtatttcttcaatttctctgctctcctttcatttaccacacccatttcaattttctttttattccatatttattcaaaggtgtttgttcatatgatgattataacaaaaacaaaagctggaattactggctgaacgagtatatgttgatacgtttttgcactatcctgacctagcaaacacctttaaaataaatactagaaagttgacacatttccataaattggaagaatacatttaagcttagaaaacagtagttttttagtgctattcttccgtagattgatgttttcgatctatttgatacaatggaaatgaggatccacagcactgggcactgagggggaaacaaatatcctttcaaatgagtgacaatgctttagcgggcctagaaaacccgcgcaactgatccattgtaagtttttctgagggctaacagaattttctatagggaagaatggatttttttctcattttcgtataattatgtgaattggtttttatgatgagatatttatagatgacgagtctgatcattcgtgaagacacaactattaaaattaccattcatgcctttctgaagctgtttacattattcttttcgattagcaaagaatttggaaatagaaaaaaatcgacagataactagttcatcagttgatgtgtctgtattgcttccatgttttttaaagaaaatttctaccttagagacgtcaatgctgcagaagatgaaacaaattactcaaatagacaagcatatgtctgatcttcatgattgaaaagagcaattagtgtctgatgcaatttaaactagaaaatttatctgagagagatgagagatcgtacaaactgtttcaaggtttttaacttttctccaatttcaaaaattgtttatgatgatttccacatttcacgacggtcaactgcgtttttcgaatgtttatcgattaactttgatgatatttcgcctgtgacagggcgtggtactgagctttaatatttttagcaaatttagaaattgggtcaagcgaaccattgtaatgctgactatttggacgactctaatctcttcaatatatttgagttcaaatatattaacttgagtaaattttctcttgcgttaattataactaattgtgatgtgatgacaacttcttgagctatatattttcttgagaacatcaatgaagaaaacgtctcatcaaatgatttgcacgtcagtctgatcacaagccatataaaattctttaagtattttatccattctacctttttcatctgttagtgatcgattaaagcaacacccagacattacatggcccatatggcaaaaattttcatctcatctacctcatcactgtgtgcatttagtgtatgaatgactactttaagcaatttaaccagtatatacgtataaagaggtcaagtgtacggataacccaaaggaaacatgccttccgaatcatccgtctctatctacaagcttgatcagttggagtatcagtaccattatttgacaaaatcattacagaagtttgaaccaagatatccaaaaactgccaaattatacaattgtataggtaaaaagaacaaaaagaaaattgaaaaactgttaaactctttagagttgaaaactttggacaaagaactagatgaaagttactcaaagttactcaataataagattcactattacgagacgcatttatcaaaatgtataaaagaacaaattcagaaaatatccaaaaaaaattctagtaaagtgaaggatgctcaaaaaaataaatcaccctctatagatattgaaaagatgcttgctacgcagttgtcattagatgatttagcactcttcatgacaagatttaggctgatcaaaatcttacaccagaggatcaaacaaaaaagcaaaaagattgaaggtgatacgaataataaaacttggttgaataacaatgattatagtggttatatcaatgataagacaagtaagtggaacccaagcaatatatggaatgaagttattacgaagctgccaagttgtgaaaagttaaacgcactaattggtcaaagtaaaatcgttcaaaatctaaccgaatcattcgatttgagtatttgtctcatatttggatttgatgtaagcgctatgaaagcaaagaagtatggagcaagggagaagacggccaatgctaatcagacgcactccaacattgactatgacaccgatgacggcaatgaaaagaatgccatcgatagcaaatctaatgcgatcggcgcacaaactcaaagcaataaagaaacaacgtccgacaatgaggatctattgataaaggaatacgagggaatgctaggcagttcaggagatgaaggggaaggcggcggatacttgaaccctaatatcaattacaatgaagtaacagatgaagaacctagcgaagcgtcatccgatgaggatgacagtgacgaacgcttcagcgactctgaagagaatgaaccaaggagaaaaaaaccaaaattgcataatttacctgaactaatggctggttattacagtggaaatgacactgaagaggaaagcgatgaagacaacaaaaatgttaagggaaagaagaaaaagagagacacagcagaagaccgtacggccagagagcagatgtcaaacgagccaaagaggaaaaacagacgtgggcaaagggcaagaagaaagatttgggaaaaaaaatacggctcacaagccaagcacgttcaaagggaattggaaaaggaaatggaagatagaaagcagaggcaaatcgagtacgaagcaagagtagctaagcgtgaagctaaagcagcatcattagaggcctctaggagtagggaacgcgaagacagacgtactgaaacgaacaataagaaagaaaaagaaagtgcatccactggagaagaacatccttcttggattgcaaaaagattagctgaagaaaaattacaaaaagctaaatttgaaggtaagaagatcaaatttgattgaacataacgtcttcatctcctaacttcatgtataataaaaactattagcacatctattttatatatgtacgcgtatatcttacatcgtaccgttatagcatttgaattattgagcttttgtatcatctaccgctgtcatgctcgccttcacggaacttagttatgcgaaaaagaattcaggaaaccaaagctggcagggtgagtatttgtttgtaaagtcgcacctttagcagatcattagctgtagcgtatggaagaaaactaaatgaaattgtttataaaacctgaatatgataaaagaaatctaaataataaatatgattgctatataatagttatatttgaaatgaagagaaagggaagaaaataaaagtattcaaaacgccaacccttaatgaagtaaatatgatttattgtctggacaaagttctgtttttccccattattcgaagacttctccagtaattgggtctctctttttgaaagtcagtaacaaatcatcttttgggaaaattgtagcgaaaaccttgattttttcacttaatggagtcactgtatgatggaaatcagtatatagtgcaaatttacccaacaaagcggcgaaggtaatcatgacatatgtttgacctaagcaaacgtgtggaccacaaccaaaaaccaaccaattcttctttgcttcactagccttagagccttctacccatctttcagggatgaactcatcaggattttcgtaaacttcaggatcatgtaaagctgggtataaggttggaattaacatagcgccctttggtgcggtatagttaggggaaactgggaaattcttcttaacaacatatggaaccatcaagacaggaggtctgtaacgcaaagtttcttttatgaccatattggtgtacttcattttctcaatcaaatccaagttcaattcggtagacatgtcattgttacgaacagccaattgttcttctctgatcttagctaagacatctggacggtcagcaacaatttggaacaaccaacaagctaaagaagaagaggcatcttgagaagcaaataagaaagtgaaaacagcttcggagatttccttgttagtaaactctctgtggtagattctagaatcatcatcgttactattctttgcatcgtgcatcaacttacaccaagcatccataacacaaactggcttaccacctgcagcaatatgatccttagccatttgagcacagttttcgaaaatcttcatggccatgtctgcagttttcttaccataccatgttttagtgtaagggataataattgggaagttgactaattccaatgctgctgtaaccaaatagtaatcatcagcaatctttctgacttgatcttcggtaatatagttaccacagaaagagttcaatgataaggcgcaaagaatttctctcatttcatggaaaaagacctggggctcgtagttattctccttagataaacgaacaaacttatccatgtacttatccatgatttgttccaatgaaggtaagtattgagccaaagcttgtttagtgaaaagaccgtttaatgattttctgtaatcagtatgagctttaccgtccaaaaaaacccaattgcaaggtcttaagatcttcacagcaacatcgacaacgcaaggtttgacgaatttggaagattgcaagatctttcttgccaagtctctagtagatgcgataacaacaaatttatggaaaatagaaacacatgaaagtggaccggatgcccacttagccttatattcttcaaactttggatctaaggattccaaaaatggaccgatgatgggccagaacttaaactttggacctgcgatggaacctttcttgatttgatatgcaacttggtcccaaaccaaaagaatacagattaaagtagcaaatattttcaaatatgacatagacttaagtgtatccaggatactgaaggcagtagtgacgcctacagagggctggtctttagccaattggtgtagcgtagaattatgagtggcatgttgtattatattttctgcgacagaactcattttgttaaaaggtatttattgtctattggaatagcaaaatgtgatgttttgtttattgtgataaaaattaaggaaacaatataacaagaaagaaatgagtaagaataagatatttggaacaatagacaattagcttatatataatttttttcttccaacaagattccctgcttgcgtatataaaccaatcagtccctttgcctgaagacaataaggacgatcttttacaaccgattcgataaaaaatcttttcaaaaccgaaacatgagctctcttcaatagcgatataaacaccggcagcatatagacgcaggtttgggctatgttttgtcagcagcgataaaaggtacgagacttcgcagacttaaacgagggaaaccttctcgagaactatggtaacaaatattacccgccccggaaattgcggaacaaatacactgtctctttacgagtttctcgtttaaaaaatccaggggtgtggggtgtgggcgcccatatgcgcgaacgagcagctgcttgtgatgttttccggggaacctcccacgttcacaaccgcgccgcggaaataacgaagtttttacgtgtaaagagattacgtcaaaggaaagaagtgttcaatgtgtctatcttataggcgtgatagatgtcatttataacatgagtccacctcatgcataacgtatgtacatatatgtgggcggtagggttttgattaaagtaacataattatccaaggaattcatagttgttctatttttcttgtttttttgtatcatcagcagcaatttcttcgttggagacatcgccagctccatcaacttgtgatttggatgactctgactccttgacaggttctgcttcactaggttcgttcggttgtgttgcttcatcgcttgtacttgtttttattttgtcagtatccgtcgaagtcaatgcggagattggtaattgactagatcgtggctcctttaatgtttgattatctggtacagtattcccactgtctgcttccttagaccatttggaatgtgatgccgattcagattccactcttggaagggtgattcctgtatggatacttcccacatttgattcagatgattgatttgtgtttgttgtagttggagaaggtgtcaaaggctttgaatctgcaggtgtaatgcctaatgtacttgccgaattcattgtggcgttgcgtggatacgataagggtgaagctatgttgcccatcagttgttgtttcatcggcattgttgccgaaagggtctgtaggttagttatagtatgtccttctagttggttagagttaggcattgtgcattttttcaagggcttttcacccgcagcgattgtacttacagctggtatagaattattgggtataattttgttgttcaaattcattgaggagtatgtcagctgagcagcagatatatttgaaggaccattaggattttgatagttgttaataggttgataataggtacgcggactgatggatttaataccagtgctactgctactactactgctatcattgcttggattattttgtttcaatacgctctgaatatccctgatgaacaagggataaagatagtcagcaattttttctctttgtgctattgctagggcacgctcaaacggtatccagacacccttcaaatgcatggaaccaatcttcaccacatgcctgattttttccgcttttagaataccatctcttctacctcttgtcatcttagttacattcagaagtttggtaccattaaccatatcattatctgctcttcttaccactgaaataccgttagcttctacctgataacatagcgttttttcatcctcccacattgttgttgttactcttggccttattatacttgccgaagtgccgctggtgttactgcctgtggcattggtagtggcgattaagggcatcgggtgccttatggtagttgtttggaaagaattcatggttttagccattgagtcatactgttgatctgacactccgtgcctatttgcagttaaataagtttcttgatcagtagagggtttaactggtggagttatagaatttccatcatacaacgggctcacctgttgttgttgctgaggcggtagcaaacccacttgcggaagattgtagcttaaaggtccattttggctggttggaccttgagttggcgttgttaatgatcttggaggaattggagaatgcgagtttggaattgacgaagtcttgtgaaaaccggggtattggtaggtggaaggttgtggatagtttgacattggaggctgctgagctaaggacgagatactattactattgcgactagtgcgattagaattgggagacatagagccactggacgaatcagaaggtggtccagatttactgaactttgaaaatgcattacctatctttggtggttgggccggatacgtttgagcttgtaattgttgttgctgctggtgttgttgctgttgttcaaaggttgagtaggttttttccaaattggggttttggacttgattactggttacagatggtgttgcaccgttagtggttccatcgccgtttgcaggataataataatacgcttgtggatacgaatatgccattgattgttgggcttgcatttggggaaaataatagtagtatggtacattgttactgatattagtactgttattgctttttttggtggtgattgcagaaccattcggtaacgcagttgcagtagcgttggaaggaacacctacagacgtggaaggtggattggaagcatttgagtcagaaccgctactctgaaaggattcttgaacttgatacatctgaggctgggattgcagttgctgttgagactgggattgcggctgctgataatattgcgggtacggccactgttcaggaactacgtattggtaggatacgggcatcagaggttgaacgctctggccgagatattgttgttgttgctgctgctgttgggtggactggccaatagtactttcgctattgctcacggcactcatatttgattcctggcgcatgcggttggacttgatatcattcgtattgattgggttaccgatgggcatgacaaaaggaccttaccagggttatataaggatgattttgtactgtgcttaacaaatccactttcaatttctgaaaacaaagatcaaaaaggttttttttttttatacaattgtgaagtatgtttaatgaaaacagcacaaaatgatatctctctgcttgcaatataaaaagctatggaaaaggattatcaactatactagaaggcttacacacgcacaggcacacacaactaatgcaaaagatagtggggaaaaacttcaaaaactaacaaaaagaagtgttaaagatgaacttttttcttttgtatcgtcggcttgccacattcgataagttaataaaacacaaacgggcaacacatctacgtactttttatgtgaagacaagagaaagaatacatcactgatacgtgcgtctattgcgcagcactgtactattgcgaagaactgagtgaaggcaaagaatgagatgatcgatgcttagccgactgttaaacttactgagcggtagcctctactagttccttagtcagatcgcactcaacttggaatgttccgtcaggcccacggaagaaaaagcaacaaaagaaagaaaaaccggacaacatgcgggaaaaatgcaaactgtgtgagggaaaaattaactttaaagattacatcaacggcgggaaaagatccttccgcagtccttctactgcggtttccctgcaggcacagctaaccggagggaagacaagtcaagcggacatgcagttcccgctcaggcttctttgcagagaaatcggaatatgaattttttgtgttttttgttaacttctttaccattcgcatcacgggaagagtgtgttggcataagaggcgcaagaaaaaggtgacccacggtggtgggaaagagaagaaaaagccgtttgcggaaagcaatgttttgcccattcagaaacaatatctttgctgtatccctacatgtattatgccgcgttgcttgtgcaggtacggagtccctgcacgatttttcaacaaggtctagatttgctaagacgatgaggcggagcccgaaacaaacaagccaaaaaccggaatttcgcgcttggtgtgctttcgcatcttttcgtgtggtgaatgcacctggtgcacgctgcgaaggtgacgtagcaatccaaaaaagggaagtctaggcgctttcaaccgccccccaccgtgcatgcggattggttgtcacaattcgcagacatattggcaatgtttcctcccctcctgttgatgcgggtaaggggtgtctgttatgcaggaacaggaaggtaaaaattaaatgggccttaattctgtagacactctcttggggtaataaggttaaaagccattgttgaagtacggaatcatctcttcattttttcagcgcttgtaaggaattaatccccaggaaggtgccgatgtaatgagagaagtattcttgttgtatctctttggttcggagtatttccttctttcttttctttgtagtttttatgcaaatgcagggaacagagtacccggttaaggctgttagtcagccgcactctacacaaaattacttggcaaacacgttggttgggaaaagctttatacttggcggtgtagtaattgtaaaggatcaagattgtgtcatgctaatgtgccgctgtgtaacaacctttttgaagcgcgtatttaccaccggcaaaaggccattgtgtcacataaaaaaaaactcccgccaaagccaggttcattttgcataagattcaccacagtacggaaaatacgataagttaaccagtaatttgctcgctttagctactgataaaccttctctgttaacactattatttttttattactttagatttttccgtttgtgaatagccatttttagatatataatggggttcagaaaaatacttgctagcaaatcgcatcacagtcgccaccataatcagcaccataagaacctgaagttgcaaaatcatcgctatgtacttatttccaatattacaggatcccatgaaacaaaatatttatcacccttcaggatggacaattgttcaggaagcagaagacgtgataggctacatgtgaagcttaaatccttgaggaataaaatccacaaacaacttcacccaaactgtcggttcgatgacgccactaagactagtgatgataaatgcgtctcttatgaggtgcccgaaagggatggccttgctactatttcgttagaagaggtttttccaaagtccaacaggtgccaaatacctgaagaaaacttgggagaaacagatagcgttattcacagagatttgggaaattttgcaaatgagaatgactatccacagtggagaaaagttgaaagtcaatataacttagagaatgtccagcctgaggaggatgaaatagttgatagactcaggtccgagattagaagcactaaattaaaatctgtaaaaacgacaagcagaacacttgaaaaagctatagaggctcgatgtactggaaagagagttcttcaacaactaagttgtcagagcaaccaactcaccaagatcgagagcaattgtgacatgcttaaaattcaatctaacgtagccgaccgaaagattgacgaacttgcccatgaaaatagaagcctgcttgcattaaaatcacccaaccccttcaggaagaaaagggagagagaaaagcgagaccagatctacaatttgaagttaaagcatcgtcacttacagcaagaaactatgaaaagagcccaagattctgacaaaaatttagccataaatctaagttctgaatatggacggtatggccaaggggtggaaagacagcgtattcttagagatgcccagaagtatcagtttgaagccgatgaagaagataaccaaatggaaatcgacttgtacggaaacctagaacaaataaaagcggtgagtggtgacttgaaaattatggctcacgcttttggcagagagtttgaagcacaaaacactagaatgtttgacatcgagaacaatgtacagcaggcagataatgctttacaggccaagcgatatagattggagaaagtgatcgggaaaagatggtgatctgttatacacacaaaatatcgtgtataaatatattgaataaatagtttctaaaaaggcatacgcagatattcttgcgaaagagaaaaaaaaaagagcgagggggacattagtactgaaggtctcaattcttctttgtattttctttcggagttgtcagacaaagctttctctttcccataaataaagtgcattcaaacatcggcaggtttgtttttcccagttgttacgtatttgtttcccgttccattcatgatcttaaactgggttaactgaaaaatcaacatgattttgtgaaaagtaaaagagggtaagaaagatagataccgctgtcgtgggactatattttttacagtaccaagtctacttgcttctcataaagttgataagttataattcatataatttcatttgtcaaaaaagattttagttacaaaacgatatcaaagttcaatcttgttgggaaaaaggaaaacattatgaagggtttccggtaatcactgcgtatgccacactattcctatagaattgtcttgattgggtgcttatgctgcggaaaaattatattctgcgcttgccttttatattaagcgtcacaacgcccttaccaagatcgagcggattaagacaagagtgtatctcaagcgtccgtatatgtttaagttgaaaaggatatttagtaagaataattctaccctacaaacgatattagtaaaaaaaaaaatcaataatagagttattgtacaaacatgttctgaaaattggaagcatcacatcgtatgctactagagaaaatttttactatccttttttccacaagcccagccctagcccgatcatcctattaattgtcagaccaccgaatgctatcccgccacggttgatataacgaaactctttactgctttgggtcaaatatgcctcttttccgcattttttcggagtagttcattgccgcatacataccgcaacttggacgaggatgtcctccttctcttacttttttattcgtttccaatttgtttctcgtaccgttcaagtttcaagcctacaagaaatgtacacgacatggatgcgtcagcctgattcagatatgacaagattgttcctgcgcatatgtgaatatgagcgcacgcaatacattgagatcttatttgggtttgtaagtgcaaacttaatttactttgcttcctgccggttttgatgtgcacctgggaacttaaatagccgccaaaagaaaagcaatcagagcggcgcggcgcagacaaaacccgaagagtttcctgggaacggtagaggccttggtagtaccttactaacgccggagaggatgattgatacgcattgaaatcgtacagaaaacttggggcaaagcgctcttaccccaatattctcacccaaacagtggcaataaataaagaaaaggtcatcactttttttcgtactcttatccgttttattttattttattctttttttttgagtggagaatcattaagaataaagggtaccttttgtaagcacgatgaacgaagttacttgttccataactggtgacaacccaattcataagatcaacaatggattaggcttgaaatggaataatctgggtaaattctctgattttcagactaacgatagcgccgcgcgagatgctagaacaatagattacatctttaccaattgtcaaaccggcagcagtattggtaagatagattttcgggccgcactaccggcagataaatctcaacatagtggtgtcagcgaaaaagaattttcaagacttgagaaccagtggtcaaaggaattctcttgtttccccaagaataaaaatgctgatgtgaccaagcccagtagaaacaaacatgagaaacgctccgctaatttgcacaataggtactttgcacaatattatagtacggcatatcagcaaaatcgtatatatccttgtcgaatatcttacaatgaacactcatctgtttctaatggctgggaatttcagttcaaatcaatcgaaaatcagttactaaatgagctaaagatagaaaacaatgtagaagaaaaaactgttggttatgaatatgtggcagaatacgaagaaacaattgatttcatgcatatgctgtcatccgtaccacaaacatatcaattcctaaaatcaaacatctacataacggaacgggacccatataaaataggatgtgtactaatggacaacggttccaatttgaacgaagtagtaatggcctttgaagcagccatttcacaagatccaagccatataaatgcatggttgaagttaggtatagttaattttgaaaatgaaagcgaaagcaatggagagcttgctttgcgaaattgcttaaatttggatccaaataatacaattgcattggaaaacttagcaattcaccatataaatcaacaaaatgaatcagagtcattgaaactttttcacaaatggattctttcaaaattttcgaaggttttccaaccttctgcgggggaaaacaaagatagcattaataaaattccgaaaaaggcccatttggcgcatattctagaatccctgttgaatatgggtatagaaaaaaaagatcagtatgatatatattcagtattatcaatcttatattattcggatcagaaaataaagcaatctcagaaatgcttagagtttttactactggaaaagcccaataatggaacaatatggaatagatatggtgctattttggccaatactaagtcgtatcactctgcgataaatgcgtacaataaatgcaaacaactaagaccgaattttacaagggttcgttataatttagcgatcgcctacatgaataagggtgactatgtaaaagcaagcaaaatgctaatcgaagttatactgttacgaagtaaaggatatgaacacaacaaagcaaaaatgcaaaacaaatttatgcaaaatttaaaaaatgctctcatcgcttcaaaaaattttgattcacttgatctaataaatggttctcataatacagaatcgttaatatcaaccttaaaagctatttataacaaaatggattaggttttagttaatttttttgctatatagtgcattcaaaataaaaaaaattaaagctgaaacaaaccaaatatgctattggacgttcgaaaagctaattgcgtaaaggaacactaaacacagcaagcttatgctagttcttctcaaaaatataagttcctcttgcaagaatatgaaggtaatttcactttatcgcgcaagtgcatatttctgagtttactatgtgcttcgtctgaaacctctcattatctacttaatatcggctattcatctcacgtattcacgtaatatttgatttttgtactactatttctctctgtcatacgtgcatgatacatttccttgttcaaattaaaagagtcaccgtcagcctctcaaaacaaagaaaaaagatacccggctgaacatgagtatcaatcatgaaatatattatatacttgtatttgagcatcgttcagtagcaatcaagctcatcatcgtagtgattgttctccttcagttttttttagcacgaagtcggcaaattgataggacatgggcccatactaatagaaaggaacggttcagagaaatgacagctatcgggaatactgatgatgcacttgatactagtacagccgcaagtaaagaaaatggaaaaggtagactcagggttcaaaaagcttgtgaactttgcaagaagagaaaggttaaatgcgacggtaacaatccttgtctgaactgctctaaacatcaaaaagaatgccgttatgatttcaaagctacaaaccgtaaaagaagaagacgacaggtcgcatcagctgttcgggacgttagtaagacatatgcagaaaccagtgagtcttttcctagggacttgttaagtaaatcaaatattatcataaatgccccctcagatggtgtatcttcgtctgctagcaactctcccaatccaaattcacattatcatcatatatcatccactttacccttcatgagcggtaggccaaaccatacattccattccggaagcaacttaaatggagaaaataacaataacagttttccggaggatcacatggctaaattacttctgcaattgagttcaaaattggggaatacgaccaaggaatcgtcaattagaacaactagaaccaatgctagtgatgtgaatgcaaacccgacagtggtcaacatgaaaaatagtcaggaagactgtgacacgaatcacaggtctgcaatatgtgactctgcagaggctcttcataataacaacatcaattctaaagagaataagataatcaactctcaaataactaacactgttaatgatcactttgaatcaccctggcagacattttctttagataagtataggtttcaccgacgctaccaaaatattctgccctattaccttggtgtatctattttaaaggatctatctccgcagacaatagagtacgcgaagttgaaaaggccaagagttcaaaactatggttggaacttgtcaggaggccattacttaaagtataagggtgactttagaagccaagaaaaaaatataaggcatgagtctaaatttttcgactttgatgaccctgttcacttatccttaatcaataagttactaaggtattattttgatgagatcaatcctgttttcagtatcattcacgaagcgacattttggcagcaatataacaataaatttctacggcaaggtaaacaaaataattcatctgcgaatctattcacttccatgctttatctaattttgtctactacactaagattcagagaagggcatctagatggtcagaaagggcaaggaacctacagtaacacatccttaaatatcacattcgaggaaaaatctattttgatcaaaaaaccctccatagaggaaaatttattcaaatacgcttatttaataatcaacacgctgacctttgagtgggaatcattcgaactaatacaatcgtggcttttgataaccttctatttcagaacctgttacagacagacggcgtgctggaacgcgttaagtcaagcggtgaacatgtgtaatgggatgagtctatatttaaacaaatttcctgagatccattccacttatgatgaatcaaaagcatggcattgtttctggtgttgttttataatggataagttgataagttttcaaatgggtcgattctaccaactatcattacccgcgagcgagatgtgcgaacagatgaatctagtgaagtcaaagaaatttttacaagaagaagatgattggtttcacgaagagacttttcaaatgcttgatttgtccataatagtgacacagtttttaaaaagagacgcacaggatttaaatttgaacgagaccgtgcaattgcgcagccaacttggtcaatggtatgacacctttatagttggaagtcaaaccaatgcgtacgacgacaattatcgttacttctatcaagttcaaccattcatgacatacctggatataaggctgactttcgaagtaagacaattattttgtctaatcgccccctcatctaccgcaaataataaatccctagaatatgtcgtcgatactgaattgttaatttctcattgtcaaatggctattgaaaatttggctgaaattacgagaagtaatcttttctttgttccgtggtggttaaacctttctcaactattcacggtaaatttaatatgtattatctacctgcacgcagggattgccgtaactcaaaataaagctatcatgcaaagctgccaagaaatatggcgaaccttagagtgctctaagccaaaaaatcggccttcaatgcttcctgagtgcttgtggtgtttgaaaatgctgaatcatatgttctgcatacgactgagagattctgctttgcaattggaagctactctcggaactgatcatggtgatgacacccctaatagaaataagtttgagcagttcaagaaagttggcgataatgatgcggatgttgaagttgatgctggtgaaagagaagaaaatgctgatgaaagacaagaaaatccacataacaatagcaaaagagtaccattagctactaggtctcataataccactaacttcgacggttcaatcgcaatttctccggaaagtgcagtagcaaatctaggtactgatactggattgccctcagatgttcttgatactgtcagtaaaatagggaactctcctaatgtgtttgatgatgatttattttccaatttattatggtttgaccaaaattttgcataaggattctttttctattccataaaaccattttatggacacgtttacctacatattattatattgtatataagatgttgaaaaaattgagtcaacctcaccttaccacatgttggtccgttgctatgacaaactctcgttttacaagaaggaggctcaaatttcgggtcacccacccatatacggatgtcacgctatgagatcttttaaacaatagacaatttttggtatcctaaagatataaaagaggagtttttttaaaccatggtaactattttcaaatttgctctgctgcagttttttatttctgtttttctttttttgttcccaacaagaagtgagttaataaaggcaaaaacagtggtcgtgtgagaatgaatacagtttcaccagccaaaaaaaaggttattataattggtgccggtattgctgggcttaaagctgcatctacgctacaccaaaacggtattcaagattgtcttgttcttgaggccagagatcgggtcggtggtaggttgcaaactgtcacaggctatcaaggtcggaaatatgatataggtgctagctggcaccatgatacgttgacaaaccctttatttttggaagaggctcaactgagtttgaatgatgggagaacgaggtttgtttttgatgacgataattttatttatatcgacgaagaacgtggaagggtagaccatgacaaggaactgcttcttgaaattgtggacaatgaaatgagcaaattcgcagagttagaattccatcaacacttaggagtttcagattgctccttttttcaattagtaatgaaatacttactacaaagacgccaatttctcacaaatgaccaaataagatatttgccacaactctgtcgatatctggaattgtggcacggcttagattggaagcttttgagtgccaaggatacatacttcggtcaccaaggaaggaacgcctttgctttgaactatgattctgtggttcaaagaattgctcaaagctttcctcaaaattggttaaagctaagttgtgaagtgaaatcaattacacgagaaccttcaaaaaatgtgacagtgaactgtgaagatggtactgtgtacaatgctgattatgttattattacagtacctcaaagtgtattgaatttgtctgtacaacctgaaaaaaatttacggggaagaatagaatttcaaccacccttgaaaccagtgattcaagatgcttttgacaagatccattttggagcgctaggtaaagtaatttttgagtttgaagaatgttgttggtcgaacgaaagttcaaaaattgtaactttggctaactctaccaatgaatttgtcgaaatagtacgtaatgcggaaaatttagatgaattagactctatgctagaaagggaagattctcaaaagcatacgagtgttacttgttggagccagcctttatttttcgtaaatttgtcaaaaagcacaggagtagcaagctttatgatgttgatgcaggcaccgcttacaaatcacatagaatccattagagaagataaagagcgtctttttagttttttccaacctgtgctgaacaagattatgaagtgtctagattctgaggatgtcatcgacggaatgaggccgatagaaaacattgcaaacgctaataaaccagtcttaagaaacatcatcgttagcaactggacacgcgatccttactcacgcggtgcttattcggcctgttttccaggagatgatccagttgatatggttgttgcaatgtctaatggtcaagactcccgcataagatttgcaggcgaacatactatcatggacggcgccggctgtgcctatggtgcttgggaaagcggaagacgggaggcgactcgaatctctgacttactgaaatagaatctattttttcgaaattacttacacttttgacggctagaaaaggatatacatacatattaaaatttttagtaacactctgtgctttttcaaaaatttgaggtacacctaattctcccacttgttgcttataccaagtttgaacaattttaatgttaagcacaatagattggaatattatcatatggtggttcagagagtagtagggtgcattttcattcctgttgcctcaatgtgttttctatctgtatttacgtgattttatgaagtggtggcatcgcttagatgtggtgcataattagagactaatttttgaaaccacgcatgaatgtcaagtaattctaactgagcatctgtcatcaatggcacttgcaacttcaaaaaatcccaccaatattttgacggcaccaatttacctttgaattttatttgagttttccttgttaatcttgcattcagaattccatagaaaaagaatttttcaaatggaattatatttgtagagtgagaaaaacatccatcacaagtgcagttatccggaggacatatgcattccttgtcagtgcatttacaatcatccaaataatccatcatcttatcagtaatttgagcttcaccaatattggttaaaggaacaccactttgttgaatataagaattcagttcctcttcgcttctatggattagacaattaacacatgggcagctttcatcttcacaagagcactgcgtgcttaaaaaaatgcccttatgagtcaggacttcaactttcgaagcaacgtcgcttgaatgaggagcagcaatcgttgttgtactttgtggggtgagtgtttctgaactgtcatgcgcaccaggaacagaactattgtagttttcttgtaaaatatcgttaaaagcggacgtagattccaaggagccgtatggcgtaaatatgtcatcagacggtgccttgttcgtcttgccattagaagctgggttctgtgatttatctttcttacagcagtttgaaaaatgtcgtataggctcctgttgaagccggcttcgctctttcttctcacttgaagaagatgacttggtagagtccggagatattgttcctgttgccggagctttgggagagtgtttcctaagaaactccgtttcggtgatatatttgttaccatcatcggtaaatgtgctaatatctttaggctcatgagcagtgaaaccttcctccattaatatatgcaattttccgtttatcattcttgcctttctaacagcagaggcacgtacaaacagtattggctgttgattcattgcgctgcagcagtcaccttcaatttgtgcaccattttcgtattctgtactttgcgatgtagagtctactaaaatagcgtctctgatagccatgggtgaaggtcttcctctagttctcaccttaattagcattcggtgagaatgcctgcatgttgaagagcgatgccctctgatgcacgatgcacacgcatatttgttcccattaaatattatcatctctgatagagcttgaagaacttaccagactgtttcaagtttaaaacaaggcgcctcatcgcatctacctcacgaagatgcagcagcttattgtctcgagatccttcttataactccttttcgccattacccgaaaacgagattacagcctctaaaccaagagctcgaaaagcgccaaagtaaactctggcgtttagcgtacgaaggagattatcctaaaaggaacttccctagtaatagtgtaatttggaagggcatagcatgtcgaaaaccgctcagaaacgtctcctcaaggagcttcaacagttaattaaagattctccacctggtatagtggctggtcccaaatcggagaataacatattcatttgggactgcctaattcaagggcctccagatacgccatacgctgatggtgtttttaatgctaagctagagtttcctaaagactatccgttatctccacctaaacttactttcacacccagcatactacatccaaatatttatccaaatggggaagtgtgcatatccattctacactcccctggtgatgatcctaacatgtacgaattagcggaagaaagatggtcgccagtgcaaagtgtagaaaaaattctattaagtgttatgagcatgttgagtgagcccaatatcgaaagtggtgccaacattgatgcttgcatcttgtggagagataatagacctgaatttgagagacaggtaaagttatccattttgaaatcattaggattctgaaagcaggtagcaggttaatgatcatttggtcttccttttaactgttctctatatacataaataagcatatctaccatctaaaagaaagcaaatgtcacataataaatatgttaaaatctcaatgtcttcctggcttttcaggaattcaaaccatttccatttcgttggtgtataatcaggggcccctctactctcacctctctgtaccgaagcgttaatcaattttcttttatttatatacacgatgattgtaactaggttattttcctatacaaaatttgctgaacactgaatctaagatttcctcaataccaatagcttgtcctgttatcttagctattccatcggatgcatacctcaaattttctgtggccaatactatatcattatggaaatctttggatttgaaaaactcttccaagccgtacagtacgtcgtttttgagaatctctgacactcttttggaaacaatgacaggacttgcatcggcacttgattgagacaagctttcaaaattacttgtcaaagtgctaattaacgattctattccctccttggtcttacaggacacgcttaatatggggtactttgatccgagtctagtttgtaatttgttcaaaactttcgtcatctcatcatcggaaactaagtcgctcttattgactacaataattattctcttatttccaaacgtcttcgatgatagatgtgctaatatgtcctcaggcaaaagttttgataaatcagtaggatctacaatgaataaacataagtcgctctgtacacttttcttctttgctctatctatacccagcatttctatcttgtcagaactcttttctcttatacctgccgtatcacagataataaccttatagccattcacgtttatcattgcatcaatagaatccctagtagtgccaggtatatcactgacaattgatatatcatcgttagtcaagctgttaactaatgatgacttaccgacattgggagcaccaagtaataccagctttattccattttgcagtatggtagacttttcgactttttgcatgaaagtaacgatttggtctcgcagacatatgatgttcttttctacattatggaaaatctcatccgtattctgaatttcttggctattatcgtcggcaaaatctattatagcagtcaactgtgccatattctcgataatggtttccctccagttctcaaataggattttgttatccccattgaaacttgacaaggcagatctcctttgagattctgtttccgaatcaataagatctttgataccttcaagttgggtaaggtcaaactttccattttgaaacgccctcctggagaagtcgccaggcaaggcaaatcttatatctttaccactgcttctatcgtgtaacgagccgatagctttcagtatactattaactacggctttcccgccgtgaacgtgcagctctaacacatcctcaccagtaaatgaataaggagcttggaaatatagcaacaacgatgtgtctaataatattttactttccttttgatcatgaggtttcacactacaagaggacggcgaataaatgttcctcaaaatagccttcctgatcggcggaactgtacttgaatcaactagtcgattgtaaatgtacttagcatgggtaccagatattcttatgattgctatcgcagaggtttgatttgctggtgtagataatgcatatatggttggttgctggaaggtataaggctttgcaagtccggagtacctctttaacgaccttcttacgagaaaggatctcgaaataagccgtgattgtaagaaagatgcactattcataaatagaatacttattaaccatatataacattctctaagtagatagcagtcgtatggaatattgctgtatcttcatgtaacctcgtaaaagacgttatatatgggttagttagccaaaaaaataaaaaatggacgagtccggaatcgaaccggagacctctcccatgctaagggagcgcgctaccgactacgccacacgcccgatttgtattgaagactttgaagaagtatagaaaacataaatgtaggatacatttttaaacttttattaatgaaaccaatttgaagacatgtggcaacccgtgttactcatatatatatatatatatatatacaactatcagaagattatcaatctaatagatctttaacgccgcctcagtactttctgaactgcaagtagaatatttttttctggaatcggcacattcacattcagacgtatacgatgtcagcacttagattgctactatagcaactcatttattattaatccccattcgttccgatatggatggcatattattacctttaagaaaggtggagttccaaagattcatcaattttactgtttatagaaaacgttacggaaagatgaaaagtaaacaccaaggtctcttatgccttgacataaagaatacggaatagaatgattgtagacgcaacaagatgaataattaatggcaaattattatcctattagatataaattacagtcgctttaatgcgtgattatagaaaaggtccttacaatatgcagccgggtaaagagtgaagtttcccgcctctgaaaaagagcaatactaaaataatctgaaaagaattggtgaaaagaaagctgtagttatatatacagaatgggcatagttttgaaaagagcaatagcagcaggtatgaaaccttttccaaacagtacgtggcattggagccgaaccataagacctttctcacagcatttgtctagcacatgctttctgcagcaatcctcgagatttacttcaaaacgatacctacacctttcaacattaacacaacaagaaaagcgcttcctacccgaatctgaacttgctaaatataaggaatactaccagggtttgaagagcactgtaaatgaaatacctgaatcagtggcctctaagtcaccttcgttaagaacgcttcataagagattacaattacctaatgagttgacctattcaacactttccagatgcttaacgtgtccctctgcaaaactacccgacaagataaataatcctacaaaaggtgcagctttcgttaatactgtacctactaataaatacttggacaaccacggtttaaacatcatgggaaagaacttgctctcttaccacgttacaaaatccattatacagaaatatccgagactacccactgtggttttgaatgctgcggttaacgcatatatatcagaggcggtactggcgcacattgctaaatactggggtattgaagtagaaactacgtctgttttatcacgctatttgaaaatggaaccattcgaattcactttgggaagactcaaattctttaataattcattgaactctaaggacggtattgagctaatcaccggaaagaacttttcagaaacaagcgctcttgcaatgagcgtgaggagtataatagctgccatctgggcagtaacggagcaaaaagattctcaagctgtttacagatttattgatgatcatataatgagcaggaaattggatatcacgaaaatgttccagtttgaacaacctacaagagaattggctatgctatgtcgtagagaggggctggagaaacctgtatcgaaactggtcgctgagtctggtagactatcgaaatcacctgtctttattgtgcatgtattttcaggcgaagagacattaggtgaaggttatggttcctcattaaaggaggcaaaagcaagagccgctactgatgctttgatgaaatggtattgctacgagcctcttgctcaacaggaaccagttattgatcctggcactgttgttgtttagttctgtgtttgccattttgtagatagagaactccttaaccagaatacattcttgtacatatatatatacacgttggtacgatatgcgtttactttatgtgtactaaaatatataaaagtgaacagaagcatgttccttgtttactactatatcttaccaggaaacagacaaaaaaaaaaaagacttgctatatttaaagagaacgcacatttgtgaggggataataacacaaagcaaagtaatatagggtaaatggacctcctaaaattcagttctctagctatatcagaaattaacttcctgcacgagtcatcgtttgactcgatagaccactcttggtttttattgataggttgcaaattggatcaagatgatgaaatttacatcccaataaatggtaatgaagcagagtctcaatggtatattgaaaaagttatacgaatcccgatgcaggaaaatgataaaataaatcaagaacgcctagaaaggagaattaacctaacaaaagtgactcaaaaggacatttgtatactgggtattcttgatttatgtcagttagaagaggacgaaaatatcactaataaagtgacggagaaagtgctcacccaattgaccgccttggcattgaaatatctgataaaatataacgtgtttcgccaacatacctccttccaagaagctgtcaatagtttaaagggttataaaattgaaaatagtgtacagataggcgcggaaattatccttgattttctacaagataaagtgcaaattaaggatgtaaatgacagataccaaattcccacacctaataataccgtagacccaggttttgatgagtttcaattaattgacatgaaggataaagaaatcaatattcaaaaatataataataataccataagaaaattactcgagaagattaatcgaatgataatattcttgaaaaattatgatgccactgacaagcctttctcttccacgcaagatgtaatacttcgaaaaatatcaatgcttgtaacacaactgcaaagaggtggaacaagtgacatgaattacctgctggataacaaaattaatgaaataaaattattagaaatttcgtgtaaacaatgggaaatttcaaatatgttaaaaaaataactagaatatatatattacacagaattattttcttcacttcctccgtcatcagattagtagcttcctaatacctgtcacaacttcccatttattcgtgtgtttgttgtatgtacaacccagcagctttttattggtaacgggacaatggccttcattattaaccaaatagcttatggcacacgggtagcatgccacgtatcctgtttccaatacacaggggttttgtacagttttttcgcaaacgggacaggcctcagaaactccctctttatcttccgttttgtcactatgtgaggagaaaggcggccttggaatatcttcatccaagtcattgacccttttctgcaatttagtagtcatgtcttgtgtggtccaccattggtacactcttaggacaaatataaaagtggggaagaattgcgaacccataaatgttaaaaatctgggtataatcgataattgtccttgcattagcgcgaaaattgacgatatatttgttttccttagcctattatccatccctttcgtctctttgagaccagagagttctgacgatagtggtcttaccgttgtgtactctatcttgaataagtattgcaacaaggaaaccgaccctgttcttttagttaaaaataataatttaacgagtaaattggataacgctaataatttcttaataaatggataaattcttagaaacgctctcttgggccatttattttcagtttcatcgctgctgaatatattattcattgatattttctctaatatttcatccaacttcgctgtgatataggggagaataattttttccaaaaaaataacactcttttgctgttgattcagctgcaaaccttggggccattcactctggccctttggatttaaacattgtgttaaggcaagatttctgtccctcgaactaaatagttgcaatccataaaaccgatcaataaacgtagaattgtatgtctttagatgataccattcaacaaacccttttatcgcttgaaaccactcaaaaaagtacttgttcagccgcaaagtatacctgttagggaagttcgccactaaatgatttgccagtagataacggatggatgcgggcagtaacgaatcgatttcttgtgatgacattatctcaaagatagtcggatacaatggttctaatcccaccccatttcgaccgcttgttgaagaccctcgactagattgtcctgcagacggtaggtttgaataaaagctcatcacttgacgactaccttcctttcctttgctttattttccctgcttattcccttgcttcttctggagccttcatgcaaaaccgtttctctacctaatgtgattctgcggtaagcattgctcttaagcatctgaatgagacgaaaggatgactccacactaaattgtacctctcttctccagtgactgaattggaggttaccattgccagtgacggtaatcgtccacatcgatgatttcttagtataacccacacacctctcagacatagaggccccaggtgcaacgtgatagtataactgcccggaagtagaaatacaactattcccttcatattaaaagaataaaacttcatttgaactctttaaaatttagtggttcattgtggtccttgtgtaaacggaaaaaaaggatattacggtagtgggtagtacataacaagagatgactatccctggaagatttatgacaattgataagggcacttttggtgaatacactgctagcacccgttggcccattatcattcagaatgctatagacgatttaagtaagcatcaagaaacggagaagagtaacggcactaagttcgaacaaggtgaagttatcaaaaaggagctcaaggaattccgtcaggagataattgatcgtgtacctttgagaccctttactgaagaagagatcaaaattgccaacgtcccgctttcgttcaatgaatatctaaagaaacaccctgaagtcaattggggggctgtagagtggctgttctcggaggtttacttgtatagaagagtaaatgttcttttccaacgccaatgcgaatgggctaaatttgacatattcaacagacttaaacagtcaacttttgagtcctcgttttatggtgtcgtggaattggcgttaaggtatgaaaatctgttaccacagctgagagaaatgaagcaaaatccaggaaatgagattgacgatatattgaaagttctttttaaagagtttattgagatttctttgtggggcaatgccactgatttatctttattgaccaacgctacgttagaagacattaaatcaatccaaggggcgaaagcaagagctgcatccgagtccaagattgttgttaatgacacggagaaagcatgggaggtattaaccaaagccagggccgatgccaatagcagagaaattcgtgttgattttgtattagacaattctggctttgaattgtatgctgacttgatgttggcagcttttctgttacaaagtggtttggctaccaaatgtattttccacgctaaagacattccatacatggttagcgatgttatgttaaaagattttgatatattagttcatgacctgagagatcgtgagttcttcccaagtggtgaaccctcgacaaaggaatccagagctcttgatttatttgctggtgaaatggaaaagttcgtctctagcggtaagatagaattccgcgaagattctttctggaccacggaattagattattggaatttggacgcaaacgaaaccaaataccatggatccattttgcacaaagatttgcaaaaatccaatttggttatttttaagggtgatctaaactatagaaaattaactggcgacagaaaatggccccgcaccactaaatgggaaacggctatcggacctcttgctacgaatggtattacatcattgagcttgagaacctgtaaagccgatgtacaagttgctttacctgaaggtctagacgcgaaattaagtcaagaatgggaaaaggaaaatcctggccgtggttcttggtggtgttgtagcggtaaatgggcagtcatttgtttctgctctggtatacataaataagaatatgataagttctctatataactttactttatgactttccctatgaaatgttccaaaaaagcacatagatttttagtacgtgccttttattttatgtacttctgataaaaaaaagaaagctcctaaggacaaattacaatcaatggcgaaagaagaggaagaaagtaataacgaggagagatcataaacatggcgtcagtaacagaacaattcaacgatattattagcttatactcaacaaaattggaacacacatctttgaggcaagattcaccagagtaccagggattattactttccacgatcaagaaattattaaacttaaaaacagcaatttttgacaggttggcattgttcagtactaatgagaccattgatgatgtgtctactgcttccatcaaatttctagcagttgattactatttaggattattgatatcaagacgacagtcgaatgattcggatgttgctcaaaggcagtctatgaaattgatttacctgaaaaaaagcgttgaatctttcattaatttcctgacactattgcaggattataagcttctagatcctttggttggtgaaaaactaggtaacttcaaggatcgttataaccctcagcttagcgaattgtacgcgcaaccaaaaaataacaaagatttatctggagcacagttgaagagaaaagaaaagattgagctattccagcgcaataaagaaattagcacaaaactgcactgcttggagttggaattaaaaaacaacgacgaggaccacgaccatgatgaattactaagagaactatatttgatgaggttacatcactttagtcttgatacgattaacaacattgaacagaatttatttgaatgtgaaatgctctctaatttcctcaaaaattccgtacatgaagtcaaatcatcaggtactcagatacgaaaagaatcgaatgatgatgattccactggttttaccgataaattagagaatataaataagccattgatagacaaaaaaggtcaagtcttgaggaacttcacgcttgtcgacaaaaggcaacaactgcaacaaaaagtgcgaggatatggtcaatatggaccaacaatgtcggtggaggaatttttagataaagagtttgaagaaggtcgcgttcttcaaggtggcgaagaaccagagcaagcaccagatgaagaaaacatggactggcaagatagagaaacctataaagctcgtgagtgggacgagttcaaggaaagtcatgctaagggaagcggaaataccatgaatagaggatagaaaaaaatacctatatacgtacacataagtatctattagacagattcatatattatttttttttctgcctacatcagttatattttaatcttgtgcaaaaggacttcgttatttttattcacggtgattaacaccggcgtagaatctacaatcagatttgaagaaaataccacaggctcttttctttccgagaagttgatgtctgctacgacaaattcgtcgatggatggttttaggttttctaaattcctaaactcaaagtctccattactatatgatacggtgattatgctgtcgttcaaatcgagttgtattggtagtgttgacgatggagtcaattgttccttcagtacaacttttttcttatcaaaagaataaaccaataatctctcattgcttagctgaatcagtagcttagaagtttttctatccaaaaataaatggtaaccttcttcttctggcttacccgataatattgtatcaatcttcaaatcaattttttgtagaagcttaccctcgaaatcatatatggtaagctggtatggatttgaagacagtaatattaaggatttttctgttatacccaatatacaatccagaatgtttgtggaatcattactatcatcgtcatcattatcatgtgttatttcatatgtttcttttatgttaattgggacatcctcaggagcctctatattgtccaattcccagattctaatttgagatttattcttactagctatcaacaaccatttatttttgaagtctatattaatgatatcactagacgaaaacggctgttctgagtcttgtaataggtccacatctgagatcaaagatgcgctagaaatagagaacaatttcaaatggaaactcttttcaataacaaggagtttggacgtcgaaacccagaaaaatttcataatgtcgctatcttgccctaaagatattttctttaagagtttggaattcaagtttgcgtccacttggtgtatttctaacgatttggtgtctgcatcataaagtgccatacagtccccgtaggagctgataatgtcgactttcgacaattccgagtgtatcttggatattgtttcattattttcacgcttgttggctgtgctaaacaaagatttcactttggttggtgatggtgactctgaaggaccttgctttggattgggtttggtgtccaagagggcattatttaaaatatccatcccatttgtcttcgcactgccctcttccttgggagtattcacgttcagtttctctaaatcgtgcaattcagaacccgcttctctgctatttaatgactctaactgattgaccgtgttagggcctttcaacaaataaattatttccttcacattttcttgaacagctagcttagactgcagtaatgaatcaggcacatgtttttcttccttttcaccttcaggagaaacagctttcgattgtatttgattcaattgatgcttcaaatctctattttcgccctctagttctgcaattcttgctttcatttccgacctttctagctcccaggtgattctatctctttcattcttcgtgaactccgtttgcaagtagtgcattacaccaggtaacgtgtaatgcggatgaacatgtgcctggttaatagccatattgttttccggtctaactacacgcacttacttcttttgggtttctttattaatgttgttgcttgctcctcacatttagtcgttctaggtggcttttatctaagattacgcgacggggaagatcgcaaagttaagaccaatagagtactataccatatcccaacaaagaagcctaggggatggtgcagcagtaaaaactgaatagactataatagatcatcctacgtaaaacccgaataggttatctcttaaaccttgttttcctgtaaagttgtcccgcgcatgtgaagacgcagagagtggagatcaatcttaaaacaactgaagcaactagcactttcttgacatttaataaggaactattatcgcgtaaaccaaaagaaacgcatgtaaaacatctgcaagttactccatcatctgacacctagagacgtacgtatcagaacgatttgagtggaggggtacaaaaagggactctgtagatcaaaaactgtaatattatccttttttttactttctgagaagctattcgaaaacaaggagatagaactacaagcagttatgaaggacctaaatccagaaatggggaaatttgctaccactaaaggccctcctcaagacaatagaggcatggttgatatagcgacactgcctaattttcctgccaaccgtagtgggactcctcgtgaggagatgtatctggcgcccaacaagatggaaactccaaggatacttaatatgaatatggtaccggattatttgcaaaaagagaacttctcgccagatttttcttctgctaccgtatctgccaagtcatctcctgtcaacgttactcatgatgagtcgcttcctctgggaactattgaatcgaatagcacaaaggattctaaatatgcagttcaacggcaacagcaacaagtggtagatttcatagagaataatatgcagctactgtcttcagaaacactaaattttagatcagacattatgaaaactttggagcttcccattcccaagagaagagatattaagggaaaccatctatctaaactattatttgctaaatcacctctaactatcaacacatattgccaattttatgaccgtagaaccaagcgaatttgcaatcaagaaatgatatggaaagataagaacagtagagagaagcatggttctagaaagtatcaaagacatttgagtaaagttcacgatgtccagctaacaccaaataattttaccgaattttttgatcataattctccacttttccaggaatgctatgactatcaatctagattgatgcgtgatttacttgttgaaccagatgccaaattcaaagagaagaaaaagaagaaaaaaggggacgtcaacggaaatcatcctgaaaccggatcgagcctcatcaaccaccaggtccaacagcaaaatgttcgagaacttcaatcgaaaatagccatgaacgacttgatagagattcttatcgatttaaacattccgttttctgttttagactaccaaccaatgagaaattggctcatcaaatattcaataatttcaacagatactttgccggatgaagtatacttcaaaactgatccaggcgtgaatgaactggaacacaacagtagtaatttaaacaatagcaatagcggtactcctcataatcataatcaaaaccaacataccaattaattaaaacttgcttttaatctgcatacataaaacttagatcaaataaataaaaaaaaaagtaaaacaaccatatatactatttcataagcaaaagtaatcaaattaaacaaaaaaaagaaaatacaaatattaaatttaaattaaggcaataaacatatattatacacataaaaagaataattaaagcgcagatgagaactatcttaattatcaaaattctgtagtatcccactcaactgttcaatatcttagccgcaccatttcttcgttatctaggctcactagcaattattttttctcttgattactaattgcatcctgatcgtcttcgatcgaagaaccctgtgaaaagccactaaatgtatgttccaaactatcagggctaactcccaatgatttattgtttcctgctttctgtgaaaccgagatttcttttgaatgctccgctgatttacaatcattagcgtcttcttttccacttgatttatttccgatcgaaattttttcttcaggttcctttgtttgaacagcagaactagtttcggtagcttcttttgcggcagtactcaccggaaccccatcaccacctgaatttttcgtttcggctcccactatctcttccttctttagttcatcaccttcctctattttttcaagttgggttggtaaatcttcaacatttttctcgacggatttgttttgtgttaaatactcctcagaagtcataccaatcaattttttaaccttctcttcgtcaatcttatcatcgccacgtgcagaagcaacatctttcatagcttccaacaaatttagtttttccttctttaactcgatttcggtcgcgttcaactcgctcttacgttcgttaatcaacgaatccacttccaattgcttcagacgggcctccttggttgataactcagcctgctctttagccttattagcaagaataataacgtcatcattcaaatgggattccaagctttctttagtttgacctagttccagtaatttgtcatcctctctgatatttctattcttctgggcgtcaagatcatttccgtaaccagagatctttcttttatggtcaactatagcatcctgcaatcttgagatttctgcgttaatttcatcgcgctcttccactaaagttttgtgttccgcttctgcatttgccagatcgtcatggtaaggtttcaatagttcttcttgctctttgcgcgcttcagtgatatcttgttcacatttcttaccccattcctccaaatcttgatctagacgagctttttcgtcctttaactcttgctgcatttgctttttaaattcgatctctttgctcttggtatcttcaagcagagtttccctttcagcgactttggtatccattctggccacaagtgcatcaaagctggctttaatcttttcctgggaggtctttttttcggtttgatgcctattagccgtagtagtcaatactttggcgtcattagaaatgatagaacgttccatcgtttcccattcatttgatgatttattataggcctcagttctttctgcaatttcttcatccatagcacgttgcgcctccgccctctcactcacttcaccaagtacaggagaaatcaatccggatgcgattttagtgatatcttctggtgacaaaaacaggccaccacccatgttaatcttgttatggaattctgtctttttctgatgattagactgtgcgacagcgacagcagctttgttgtattccatattagtgaatagctttctatgcatatcgcttttttcaatgatatccaattgtctgtcaacattggctcttgccaaagtcaaaacttgctgagaagttaattggctcagataggtttccctcttctgcgccttaagagctatacttttgtcgatatcctcaccaggatgcatgtctttcacagcattagcagctcctaatgcaaatttcatcgacttggcttctttctcagcagaaacttttttgaccttttgtaaatcttgtgcttttggagcatcaactttcgccataatgttattcatcatctcattggagaaactgaattgatttaaattaccatgctcatcagtcttgacgccgtattggaagttcgtcttttccggttcccatctttccttaatacgagattctgcctttttttcagcacccactaagactttctccaaattcaaagtctttggtttaggattaacagtactgttgaaactgccactcgcgccgcttaacacagagctggcagaggtgatagaatatgacctgctgtttgtttgagagcttaaacttgtagtttccattgtcatcgaataagctttcgatgcggcggcccctggagattctttggactttctcttcgtctgagattcttttgaagttttagaagtagcagaagttattgagttgttacgtacaactttgggtcccattttggatgcagctttagtggcattagggtcaataaacatacgtttgtaagcttctaccgtggtttgattgtcatgagctaaattagctgccttgtcggaagctgcatgagcgtcgctgacgccaattgagtaactttgggcaggtgactggtaaaccccgtacttcaacttcgccttatataaagcctccctgcttaatggttcgcctgttgtctggtatacctttggttttctcaaagatttagagccgtgtttcagcgactttttcgacgaagttatagacgaagtcctgctccctccaccagaagtctttcctatattatgtatgtctctatcttctacagctgaaattaaagacattggttattttgcgttggttccctatatgcaaagctatttaacaactaaagactgtgtaatcgtcagagtgcactattttgcttcttttcaaagtagctgccaaagagctgaacctttaggatccactgaattaataaacattggtgatatactgcaagcaacaaggagttctccccatcgagtggcagtagttcttccccctctcgagggtgcccctttcggtagtttgcgattttcttccagaagagcaccgattgccccatccggaaagtactatttcccttttgggtaacagcggaccgaagcggaagcgttcgagtagccgaggtatatgatttcctctttgggcaagttgtaaacaataaatggtaaaaagttatgaaatatattcaatggtaaaggtccatttgataaagtacacattcactgtatgagggaaagaggaaagccagctagagcatttttttggagcaggcgagcaaacaatataaaatacaaaggcctcgtgtgagacttggaaagtgtactactaatattcagaaaaaggtgaaagaatgagctacagttatgaagcttgtttttgggacccaaacgacaatggtgtgaacatccttctgggtcacatttctcagggaataagatcttgcgactcaatgatacttttctttaagcagcgtagtgagcttgagaaggactatgccaggcggcttggagccatcacgggaaaactagacaaagacattggaacaaacatggattatggaaagttgaatgaaacatttaatgtggtgctcagtgttgagaaagctcgagcacaatcgcattccaagcaaagtgagattcttttcagacagatttacacggatactaaggcatttgccgctaacttgcaagcaagatatactacattgagtggaaagattgaaaggttgcggatggacaagttcaacaagaaaaaggggtgtgaggtgttgcaaaagaaattacaggatgcccagattagattcagagacttgcaattgaacgagaataatatgattggggccaagagagtagaacacaacaagagagaactattgaaatgggaatcgaactctcaggaatataaggttcaactagacgttcttaagcaagaatataaggcatcgcagaaattctggatacacgagtgggcgcaattatcctgcgaactgcaagaaatggagaacgctagaatatcctttttacaatcgaaattacaacagttcgcaacctcatcgatggaaacatatattttagagcaaacaaaaatggacatgttaacaaatcatctgaactcattcacggcagcggatgaaatatcgacgttttcaaaagaaaatggaactggtagactgaaacataagacttccaaaggtgacatgaattctagcgccaactgggctcaaatgagcagtatctccacgacaagtaaaaaaaccgaatcgtatatggacaatataaggaaactatcttctcagctgaaggaaaccgaaaataaaaggaaactagcttcaatagacaaatatgagaaaccattgccatctccagaagtcaccatggctacacaatttagaaattccacacccgtcatacgtaatgagacaaaagtggttgctaacccaacattatctttgaggtcttcacccgtccagttacagagcaatgtggatgactccgtgttaaggcagaaacctgataaaccaaggccgattgttggggaagaacaacttaaacctgatgaagattcgaaaaatcctgatgaaaaaggtctaatggtgcataaaagaaatcaatctctcagctcaccatcagaatcaagttcttctaatccaacggattttagccacatcaaaaagagacaaagtatggaatctatgactacatccgtaagttcaatggccaatagtatagacgactcacagagatttgccaaatcatggaactcgtcaaataggaaaagaaaatctatgagccatttgcaagtaccctcatccgcttcttcgaggtcggatgatgggggaagaacgcctaactctgcgcacaacctcaatgaagatgattataacacgaggagagataccagtacaagcacaattttgttcaaacctcctgtggcagtaagaggaacgtctagggggcacacgcatagacaatccatgataatgcaagattcaagtaatccaattgaagatgccttgtacgaaatggaaagaatccaaagtagttctaaaccaggtacaaaaacaggaaacatcatggatgagagaggtgtggtcagggatagaggtattactgttaccttgcctattgtcaccagtgaaggttttccagtcattgaatatgccaaggccatgtatccattgattggaaatgaggcacctggattagcgaatttccataagggcgactatctgctaattactgagattgttaataaagattggtataaaggtgaagtttatgataatgaccgtatagatagaaatcataggataggattaattccctataatttcattcagctactgcatcaaggtctttgatctcgatgtatatcaattttactagttttctgataaaagaaaaaaagtataatgtcagatttttgttaagtagaaatagaaagatatacgctgccgtgggagaaggacacctctccggatttgtaactaaaaatcataaaatatcacgtctttccttcatattttcaaaaaaaaaaaaagttttctttaccatttttgacacaataatcacgataattgttaggtcaggcattccctttccacttttatgttcatttggacgcaataagatatacatattatttaatgtgctctaatgacagttctactgtgtttatatcattagagtcacttgttacgaatactacatatttccgcgcagtggctaaaagcaaatttcaacattataaatctctaatagtaaactgacaatattgcggaattagaaaaaatgtaccacgcgaagttaagtgtcttgaacaactactatatgcattgaatatggctccatttaggcaggacagtattttggtacgtatttagttcatcaatggattttttaagtcttcacgaacagtttttggttaatcttttatactaacaacaattcataacagataatataccccagatctcaaactactctcgttcaatttggtttgaatgaagaaacattcactgtacctgagctggaaataccaacacagatttatcggaccacgagacaagatggttcctacacatatcattcaacgaacaaggataataaagccgaattaatcaaaccaatccaaaatggtgaaataatagacataagcgcctttacacaatttcttagactaatatttgtatctattttgtctgatagagctaataaaaatcaagatgcttttgaagctgaattatctaatattcctcttctactgattacgcaccactcttggtcgcaatcggatctagagattattactcaatatgtcttcgaaagtcttgagataaacaatctaatccaattgccggcttccttagcggccacttattctatgatttcgttgcagaattgttgtattattgatgttggaacacatcatacagatattattcctattgttgactatgcacaattagaccatcttgtctcttcaataccaatgggcggacagtctattaatgattctctaaaaaaactactacctcaatgggacgatgatcagatagaatcattgaaaaaatcaccaatttttgaggtgctcagtgacgacgccaaaaaactatcaagtttcgattttggaaacgaaaatgaggacgaggatgaaggaactttaaacgttgccgagattattacaagtggtcgtgatacacgtgaagttttagaggaaagagaacgtggtcaaaaagtcaaaaatgttaaaaatagcgacttggaattcaatactttttgggatgaaaaaggtaacgaaattaaagttggtaagcaaagattccaaggatgtaataacctgattaagaatatttctaatcgtgtaggattgacgttagataacatagatgatattaacaaagctaaagccgtttgggaaaatattatcatcgtcggtggcactacttcaatttcaggttttaaagaagctttactgggtcaactactgaaagaccatttaattatagagccagaggaagagaagtcaaaaagagaagaggaagcgaaatccgtattaccagctgcaacaaaaaagaaaagcaagtttatgacaaatagcaccgcatttgttccaactatagaatacgtacagtgtcctacagtaatcaaactggctaaatatccagattactttcctgagtggaagaaaagtggatattcagagattatattcttgggtgcccaaattgtttctaagcaaattttcactcatcctaaagatacattttatatcacaagagaaaagtataatatgaaaggaccggctgctctttgggacgtgcaattttaagaatacgtgatagatgcttcgtgtatccaaaatccgtgtgaatatgtgctgtttagttttttccatccaatgaggatgggaaatatatacataaacgttatgtaatatatagaattcatgcaaaattaacaagggaaatatcaccttggttgtgtatatgggacgttgttcgacagaacggattgattttcaccagttccaattgatatgatcttttccaaatcaacttcctcattctcatttgcacaagatgactcgcttccgtctgcttgagcgtccttttgtatccatcttttgaacaagcttacaaagaaatttgccgtcatgacttgctcaacttgatataaaaccaagggaaccaacaacttacccaggtgttcttttttatcgccgtattgtgaagtaattagtgatacacccagtgctgcagttttagccgggccacaaaacataatgcaaatcgcatcttcctttgaataataaaaaggcctaaagatattatacgaatagcggtacaatcttgtagatttgccctctattggttcatgagggaaaagcttgaggatgaaccatggccttgcacataagtatgacagacccgtgaagaatatataaattcccaaattaaaaaagcagagaaatatgatgcaaacatgagaaacgctagtaaacgcatcctgataaaaggcagttgagaatgaactaaacataatcaataaaagcatgtaagatccaattttaatatggtattttttcaaaaagcccaggtaataagcagtacccttcggaaagcaattttgaataacctgacccacaaacaagggtacgaatacagagagaccaacctgtttcataacacggccataaagcgcaccaatgccatttccagtggcagggttgccgtatgcaaatggtgcgcggttagtaaacatttgaaccaatgcaggtgtaataaacgcacccaacaaatttccaatgaatacttcacaaacgcacaaaaggctatttccacctgcattcgtagtcatgataacgtttgaagccacggttgttggacaagtggcagtcaaaattagaccgataagtacccagtcatctattttcggatcattagcagcctttaccgcgcaacaaaatccatatactatggacgaggtaataaggaaactcagaaccagaatagtggcatgagctctccaatttaacatatttgccattagtgaccttgatttcattcccaggccactttggagaaaaatccaggcgacgcagccgtacccaatactatattggcctttaattaaccctccgtctcttgcaaaattcggagcaaatcttgcaataacgattaaaatagccaaacagatgaaaaaccactgggatttcagaaattctgttactgaatgtgcccaaatttttcgtattagagagtactgagtcttcatttggcactaagtaggtgtattaaatgtgtgtcttccttctttttgcaagttatgtcagagttgggatatatcgtagaaaagggtgcgaaggtgattcaggtagcatagacggtttcaggcaataaaaagctataaatctctctttatataattgaaggttaaaatttgctagattttaaagtggttcggttcttttttatgctttcttagcttctggctgttcgttggagctcagacttacgggtagaccaatgtcatcgaaatactgtggaagatcaagctcggaaggagagcgaggctaagttccgagctactgaaaaaaatggaaaaaacaagtgccttaattgaatgactagatgggtgcttgttaacgaaggcgtgctgctattcatgaagctgttgcattgtactgtacagtaatgtttcgagccggatcatcaaaaagattcttacgaaacacactaatagcaatttcatgggttccggtacttctaacaatcaataataatgtggtccatattgcgcaagttaaaggtacctctatgcagcctacgctgaacccgcaaacggaaacgctggcaacagattgggtgctgctttggaagtttggagtcaagaacccaagtaatttatctagagatgacattatccttttcaaagctcctacaaaccctcggaaagtttactgcaaaagggttaaaggtttaccgtttgataccattgacacgaagtttccataccctaaacctcaagtgaacctgcccaggggacacatatgggtcgaaggggacaattattttcattcgattgatagcaatacttttggccccatttccagtgggttggtcatagggaaagctataacaattgtttggccaccctccaggtggggaacggatctcaaactgagtaccggtagagactgcattagcaaaagagccattttagaatgaaaatcagcttatttttatgaatttagaagtgaccccggtattcaaatgcaaattttttatattatgtgattaatctaatgcaataaatatagatgattgtgatttatgtattgatgttgttgccgttcggttcctgaatatatacttctttttttcataatacttcatgcacatgtagtatcattttttatcttcagtctctagagaagggaataacgatcttcttgcgggcctgggtaaatcttctcggtcggaaccaacgaaagtaaaatctccgtcttgctcttcatctccacttacttgctgatgattgcctctctcatcttcgaaactaaaatatgatggggtatccagtccgtccattagtagcatatgtgaagtgcttaggttactgttactactcatagacgacttacttaagatggggaagaaattttcgtcgcctgtactctcacttgaatttaatgatgaaccactagagactcttctgtggtttaatgacagcttcggaggcggctcaaacctgaacgatagtgcagaagatgccattgttgttgaagattgatggctatctctataaaagaagttaggatttgaaggggaagctagttttctaaaagaattatttttagtagcaaatcttttagattctctcctaaacttatccatttcttgttcacaattcagcaaattttcttgtgagttcattcccacgtactgacgtggataacatagttcaggaaaattgtcaaaaacagctttgtatccgccatccaatatcaatatgtcgggatagaataatttgggataatgatcctgatttattatacgatcacaatttctcaaatgagaggccaatgaaggtccccggtgggaactaaattcgcaatggataattaaaagagttggtagagtgttgttgttgctagtatcgctatgcaaaactttatggataaattcgtactctaactcatctctcgagtgtatgttaacggagtttattatgtggccgccagtatattcgtattcaaaccgacaatctataatacgacatgaattataaaatgactcgcacatattattctgcagaatatttttcaacgtttctggagaaattcgagggaaaaagtcatttgagttacgatcgtcataataatatggtatctgtgttttggctaggcatgattcaaaacatttcacccctaccgaattaggagctagtggactggatgacgcagacgtgaagttcaaagtattctgagtaatgttagaaaatttctgtgaactttttctcgatgacctcggaattttcccatcttgccgttgcaccctcctgcttgaattgctactgctattcatgcttggctttctcgacaaggaccttgaccttgaaaaagagctcgacctctggggactgccaggatacttgattctacttaaaagatcattatccctattattggtcaaagatcttcttgatgagtttcttgttggactttgtaaggtttgagaagcaaaatgcatgcttaagactatatcatcattttcattttcattttcatctaactcatcgcgatggccaagctgctttatattcggtgaaggaccatcaatttccttactcctgtgatttgttaacaatggagatttatcaaaggcaagattctctttattgattaaatcatcgtcgacattcgaatgtttgctttttgacttaaagaaggtctgaacatttctaaatatgttcttcttcttaccaaagggacttttcaaggaaattttttggaaactaagaacgtcttcattggcacattcatcttcagttccatgaaatatattgttcatggtttcttcaccctcgctgacttcaatcctggtttgtccactgctctgtttatcttttgtctcctttcaagttaactctcttttctttgttttcgcttgtaactttaagttttctgatatacggcatcgaaacagggaaaaaacagataaagcataaaaaagaaggaaataacagagtgtaactgttggggaaatatcataatgagaatatttaaacgccggaacaatgtatcaaaaagggctttaccgctaataagtggagtatctatgcttttttgacgtatacaatggacagaaaaagcgccatataaaacattgaagcccctcttcatccttagtcctgaaaatgaggcctaggaaattaagtattcggcaaagatacataatacagttctaaaagtagcaaactggtagatactatttgtggcgcagttagctaccccaaaataaaaacggtaatcttctcccattaggggcacccctcttgcttttgtacgatgtggtatcttcgattttcaaactgacaggcatattgcacagcataatgcgcacggaattcattaaactgtacggatatatatatgatattacggtgccatatgatattatacaatattatactgtactgtactatattatattatattgtattaattatattatactataccctatcataccaaatattttggctatattaatttttatctacgtgtatctaagttgttacaggcgggggaactgaattccttcaaaatgtgaaggtaccggaaaaatggcaaagaatcatgataataataacaataagccgtaagcttcataagtcattgaacagaattatcttatgaagaaagatctatcgaattaaaaaaatggggtctattaaatgtctccatgttttttatgagtcttgatgtgttgcgacaaattatcgcttctactaaatttcttatcgcatatgtgacaagcaaatggtcgttcgttagagtgaacagatctcacatgccttttcaaatgttcgctgcgcttaaagctcttgggacaaatgtgacagtggaacggtttctcctcgagttcctttgttgattctattacgacacttgatcttctggacggtgtcattgattttctcctgtaacttggccttctttccttcgtaaccccagcaccattgccagttgagttgacactactactgcttatattattttgttgatttgtaagcggcaccgtacccatcaaaggcacagcagacttccgcctccgaagggaagaaccgattttagagttcatggtatggtgaccctgctgtgggaaatggtgatagaaatgatttgttgcaagagacgtggaggatgatgatgcaggcgataatggagccatattcatttgagtgatggaaagatcgaaatttggagtagaattagcattttgttcaccttcctctgtcaaaaatggcatatcattactcaagcctgtagtcgccactttcgcaataacggacgcattgtctgaaagaatcatagacggtttgataaattgttgagatgaactcaaatttgaattcggcagcatatcgttcttggggtcttcatcctgcttattaaccaggtcgtagcttagtgaatcatcgattatgggtaaagaagctctttgccttcttgaataaagatcgctgttgaaggatttcatgttagtgctactgttattatgtgacgaggtgagctgcttgtgttgaactcggtttagctgttgctgtaattgctgacttggatttatctttgtcatagcattggcatcaaaagaacttgggcaagcagatttgttcttgccagaagtggatgtgcccaaattatcgttgaagttcatattatattcgttaagaatctgtgtcaactcattgtctatggtagcgtcattgtttttcgggttgccagcaatatttgagtctgcatttgcgttcatagtagtggtattcggacttgcattggaacttgaggtagaattagtagtgatattgagatttgtatttctattgcttggattaattttcggatggttccaaaggtccaaagagtgagaaatagaattcctcgaatttgtcattgacggaaattggtttgttataacgtcgctaaatcttcggcgtgataaattagtgtcatcatcatcatcattcaataagagatcactagaaacgtaatcatctagcatggagtctatgttcagtgaattaaaataactggaatttaaattacccgtagaattggagtttgaattagaaatggagttagaatatgaatttgtatctgagttcaattgatttcttagtttttcgttcaaattgtttgggttagtgtcaatgaaaagattcgaattagcaccattaggtaaggacagacgattatctttaatggacgtatgttgttgggctcgaggagatataagagtttcattaccatttgaagtttgaggcgataaattagtttcgttacttgctgtatttatgggaggatttatagtcggattttgaggtaccgatgaaggtgacggtgattgtaacggattgttcatgttgtacaaaatgtcgttcataggataaggtgaagtaagagttgtgtattgatttgccccagagccactagcattattagtactcttaatttcactatcattttcaatagttcttgcatcgcgatttttgttgctatcagctttcaaatgcaagctgttatcggtagtggatggtatcgtttccgttacgggcagtggagagtcgaaagatagtggaggaagccccaaattcagtgaagtttcttgattttgaatgtcattgagatccgcactatctaagacagtgtttttgatatctagagaatacgggataacatcgttgttaatattatttgggttattattctccacgtattgtatactactcatgctttctatggggaataaaatatcttcgctattgaaatcatggtcgaccgtcattttagatctagttcttctatgagcaataaaagttgaaaaaagaaagaaaaaataaagcaaataaaaccaaagaaaaaaaggtagcctcttggcgtatgaaataccttgctactactgttgtgatcttcccgaaaaatatgaggaagataccgataaagtaaggaagaaaaaagcaatatctttttttttttgaacttttcgtattacagactagtttctgttatctccaaggtttccgtctgttttattttcgtgtaacacagtttctaactgggaagtcttgttgagctcgtgctgctttcttactattaccaaacaggaaggcaaaaaaagggaacacggtttacgcgataaaagtaaaagggccaagtctgactggtgctgatatcaggcaacaaacaccactttgttctgctatttgtctttattacctgtctctttcgctggaaacaacaaatataaataagtaagtgtcaatactatatgttgtctgtagaggggaaattgtatatattttcggtgtcttgtttttcttttccgcagtttgtttttcccattctgattttctgaaattcgtaaaaaggtgtttttttcgtataaatggctctctttaatttattagagacaaaaagagccgatatgtatgacgtagacagatggtgtcaagaaccggcttggctgctacggaatgcgtagctgaacgccgtggtttccggagaaagacgaaagatcaactccggccgtctggccaggaacgataggtgctggagataagtgaggtacggataccaagagcgaaatacctctttaggtacgttccgggccgttgttgccggcgaaaccggagggacaaggcaatatgaagtaggattggaaaccggctttggcatattgccacatgcgtatgtacatgtccggcatcacgtggttatgatgtagtatactatattatgttatatctgtattacgctacgttgtgctatcttggatgttctatttgatgttgttggccaaggcatcttttctctcttcccaaacagtctttccggtacacgcacacacttgtttattattttcccacacaccagcgcttctcgcaatgactcccagaaatgagtagtccttaacggaggaaggctcgttttctgggtggttcagagacttggaaatgacaaagctgcggccgataagttgccatgttggcaagggagcgctcagaaaggtcttcccactgtacaagttcttgcccaaatcactctcgttgaagcattcaatgggttcgtcgaacttgtgccaaactttaccagtagattccacgcccttggagacgtcgcctttctcgtgaatgctggcgtggtaatttcccgcctctgggacgccatttacagtgatgtcaaaaagagtcttattctctccaacctgaacgattcttgctaggcccctcacggcggtgtcctttttctggtctatagtatatttttgaaaggtctctaagatagcgaccgcggaagaattcggcttcccggcgcctcttatgatggcgtctttaccacagtttcgcaaggtgttgatgatggttgaaggggctactgagctttccacgctcattatttgttgctctatatcgaaattcaatgaattgattcctgggacattttttaggcatgcctttatatcattcacgcaattttcacagtgcatgggaatggcataagtagcctcgtatgtatcgttcgtggtcatttttgtgctgatcgaatgggtttctgccttgcaaagatatctttattcttttcttagtctaaattttttttttttggcttgcctttaatatattatttttccgaacaatgaatttttaccctcttccattctcactgtgtactagttgtacggggaaaatgcttagtaagcgcaaatttttttttgatagtatattatactgaaatgtacaagattaacttttgtctggttattataaatcacatatttgattatatgaattgttaaaatgaatttgacaaacagaaaagtatatatttttatttctttttttttttttttattctctaataagctcgttggatggaagacgttgacataagcaagctcaacttccaggactattattcttcttcacttatgtcgtcttcagccttgttcatttcagcttccaagctttgagcaaattcttcgtcactagaatttgcatcttttgactcgtttatgttggagacaatatcttcttttttagcttgaagtgtgggtacaggttcaggttcaggttcagctatcttttcttttgcctttgcctctttctcttgttctgcaactgcttttgcctttgcctcctctgcctcttctttttccttttgcttgcgttcctcttgttgtttcctacctgcctggcctgggatgatcaaagtagcattggcttctctttcagcgttttgaatgttttcctcgtgtggaagtagagtaggtggagcaggtttcttcttctttgaacgtggctccaagtcatgactctcattagatgctttggacttatcttctctcctcttctttgggctgttcttgtccttcccgtttttatccttgtcgttattagtactgtcattattgttatcatcttcatattcgtcgtcggacaatagtctaaccattttggtttttggtctcttggatcctagccttctcaaggcttcatcaatattcaatctgtgcttaagcaattcgtcgtatagatcttctgtcaacgaaatacctttcttcccaggtttcatttcgcctgtagatgagtccagatagtactcacggatatcaattaaatttatgtttctaaattgtcttaccgtgaccctcttatttttacccagatcaaaaattgcatctgatgcggatagtccagatggcataccaccattgttattgttactgttacttaagtttcctccaccattatcgcttcttcttttgttcctatacctgttgtaatatgacatagcgcttgtgtttgtatatatgtcgaaaaattgatgtgtacggaaagatttaatattaaatagctttcttaagtgggcaaccaaaagtgtttctttgattggggacttttacaaaattcacgtttacaacctcttctcttgtcttcctatcgttccctggatcaaattaagaattttcatcaagaatagagagcagaaggcaagccaagagagaaaaagaaagagagaaagaaagaaaggagaggaagaggagatgaaaagagaggaaaacttgagttttgataaagaaatttgaggaaggtaaaagtaaaattcccattcaaatgaatgtattaataaattctcatcattaaaaggagggaaaaattacgtataacgtaaagataaaacgtgtgtgtgtgcagtgctatactcattgtccttgttagtgatgataattcgtcccagctgaaaaaactcaaaataagtattacccggatcgaggctgtggcatttagcgccgctgtcttgaccatccaccaatggttgataataacatcggatgatcagcccatttttggtgtattactatcccatctcattcttccaaaaaacacgtatatatcattgacgagatcgagatacgtctgctgtgtttaacggctaacttggttgtgtaggcttgtgtcaattaggcaaaatggttttcttggaaaaaagacaagggaaaaaaaagggttgatagagcaatatatgtacagctggccttctctgagaaaagctagccgcctggaagtaaataaatacgctgagtgttcgttggagcatgaattatgtgaatagaaaaatactaagcaaaatttcaaagtcgagttagtgatgggtgtttatttggcagtactcttttcgttactggtcatcgaaatggccattctgtttattttggtacttccgcttccacagcgtatgagaaggtggctgtatatacgctacagtatcataagtactaataagaaattcagaacttatatggttggaatcatgatcttcgttggtcttttgttcatcgattcatggaaaaggtcacagatcagagtgtctacgtaccgcaaccagaaaaatccctatataataaatagtgtaaccccagtggatgcactggcttcaagggcatataaccaaaggaatgtttacatttcaggcttcatcatctacttttatatatgtatactcaccgtgatgagtatattgcgaagaatagtggaatggaatgacaaaatgaaggctggagatgacattctgaaggaaaagttaagacgaaagcaaaaatatttagaggaattgcagaagaagaaattttaaaaggaaaaaactaaaaaagaagaaaaggaaaaacttacatatgtaaatagaacaaatgaatataaactaaaatttgacaaattttttttctttttggggtgattatatcatttctggatgaggaatacctgaagaccactcttcattaaaatgttctttaaaaatattcttttggatatattctactagttgtccgtccttagaagataatctgttgccattcgatttcacaatttcgtaattatccagagcaagtttcaattcttccatgctactgactccaagaacaacgggtccctttcctacccattccgaaatcgcgtatcttgtggccaaatcggctaagtcgacattttgttcttgacagtatttggcagcctgagatgcgcattctctcaattcatgagaacacgggtgaaactgtcttgtctcctgtgaccttagtagcgacatgctcaagattgatgcgttgcaaaccattttcagtttagcattgcgtagcagtctttctcgaaagttcaatagcttattgttttgtaagttcaagttacaataggacaatactgcatccaatgacccaatatcactttcctcggtagagcagtactcagcaagccaggtgataaagtcgattgggtagcctgatatgccaaaatttttgataactcctttgttcttcaaggtcctcaattcctttaatgcctctaagatgtctggaaatttgacaaactcgacatcgtgcaagtacaccaaatcgagatatgtagtgtgtaatctttcgcacgatctgtgaacactaaatctcacgaaatctctagaatagttaaactcttccgcaccaatacgcccaacctttgtgcatataaaataagtgtctctgggaaattcattccttaaattggacagtgccctaccataaagaacctcactagggccatagtagggagaagtgtcaattgcattgataccatgcgaaaatgcgtatttgattatgtcttccagtggaatggattctggctcatctgtatattgctggttcagtattgcacctcctaagactaaaggagaaaccgaagctaagtcgaatggattcactttttcattaaccatcttatagtctccgttgttactcttttatttatgtgtactcttccttcctgttaacagagtagataaatataggctttaaacttaccgtgtactgaaacccagaaggcagctttcttttttccagaaagtaaaataatgacaaaaaaatcgactacatatgcacaatgctaagttatatgacactttctttcttatcctcacttatccataagacacccctcttcttcagagaatttggtaagcaatttcatgtatttccatgagaatgggctcgcatcccagagcgcaactaatatatgaatataagcggatttagctcagttgggagagcgccagactgaagaaatacttcggtcaagttatctggaggtcctgtgttcgatccacagaattcgcattaatttttttttacttttcattcgttttcctcttttggtgatgagcagcatcacagaagcgggtgggtcatccattattagacggtaagtgaaaaaaatttgatgattcaggtgaaccgctatggaaaggcacgtagttctacttactcctagcaagtagctatgcgattttcctgcgccattttttttcccacattagttacatacactctctaaagaatattgctaaatatgacgtcgaatagcgacggttcaagtaccagtccagttgagaaaccaattaccggcgatgttgaaactaatgaacctaccaaaccaatacggcggctttcaacgccatcgccagaacaagatcaagaaggcgatttcgacgaagaagacgatgatgacaaattcagcgtgagcacatcaactcccaccccaaccataacgaaaactaaggacagcagcgacacaagtacggttacgaggcggaagcagccgatcaggtacatcgagaataagacccggagacatgtcaccttctcgaagaggcggcacgggatcatgaaaaaagcatatgagctctccgtcctaaccggcgccaatattctgcttctaattctggcaaactctggcctggtctacactttcacaacgcctaagctcgagccggtggtacgggaagacgagggtaagagcctcatcagggcatgcatcaatgcttcagacactcctgacgctaccgacacgtcgccggcacaggaacaatctccggcaaactgaacatgcgagagtaagagatgccccacgaaggcataggcagatccatatagcacaatacgcgcatataaagtagcattgctgccaaagggggttgcacaaggagttgccctccttcggcacgcggctcggaacataccggagtgtccccctttgagtaatttttctcaaaagaggcacttttgcgctgggccgcaggaaatttccctttctgttcagcacctgttgtcctatattaagctgtgccaaacaaggtcatctccaaatacttaccaaaaagctagggcgtactgtactggaatctctgcttttttctttaccttacttcaatttgccttgtctgcttttttacgtgtgttttggcgtttctgcttttcttttttattactcgttgttgtaaatcattttctaagtattatacatactatatcatcgcatacccaatcggtttcctattctcaccacttttttctggaaaaatacatagcctaacaagcaattttattttacgtttgttaattcattatactgataatatttttgaattttttttttttttgatacattttttttaatcgctgttttgtctgtttttttcgattcagttatagggaaaaaaacgggaaaggaaagagaaaaaaaaattagtgcagagcaataagaagcgaaaatcaaaaaaaagttttggatctgcaagacttgctgtcacgcaacaatattatagccacccagcaaaaatgtcagacatcgaagaaggtacgcctactaataatgggcaacagaaggagagaagaaagatagaaattaagttcatcgagaataaaacaaggcgccatgtgacattttccaaaaggaagcacggtatcatgaaaaaggcgtttgagctttctgttctaacggggacccaggtcctgttgctagtcgtttcagaaacaggtttggtatatactttcagcacgccgaagtttgaacctatagtcacgcagcaggaaggtagaaacctgatccaggcctgtcttaacgcccctgatgatgaggaagaagacgaggaggaagacggtgatgatgatgatgatgatgacgatgatggtaatgatatgcaacgccagcaaccacaacaacagcaaccgcaacaacagcaacaagtattgaatgcacacgcaaatagcttaggccatctaaatcaagatcaggtaccggcaggcgcgctgaaacaagaggtgaagtcacaattgctaggcggtgccaatcctaatcaaaactcaatgattcaacagcagcaacatcacacgcagaattcacaaccacaacagcaacagcaacaacaaccacagcagcaaatgtcacagcaacaaatgtcacagcatcctcgaccacagcaaggaataccacatccgcaacaatcgcagccacagcaacagcaacaacaacaacaacaactgcaacagcagcaacagcagcaacaacaacaacccctcaccggcattcatcagcctcaccaacaggcttttgccaacgctgcctccccctatctgaatgctgaacagaatgctgcctaccaacaatactttcaagaaccgcaacaaggccaatactaatcttatcgatttccgtatataattcatagacgagcattaagaggaaaaagctgtttccgtaccaattaaagaaagatagacaacaagaacaaaaacgtacattactctatattgaaaaaagccctatgtcggtaaaagaataggaagtaccttagtcatcggcacttacctttttttttacgattacttctggtttgtttctttgcctcatttcattttgctgccactttctttcataggcaagaagattcaatcaaatctccccttctccttccccggatatataaaatataaatataaaactttaagaatataaaaatatgagaaaccacacataacttgtatactttactcacatacacacatttccaaaaaaattataatgttaattacattgcttttaatgctaatctttttttagttgtataatcattaccatataaatgcctctcggtctaatttcattgccagtattgtaagttatatacttttatacgagtgtacggaaaatatcgtggctccccgttaacagtgaaataaatctacgcatgtagctgccagttttttaagcgttatatcaatattggtaaagtaagaattgacgaagaaattgttaactacatttttcagaacggcgtgtcattctccgataatgtctgaagcgatattccagccaacggacattgtccttgccaaagttaaaggcttttcagcatggccagcaatgattatccctaatgaactcatcccagataacatcctcaagaccaaacctgtgagtgtccacaaaggcaaatcaggtagtgataaaaaagcaaatgaagatatagatgcagacatggaatcagaggctagagatcgagagcaaagcgaagaagaagaagatatagaggattttggtgagagtgaggctaatcctgaaaaatttataatatacactcccgttctgaagtttcgtaaaaatgatacgttgaaatcgacttactgcgtcaagtttttttgcgatgattcttatatctgggtgaagcccatggatatgaagattctaacaagcgaagattgtcgtaagtggctaagcggcaaacagcggaagaataagaaactcataccggcatatgaaatggctatgagaggcaaaaatggaattgatatttgggaatttgtggaatatgggtcttacggcaagccagatgaagaggaatatgtagaggaagaggaagaagagaacgaacctgaaaaaaaggctataaggccaaccaggtcttccagtagacagcgtcagaagcgcgcctcagaaacggaaaagagtgagggcggtaatagcaataaaaggaaaagagttactagatcgactaggcaacaagcgatagatgcttcagaagaggaagaggaggaagaggaggaaaaagtacaagaggctgttagaaagaggccgcaaaggaccaaaactaagaaagttgtagtatccaagactaaaccaaatccaaaaacaaaggcaaagaaagagaaacctaaaccacctaagccaatcaaatatcattttgaagatgatgaagattggagcattgttgggttgggcccacaagatctatcaatcgaaaaaacgatggatccgattgcgaaaaaactgtcgcagaagaaaaatctagaaaagcatgtggagattaagctagatctggaggataaactagcaggtatcaacaagctcctgtgtgatgtcttatgttcagccattaaccaggctgtttcgataaaggatgatttcgaaataatattagatgaattgcagattgcccttgacaccagggggtccagaaacgaatttataacaattttccaatcaaataattccctactgttaaactttaggatattatttaacttaagaaaaagggaactgaacaaatgggatctgtgggatcgtttccaggatattttcaagcatatttattcctaccagttcatacctgatacggaagattggcaactagagcaaaatatggaaattgaagaaatggatcgggaaaagccgagctttagtgaagacgtaaaggaagaagaaagcaaagtaggagcatgacctgttgctattgcagttgatgtactctgcttttgaacaatagaggggaaacctgtgtactataaaatagactaaaactatgtaacttgtgtatgttctgatatgtatgacgcagtctttgatagtccaaaactcacctagactgtgctgtattattacaattaaagttctaagtctgttgtgcattatcatttgagaaatgggggaatgttgagataattgttgggattccattgttgataaaggctataatattaggtatacagaatatactagaagttctcctcaaggatataggaatcctcaaaatggaatctatatttctacatactaatattacgattattcctcattccgttttatatgtttcattatcctattacattatcaatccttgcacttcagcttcctctaacttcgatgacagcttctcataacttatgtcatcatcttaacaccgtatatgataatatattgataatataactattagttgatagacgatagtggatttttattccaacataccacccataatgtaatagatctaatgaatccatttgtttgttaatagtttgaatgtttttatcggaagaggtttggtcattacgtctgcaatattctttttggtttcgatatagcatacgtgcagatgatttcctgatacttcatctctcagtctcattgctttagtaccaaaaaatctgtttctaaatttctcttcattattggatataattatactgattgtagatttactgtcggttagtaatcctttggtaattggtttcttgtcgagttcttgtatcaggtaacttagattatttaataatgggacagattcacttattgcgtgtatttctgcttccgtagttgaagtacatgttaatgaagccttggtggactttcctccaattacttttccattaagtaaatatatgttgccaatttgtgatttataatacggttggttaccatacgatgcatcgcttataacaactaatttatttgttggcttaacaggtttgcttttgtgccatattaattgcttatctctcgtattccatatgaactgtatcaattcatatgtcatatctaacacttgcttggacggaaatagtatatgttgtgcaagtgtgttgatgtagtataataggtcaaatctaaatttatatccaacatatgatgctagacctatcagcttttgcatttcatgtaccttcattttgtaatcatcttcttctagctctagttcttgctggtctatatatagacctggttgacctggagcgctaagtttccttccttttgggttcaaaggtacgtttagtttgggtattttttcagttaatgagttttccatacccaatttcatgtatttacctctttggtatttgatttccaagccaagaatgtcatattgaatttcctcatcactttcgcctagatttataatcttggtgtcgtattgcatcttaagcttgtctataattcttttgtttgaatttagatttttgctaaacagtaccatatcatctacgaataaacaaattgtcacttgactgttttcaaatacgcatgaccatccacgaacttcttccataccacactgttttatcaggtatgatttgatagtttcgtaccagttcgctccactttgtttcaatccataaagtgatttcttcaaacgtatcaacttatcattcattcctaaatgtggtggaggtcttatgtataattcttctttgatgtctgcatacaaatatgccgaagatatgtctaattgtgtaatatagtagttattgtctaatgcaagtgacagggatgtcattaatgcatagtgatgtacggtattggattgcatgcctgagtcgtaagtgtcaggatgctgaatatcacctcttgcaacaaatctagctttatgagtaccgtcacgtttcctgttgaagataaacattgaatttattactcttttagggtctatttcttttctgtcataatatttgtcagtgtcccaagttttcatcttcaacagttgattgacttctttgtggtatgcctcgatatatttttctttttctttaatatctttattataggtgattgcctcatcgtatcgtaaggttgttcgtattggtttgattgattttactgcttttacagctgcaatcaggtggattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgacgagaattgatcggtggaagttctttaaaggagtctgataattcggtaggaggttctggaggcagatcgggaagtggaagatcagcaattatagattcctctgtattctccttaggacaggtatctgacgttttgataggaacgacgtggtgtagtgaattactttctgatgaggaagtatcgatcgaaggtgaacggtgtatgatccttttctcagtctcctgttcgcttgtctgcggaacagttttattattggtaccacccgtactggatattggtacgtttgtatgattagtctcattgtcactgtacgagtctgagtgtctgaaatctttagatttactggcgtgcgacgactcatgtgtgttagattgggacatgggagcaagtaaaggaacatctaatctatgcataccacccgaaccggtactctcgatatcggaaatttggggggtgctagatctcttcttagatggaagaatattagattcagatatgttggggtcaacttctctgggtgcgcgaatattggttttggaaacacgtttcgaatcttcagtatgagttgacggaggtgtggaatcggttggactcacagcttttgaaaggacatttctcagttgctcaggatgtagttcaatgtcagattggaagtcatggtcagattctatgttaagatcattggattgttggatctcatttgacgcaatgaacgaatgatatgaagcagttaaacggtttaagtcttcatcgaaagtgagtgcgtcgtaattgaattgatctaatctggattccttgccctgaagaataacatagttagttgtatctactgtcttctttaaggacggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggtttagccgttcagcgactccatgtgctcgggaatccgctgtggttgtatagcatggagttataccatttttttcaaggaatttatggagagttctgttagtatactcagaaccacggtccatttgtataactaagacactggcctgaaactggtttttaataaaagctagtatcgtagtaaaaacatcgaggatagagtcctcgcgacggtcgtgtaatggataaacccaacggaattttgttgtctcatcagtaaatgagatgaaataggatggtgcactttttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgtgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagatcgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgtcaggattagatgatgctgagtgtatgtgatgagcagatcttataagggttcgtgatgctcctgaatcaagaaggaggtgtccagggagtttatcatcagaatgattagtgtgatttaccgtagattcagtaagttcctggcctaaggtgaaggtcgtgtgtattcttcaattgaatcggttcagtagtcgatcctcttatgagatcgttatcagggccgggagagttattaaatgtggatacgttatgagccctggctgttcttgattgcgaattatttggtttttgggaattccgagttatggatttgggtttggttgtattcgtataggtgcgagagtctttcttctcatcactcggacttctcctatgagtagatttattacgttttgattcctgttgttcttcatacatagaatgtatgtctgaaaacagatcagcaactgtcatatgtatacatcgatgacgtgcgtagcgtaaaaatttgtactcgccagatagacctctcataatgaattggcatgctaccttgttattgataggaataccattgttgtttagtctgtcaagaatgtttgtgacttctgcttcaaatgcatctgcaggtgtacttccattataatgcaaagttgctagggtcgtaatgtcatttacctcttgagtatcagactgcattttgttaatgcttttggaaagaattttcatgatatctgtataatcaacagataagatgtctttaacccaggggggtaagaattgagatggagcaaatagttgaaaggtgtgacataagaaggtgagttcgtcatcagtcatctgacgtacggcttttcttgttgctgtcggaataatatcaccgagattcgaattttgtaaaaatttaatgtatattttaacccaattgagaaagtcattaggtgaggttaagattggcggtggtctgacatgttgattagtggatgtcatattagactttgctgaggatgaatcaggaaatgaattacctgactcaggtgacggggtgttcaaatgtgttccaacatattgtggatattgtgtaaactgtgattgtgccccaggtggagcgtacataggtgacatttgataaggtggatacggcatcaaggatgggtgcccgtatactggccagccagaaatattggcttgttgggtattcatcatgcgctgctgtgggtacggcccattttgtggcaatggtacttgagcagcttgaggagaggcatgatgatggttctctggaacagcagatgagagaggtgttgttggctgttgagaattagcctgagtggaaaccttctcacattcttctgttttggaagctgaaatgtctaacggatcttgagttgtttggacttctttagaagtaaccgaagcacaggcgctaccatgagaaatgggggaatgttgagataattgttgggattccattgttgataaaggctataatattaggtatacagaatatactagaagttctcctcaaggatataggaatcctcaaaatggaatctatatttctacatactaatattacgattattcctcattccgttttatatgtttcattatcctattacattatcaatccttgcacttcagcttcctctaacttcgatgacagcttctcataacttatgtcatcatcttaacaccgtatatgataatatattgataatataactattagttgatagacgatagtggatttttattccaacatcattttcaatgaagctgtgaccttggcattcgcaccgcttgacactacaggacgaataaattccatgttcgggtggtggctagaggtacatatgcggtaaatgtactgtatagcccagcatgtttttcttaacaatccaagtttgccatcttagtatagtggttagtacacatcgttgtggccgatgaaaccctggttcgattctaggagatggcattttctttttttttcaaagaaaagaaaaagggaaggcaacaaacgacatgaattattgtctttttcaaaaggatgtaattatcgcagcaggtctatgaagggtcccttttctcttttttatcacttgttccatctataattttatactcaaaaatttaacaggttaattacactaaatgcattacaaatttgtatttgattctatatatagtttcgttatataataactcaggtctgctctgcagcgtggtttacgataaacacgtatgtaccactgtctgcatcatagctttcgaacttagaatttggatttttctttaagcgttcgatatgccttttaaccagttgatgatttggatcctttataggttttctggtagatttgtctacaggataacagttaaagcaggtaatcctggcccgaacattaatgccctcccctctcttcggtctgtttggtaagttcgcatatattatacaggtttttggttcaaaagtaatgattacgccccctaatgaggtcaaaggaattccagcgaggtcaacaggttcaagaaattcaattttaccataacttttatgacccacaactaaatgaggaactttgcgcagttgcaagagagaataagaggataatgtgtccagggatggtgagatatagtagttctcattaatgaaggaggcatctttttccgcaacgtccgcaaaaacagcctttttatcatcttctgaatattcttgcttctgtaaatcggcgacattttctttattttcttcgtccatattccgggaatgatgtttcgttgcgctatcttccccatcgttctttgaggacaaaaccattctttcccccccattagcagtttctttttcatccatctttggctttcccaagatcgtttcttgttcttcacttttacttttaaaattcatatcgttgttctgtgatccgttattcttttcctcggatgcgatcaacattttcctgttattaattagattcttgaatgaccttttatcgggattgaataataactcagaagcttttaatatgctttcgtccaaattttcctcctgctggttagaaatcgcaatctgattattctttttatcaatggaaatcgacaactttggatcaaccttgatctgggccttatccatgacggaattattagtcttgagcttggctgtaaataaagttttaggaatcattttgtatgcgttcgtcaaactggcttttttgcgttcatcggctttgatctttgtagcgcttggttgaattggataggaaaccgtgttggtgacagttgctttcgaaaaaagctcattagtaccgtagggattgttattctgaatttgtaatcgttgttgctgctgctgttgttggagcgcattttgtgattgtgccattgactgggaaggttgggaaaataaccctccgcccgaagtgttcgtactagtgttattctgaaataagcctccagcattagtagattgagaggtgttattactaccaaacaggcccgttgaaccgttggaattgtttagagacgagttgttattgtttccaaatagtcctccagcacttgtagaagctcccgcaccaactggtttattaccaaataaaccagtagaattggtggtggccgccgtgttagatgcattattggacccaaatattccacccgaagaggcgtttggagccgtggaattagtacctccgaaaagggatcctgtagcaggtttgctaccaaataatccgccgctagttgaggcaggattgttttgatttgcaacttgattgtttccaaataatccgcctccaacagtgtttgatggttttgaaccaaacaggccacccgaagcaggttgctgtttattttggaacaaacctcctgattgctgctgcaaattatttccacttataccgttactttgatttgttgtgctgttagagaataagcttgtatttccaaaaccagttggtttcgctccaaaaagactattattctgttgtggttgttgtaacccattttggccaaatggctgattattattttgattggtctggccaaacaatccaccaggttgggactgcgactggttgttttgttgtccgaataatcccccggttgattgctgttgttggttattttgcccaaatatagaattattttgggcattaccagacgcaaaagtggatgctccctgctgttgtccaaacagtcctcctgcaggtttgcttccaaataatccgccttgttgctgtggctggccaaatgcgtttgaggagttttgttgtccaaataatccggattggttctggctttggttattctgaccgaacaatcctccagcgttggaattttgttgctggccaaataaccctcctccactttgctgctgattggtttgcccaaataagccaccagtggtaccagtggggttggtattcattccgaatgcttttgaaccagcagattgtccaaatagtccaccagaagcaggtttagctccaaaaagagcaccagtgccttgctgttggccgaaagcgccaccatttgcgttagcgtttgattgaccaaatataccaccactaccttgttgtgtttgttgttggggaaaggcaccacgattcacctgaccaaaggctcccccgttactgacattattcgccccaaatgaattttgctgttgaccaaataatcctccgtttgtatttgagttctgctggccgaaaaggcctgtattattagtgccgtttgttgggttgttagttgtattaccaaacaatcccccggaagtggcaggtttatttgctccaaatgcagaatttcctgagaggttagtagagcttccaaacaatcctgtagagttggtcgctccagagccaaagccaccaccacttccagttccggttccaaacatgcctgttgctggcttttgaccaaataatcctcctgttgtagcagaagtagtggagttattattacccataattccaaatccagtattggtagttccttgaggattgttaaaagtagtaccagtgccattttgactggtaccgaattttctaccagcttggtaatcttgaaatctcaattcttcaaaagaaaaatttctgtattcaggcatacaggtgatactttggaagacgttgatgacacctgtggttggatccttctcttcgaatgtagtaaaaggtttaatgcttgtacctgcagtagaattgggcacaacagaagcggaaccagcagaaagtgctgtgttattacccattccaccgaagatcgagccagaggcattgttgttcgtcaattgactttgaccaaaaggagtaccatttgctgtagtcgagcctgacattccgaagggagaattagaagtttggttaccaaagttaccaaacgcaggtgcttgtgttgtatttgtttgctgactgaggccgaaagcagaagtgtttgctactggttgttgttgttgctgttggccaccaaaggttgatcctgttgagccaaatggctgtgttgttgcgctggggaatgcgccacggctaactccaaacataataatgttttaaaaaagaaatcttcgaagctgaatggtgcctctcagttgccgggatctctatgcaatgctgatagtttcctttgcgaccttatgacactttattaactctaagtataatttagttttgttctttttctaatgagcatggtaaggaaaaatgccgggtaatgataatctgcaaaagtgacaataataaactgacgcgtaacaagatcaatgatatactggattaaaatgccatgaaaacgtgaacagaaacttttattgaggtcatggatcaagattttgacagtttattactaggtttcaatgactccgatagtgtccaaaaagacccaactgtaccaaatggcttggatggttcagtagttgatcctaccattgcggatccaaccgcaattacagctagaaagagaaggcctcaagtaaaattaacagccgaaaaactactcagtgataaaggtttaccatatgttttgaaaaatgcacataaaaggatacgaatttcctcaaaaaaaaactcatatgacaacttatcaaatattattcagttttaccagctttgggcacatgaattgtttcccaaggcaaaatttaaggattttatgaagatctgtcaaacagtaggtaaaacagatccagttcttagagaatatagagtcagcctttttagggacgagatgggcatgagtttcgatgttggcacacgggagactgggcaagacctggaaagacaatcacctatggttgaagaacatgtcacttccgcggaagagaggcctattgtcgcagatagttttgcgcaagacaaaaggaatgtaaacaatgtcgattacgataatgacgaagatgacgatatctatcacctttcttatcgcaacagaagaggacgagttttggacgaacgtgggaataatgaaacggtacttaacaacgttgtgccgcctaaggaagatttggatgcattattgaagacattcagggtacaagggcccgttggccttgaagaaaatgagaagaagctcttattaggatggctagatgcgcatagaaaaatggaaaaaggctctatgactgaagaagacgttcaactgattcaaagtttggaagagtgggaaatgaatgatatagagggacaacatactcattatgatttattgccagggggagatgagtttggcgtagatcaagatgagttggatgctatgaaggaaatgggcttttagcaatgtcattgaaggtaataatccaaacgtgcgtgtgggcatctatacatataggtttatatatattgtgtaaataaagcttgtagaaagagcctggttcgagtgtttgattttttcttcttgggcgttattatacaatatctacttcaaattatttatctaggtggtccataagcgagccgtattatcagcaccggcagaaaacagccaagcttccctcggatgccaaatagcatcaagaacacccagactattgattactttatgaccggttagtttctttagtggcacaatcatcggatttttcatcatgtcatcataaacagtggcatggaaaacatgtatggtaccgtcatcagcggcagagctgaatagaggtaactttttgtggaaattcacacttctgacggctttttcatgatatcttagtgtcttgtaaggtgtgctagccaaatccaggtcgtgccataaaactctcttgtcaaacgatgacgcaattaaattatcaccccttgggtgaatatcgattttcgataaccaacgggcaccaggcaacagtttcttgaccaatatttgttgagataaatcataaattctgacatatctttgggaacagacaaataattgaggtttaaaaggatggaacttcgcatccataataatgcccttcgattttttgaatggggattgggttaaatgcttggaaacttggtgaatcaaaacagaagtgttaccagagtcaggttgaacagtgacaaagtaatcaccttttctatgccatgaaagcttttttactgtttttttgcaagaaatagtgatacaaatatccttttctagttgcttttgagaaggcttgttccattgggctacttgtttttttacagcattcttagcagattcattctctccatcttcatcgccatcaccattctcgttcacttctaggttagattttttaacagtcccaaaagtatcgtagccaaaaccatcttcaatcttagttttgccgttattttcaatatcgtagccgaatattggtggtactattaaatgaatgttttcaccaacagcaacggcgagaataccattattagcatcaggattccattcaatgcattcaatgtggtaatctgggttttcctcgtcatcgattaaagtagttctataaacttctctaccagttaaaatttcccataccctgactgttccgtcatcagatcctgttgctagccataatccagaaggatcaatggataatgtgcgtacttttcctttgtgaccagcgtatattgttgagcaacgaatagggaagggtcttaaatccttgggagagggaagttctggaattagagaattaggatcaatattcaatttgtttttacggacacgaggagctaaatataaatccaaagatctttcaaatctttccctaatagattcaccgtaaccagggacctttcttaaggcagaatacttttgaggtatgaagtttctttctctttcactatattcagtattttcccaggcctccttttcttcaggagacaaaagatactcttctggtggattataactctcttcattagttggtggaggtaattttggtgcccttagatgcattacatgatcatttgtttccgtagaatcaccccataaatcgtattgatagttttcaattttttccttttctttcatttcctttaattttttaggaggaataatacggccctctctgatagctcttacaattttcataactctcttggcttcgtttttggatggaacaaatcttctttttggctccggaacagcagttaatggcatcacttcttcgtgtctcgtgaaccaatcgattaacggttcgtatggatttatgctatcatcagtttgttcgttcctttggattttggaaataagttctaattcctctttggttaagttcaaacttgaaccggaattcttgtccagtaaaccagtccagccttcaggtagctcgatagaatccaacagttgatctaaagcagaacccttggcaggtctcataatccttttaccgttgatatcgtatccaatgtgtggcatttcatcgtatgcagaaagtggaatattaccaatggtattttgcgtttcggcatcactatcatcgctatcataaactggattaatttcaggtttgataattctatcactgccatctgcatattttgagtaaatattcggatcaacgatcgtttgcaatttcacacccgataatctgtctgttaaggaagttgtgtcgtctgaaaactcagaactgtcatagtcctcttccccatcaccttcttcttcggcaagcagtttgtttaattcagcatcggagtcatcatcagaatcatcttgggcttctttatcagaagatgattccttttcttcaacggcagactcgtattcgtcatcatcctcgtcactctcacttgcttccgcatcgatcaaaccgtcaacggataaaagcttgtcctcatcttcctcgacatcagattcttcgctagctgctctctttttcgacatctttgcctcggtagttttgttgttcttagccatcattgacctagttatgttagaacagatttaatacagtacctttcttcgctaggatctatatgcgaatatatcacatatgtaaattataagctcatcgcaaaaccaaaaaaaaaaaaattttcaataatttttcactaatcttcaaaaacaaatggggtaacccgtacaagagttattaaaacccaaaatgacaaaatcgcgacaattcaatcctacttaattagcaataacatactagcggtagagctactatcacatgttgaaccttgaatgctcaattcattgtactcaatactgctatcaaaagaaaaaaaatgtattaattatattcttgtcaaaatcaattttacactataagaggaaaatgttcttcagtcctagtaacattagttttctccctttgctagagactttacataatatcctagaaggtaaaattcgataatacagcagtaaagtcgtatattggtagcaatccttggtgacgctgactttttttttttgtaattttattgtttagttcatgataaaaaacttcaaatcacttttaatctggtagacagagaaaacaaatcgaaacgaaaatagagaactacgaataaaaaaatataagtggagaagatcgtcactacgcattaaacaatattgatcgctcaatgccagtactgcgcgtaaaagtttagtaacttaacgatttaggcacaatttgagaaaaatttcgccctgcagtaagtatgttattcagtacgatataaagctgaggttttatgctggcaacgttcagattttttaggttatcagcaatgttaaaatattaaataggatacttttattgtttgagaccaccctcaatgccagatatgttaaacgcttttttctggagtgaggtatcatagaaaaaggctcgagtacatcaagcacttaaaggttcaacactctactgttacttctttaagctaagctattcatacataatagtccatcaaagtggctcaaattgcgcatacagtgtaaaaatgcgttcagggaataacgatgtcaagcagcgtgtgaaaattggacacgttgaataataaacttcctggaaaccgtcgcgcgccactgctgtcagaaaatagtagactacttaattttcaattcatatttagcctgctttttgatctatgaaatcgcccactctaaatcagcggtgtttttgcacggtttgtaattttaacttcattatatgtattattcggtgacttcactaaaaaagaaggatctatgcaatattcttatcttctattttttttcttttcgatttttgaagttaaaccttcgtaatgaacagattcgaacagtatacagctgatgacaattacatgttaaactttcattgatgataatggcacgcactccacctgttaaagaggcagaacgaagaacctttgcttataacataggtcagtgtatactggataatagtatcgaataaccagcataatattttctctggaaatacctttaaggggtttttagaagaaaaacaaatcctagtgcaacttgcaagtcatcaaaaataatctatcttatctctatatatatatttgtgtattttatattttatgacaaagctagaaatataaaatcagataccgcaatagaagatatttcaaataataataccaatctcatagctcaaaacaggcactaagggaatactgaagaaagtaatgtctaggagttagtatagcttgaagttgccatcggtgtcatttaggtagatctatctagattacgcgcagccctcagaaaagcaagtgatttccgaagtttcaacctacccagactattcacataaggttaatttatgattgaacagttcaaataaatctgcgccattcatgaagatgattcgataccgcaatatgctgctaaagtgctaaaaaaatgatttcgcccaggatcgaactggggacgttctgcgtgttaagcagatgccataaccgactagaccacgaaaccaggttttattgaaaaattgcatctaaaataacctatactaataaatcttctaataaatcttctaactcttcgctgttctatgtgatatcgttgatagttaggttttcgtgttgaaataatcaattacatttattgactggtttaatattaatatattatcatatacagtgtaagaaggtgagatatatgtgggtaattagataattgttgggattccattgttgataaaggctataatattaggtatacagaatatactagaagttctcctcgaggatataggaatcctcaaaatggaatctatatttctacatactaatattacgattattcctcattccgttttatatgtttatattcattgatcctattacattatcaatccttgcgtttcagcttcctctaacatcgatgacagcttctcataacttatgtcatcatcttaacaccgtatatgataatatattgataatataactattagttgatagacgatagtggatttttattccaacataccacccataatgtaatagatctaatgaatccatttgtttgttaatagtttgaatgtttttatcggaagaggtttggtcattacgtctgcaatattctttttggtttcgatatagcatacgtgcagatgatttcctgatacttcatctcttagtctcattgctttagtaccaaaaaatctgtttctaaatttctcttcattattggatataattatactgattgtagatttactgtcggttagtaatcctttagtaattggtttcttgttaagttcttgcacaaggtgactgaggttatttaataatgggacagattcacttatcgcgtgtatttctgcttccgtagttgaagtacatgttaatgaagccttggtggactttcctccaattacttttccattaagtaaatatatgttgccaatttgtgatttataatacggttggttaccatacgatgcatcgcttataacaactaatttatttgttggcttaacaggtttgcttttgtgccatattaattgcttatctctcgtattccatatgaactgtatcaattcatatgtcatatctaacacttgcttggacggaaatagtatatgttgtgcaagtgtgttgatgtagtataataggtcaaatctaaatttatatccaacatatgatgctagacctatcagcttttgcatttcatgtaccttcattttgtaatcatcttcttctagctctagttcttgctggtctatatatagacctggttgacctggagcgctaagtttccttccttttgggttcaaaggtacgtttagtttgggtattttttcagttaatgagttttccatacctaatttcatgtatttacctctttgatatttgatttctaagccaagtatgtcgtactgaatttcgttatcactttcacccagatttattatctttgtatcgtattgtttcttgagtgttgttatgattttcttatttgcatttaagtctttgctgaacaatatcatatcatcaacgaataagcaaattgttacttgactattcttaaatacgcatgaccatccacgaacttcttccataccacactgttttatcaggtatgatttgatagtttcgtaccagttcgctccactttgtttcaatccataaagtgatttcttcaaacgtattaacttatcattcattcctaaatgtggtggaggtcttatgtatagttcttctttgatgtctgcatacaaatatgccgaagatatgtctaattgtgtaatatagtagttattgtctaatgcaagtgacagggatgtcattaatgcatagtgatgtacggtattggattgcatgcctgggtcgtaagtgtcaggatgttgaatatcacctcttgcaacaaatctagctttatgagtaccgtcacgtttcctgttaaagataaacattgaatttattactcttttggggtctatttcttttctgtcataatatctgtcagtgtcccaagttttcatcttcaacagttgattgacttctttgtggtatgcctggatatatttttctttttctttaatatctttattataggtgattgcctcatcgtatcgtaaggttgtccgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgacgagaattgatcggtgggagttctttaaatgggtcagggaattcggtaggagattctggaggtagatcagggagtgggagatcagcgatgatagattcctcggtattctgttcagaaacagtagttggcgttttgataggaacaatattgtgcgatgaattattttccggtggagaagcatcgattgaaggtgaacggtgtataatccttttctcagtctcttggtcacttatctgcggaacagttttgttgttggtaccacccgtactggatattggtacgtttgtatgattagtctcattttcactgtacgagtctgagtgtctgaaatctttagatttactggcgtgcgacgactcatgtgtgttagattgggacatgggagcaagtaaaggaacatttaatttatgcataccacccgaaccggtactctcgatattggaaatttggggggtgctagatctcttctttgatggaagaatattagattcagatatgttggggtcaacttctctgggtgcgcgaatattggttttagaaacacgtttcgaatcttcagtatgagttgacggaggtgtggaatcggttggactcacagcttttgaaaggacatttctcggttgctcaggatgtagttcgatgtcagattggaagtcatggtcagattctatgttaagatcatcggattgttggatctcatttgacgcaatgaacgattgatatgaagcagttaaacggtttaagtcttcatcgaaagtgagtgcgtcgtaattgaattgatctaatctggattccttgccctgaagaataacatagttagttgtatctactgtcttctttaaggatggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggttgagccgttcagcgactccatgtgctcgggaatccgctgtggttgtatagcatggagttataccatttttttcaaggaatttatggagagttctgttagtatactcagaaccacggtccatttgtataaccaagacactggcctgaaactggttcttaataaaagctagtatcgtagtaaaaacatcgaggatagagtcctcgcgacggtcgtgtaatggataaacccaacggaattttgttgtctcatcagtaaatgagatgaaataggatggtgcactttttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgcgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagaccgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgtcaggattagatgatgctgagtgtatgtgatgagcagatcttataagggttcgtgatgctcctgaatcgagaaggaggtgtccagggagttcatcatcagaatgattagtatgatttactgtagattcagtaagtttctggcctaagatgaaggtcgtgcttattgttcaattgaatcggttcagtagttgatttactgatggaatcgttgtccgtgctgggagagttattagatgtggatacattgtgagccctggctgttttcgatttcgaattatttgttttttgaggattccgagctataactttgggtttggttgtattcgtatagctgcgagaatcattcttctcatcactcggatttctcctgtaattaggtttgctgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaaatcattaggtgaggttaacattggtggtggtctgacatattttttagtggatgtcatatcagagtccgctgaggatgaatcagtaaatgtattacctgactcaggtgatggagtgctcagaggcgttccaactgatgatggatactgcggaaactgtgattgtggcccaggtggaaagtacataggcgacatttgataaggtgtatacggaatcatagatgggtgtccgtaaaatgaccaaccagatggattggcttggttttgggtcatcatgcactgctgtgggtacggcccattctgtggaggtggtactgaagcaggttgaggagaggcatgatgggggttctctggaacagctgatgaagcaggtgttgttgtctgttgagagttagccttagtggaagccttatcatattcttgaattttggaagctgaaacgtctaacggatcttgatttgtgtggacttccttagaagtaaccgaagcacaggcgctaccatgagatatatgtgggtaattagataattgttgggattccattgttgataaaggctataatattaggtatacagaatatactagaagttctcctcgaggatataggaatcctcaaaatggaatctatatttctacatactaatattacgattattcctcattccgttttatatgtttatattcattgatcctattacattatcaatccttgcgtttcagcttcctctaacatcgatgacagcttctcataacttatgtcatcatcttaacaccgtatatgataatatattgataatataactattagttgatagacgatagtggatttttattccaacagaaggtgatctaaagattgagaaacagtcaccagatttaggggaagctgaaatgcaatgattgataatgtaataagaagcgagagggaaagtataaaaaggaagtgatcaatttgtgaataatttgataaccgttgggattctattgttcgcaagggctttattttattatgtgtacagaatataataaaatttcccctgagagatataccaatcctcaaattggaatcgatactcctatataatacaattacaattatttctccctccctttcgtatgtttcattatcctagtacattatcaatccttatatttctgcttccattaaattttacgactgtttctcaatgtttagatcatcttcttacactgtatatgataatgtacgagtggcatgaatactactgaacagatgatattttatagcttcattccaacagaaagaacataaagtaatatcgttacgtaaaactatcgattcccttttgacgattcctacatcctcgagaagaagttctagtatattctgtgtacctaatattgtaggctctaacaacaatggaatcccaacaattaatcatcttgattattttattccccgcgttttagagcatcaatcttgccagcttatagctggtcattgtcgacgataatctcaagcacagggctaaaaaataaattgaaacggacaggaattgaacctgcaacccttcgattgcaatcttattccgtggaatttccaagatttaattggagtcgaaagctctaccattgagccaccgcttcaacttttattgtttatattgacacctgtataacaatataaccacaataaaaggttcattcaaagctccggctagcattcggcgattaatgaagaaagttaaaccgtgatttattacttcttgctcgttttttccatcataagttcgcacagagcagtatatatagtgatttgcaaatatgaatagcggtggtagtgatagtttcgattatcttcttcaattaacaaaagctttaagtgcagagtgtcgggctaacagacaagagaccgatcgaatagaactattgttaaagcgccttgccaaacagtcaggaatatcttatgataatttgagcaaaaacataattccagattcatggaaagataatgcatctcaaaaagcatctccccccactgaggcacagaagcttatcagcgaaaattttaaactcatatacgagattgaaaaacaagagtacttcaatacaaaggctgttgcgctaattaacaacataaatgagcatttctcatatattaaaaattttatcgacgaacagaatgcaataagagaacgaaatattgccacattttcatcagagaagcttgatgaaaggaacaaaagtcttcaacaaaattacgagtcattgaagacagaaaatgaagaaacaaaaaaaaaattgcattcaattatcaaacagtttgaaaaacttttgaaggaagtggattgggatcgtatatctaaagattccagagattacagccgctttaaaaaacagttggaatacctgcaagacacgtaccaggtactgaaatagcctacgatggatcgaacaaaagtgtaagcagacgtgaaatagcaaacctttgaatgcatttatatattttaatatacttataacaacggataaatgtttagatcccttttgaaaaaaaaaaaaaattaggatgaaccgaaaaaaatcatactcgtattcctctatcgtcttcactggcattattgtgtaaagaattattaccaaataaccacctgaaccaccccacagtatcattctttaaatctttaaaataacggcggctcagcatctttaaacaaagagcttcataggtggggttgttagtggtcatcaaatcatttacgcatctatcatattcgtctttatcactcttgggatctattgcagagcatattccagttttaccctgtccctgaagagagcttttcaacccaattaatttggaatcaaactgagcaacactactttcaatatctcgtacacgaacttccaatatcctcatatcatatttcaacctagatgataaggaatttaactcttgcatctcatggagaagaagttgttgcttattgtcaatgtcttcaaatctcccttcaaacacttttgcaccatctgaatacttcttatatagttcttgcagtcttttatatctttcgttgaatttagagtactgaccaacagttccctccttatttaatttacccatataatgctcatccatttcttgtatgtgttgctgcgcttggatgtcgtatttcattcgtaacaaatctctagctattcgaacaacagatggatcaaatggtaaatcccatttttccacaatattctgtacagcagaagaagagttgcatctatacaaacgagatgacttttccttcagctctgaaagatcttcataaatgttgtcgtgtgtgcgatctttacaatagggaaacgaatttcttcggtagtattctccttgatataatttgttgatgccaaaattatatgcatatttggtattatcgtagtttggaaacattgatgacactgttgcagatgagggcatagcattggtcctccctatgtcttcagatgtatcaagactggaagaactaacctttttggaggcgtgcttttgagcgtatgcgattctttccaaacgaaatttttctagtagcatttccctttctcttatctgcccatcaggatcgcctctctggtagttaaatttcaaaaattcttcattagaaatatccgtacagcatttccttgggtgtcccttacctttccatagtagtcctacagagcctccatgaatattatgaataagtgtatctagatctgttgtaagaattttgtgtgacaggttgatgggatttccctttcctatgatgtcctgtaccgttgatgtcaccattttcttcagtttaaaaatgtctttgctagaaactttcgctgtcacttcaaagagtttctctaacgttcttgggtctaaataaactctagattttcttttattgaggccatgctttttttggaaattataaataccttggaagaaaccagcttcatcaaagggatccttagaggaaatgcaattttctatcatcaacttgaaatagcaacaaaggatcaaactaattaggccagctactgtcgtcggacccagtgtgcattcattccttggcttttctgtaccaaggtacagtttcccgtaagtttcccaccattcatctatagctcgcttggtgtcttcacacaaaagaccatccgtctggtagttcttagataacaaattgaaataactcaacgaaatttgaattaaagttaccatctccacgactggtgatttactatcggtatttcgacactttgaatttccaaccgtcttgtattcttcctcaggcaaacgcggttgctgctgctgaatcatttggggatactgtgcaataaaaccatttgtagggattttgaacagttgtgaaaacttatcaagtgatgccatagttggagggcataacagatttgccgatcttccaccacaatgcaggtttttcagatcaaaattaacctcgaaatccttccaaattgttctcaagtcaccacattccacatgcaacagattcaagccaaaggacacacccgaaagattggtaataaatagagtgccctttggtgtaaattttggccgcgcaaattccattaattcttcaaaatacagtctaaatctccctggccacatactcgtatcctttggcaaaacgactctgactcccgatattgtatcctgagagtttcctgtatatgacgtaatcaatgttgacaaattcctacatgctacccattgctccacaatatatatttcaaacccgtgtacgataatttcttcataagttaaatcagcatagttgcctaaatctaacaagaacaaagccctagaatctgggaatataaaactgtcgagaggcgggagctggctcacagtatcattctttatcaacccaaccacttccgaatcatctgagtgaccatagtaactacttccactgtaattggtttcctcattgtttaattcatcgtaataatcaccgtttgcatctttttgtccacgttctccaaagaaattatcatcgagtgtatccctagtggagtaaattctttctaaatcctgcatatgttttccatcaaactggctagttttgtctcctgtggcaatagtatccgccataaccatacatatttattaataggtgcttcttccagggtctagttcattacctcccctaaatatcattctcagatcattatagcttctatttcctgttatgcgggtagcggggcttatttttgtttctcaaaatagaggtgtccttttttgccatttttgtttatgtagtcaactgcataggtagttaagaaaagacataggcccacgaaggtgattggaagttcagtgttgacaataatagaatagtagcacactctttttatttcgttttgcttacagttttgtactcgcttttgcttttgcttgcaaataatatcctcgtgacctcgaggcttacattaaggtgcatatcataattcgcaacagacgcattcttattctctaaaattcctcgagttatatgaataattatgaatcaagaagaggctatattccggtcagcagacatgacgtacgtccaactgtacataccgttggaagtcataagagaggtaactttcttattagggaaaatgagtgtctttatggtgatggatctcaataaagatttaactgcctttcaaagaggttatgttaaccagttgaggcgtttcgatgaagtggaaaggatggtaggcttcttgaatgaggtagttgaaaagcacgccgcagagacctggaagtatattttacatatcgatgatgaaggaaacgacattgcccaacccgatatggcggatctcatcaataccatggaaccactatcgttggaaaatgttaatgacatggtgaaggaaattactgattgcgaatcccgtgcaaggcaattagatgaatctttagatagccttagaagtaaactgaacgatcttttagagcaaaggcaggtaatattcgaatgctcaaaatttattgaagtcaatcctgggattgctggaagagctacaaaccccgagattgaacaagaagaaagggatgttgacgagtttagaatgacccctgatgatatcagtgaaacattaagcgatgctttttcttttgacgacgaaacaccacaggaccggggcgctctagggaatgacctcactagaaaccaatcagtcgaagatctaagctttttagagcagggataccagcatagatacatgataacaggctctatcagaagaacaaaagtagatatattgaacagaatcctgtggaggttattgcgtggtaatttgatctttcagaattttccaatagaggagccattgttggaaggtaaagaaaaggttgaaaaggactgctttattatttttactcatggtgaaacattgctcaagaaggttaagcgtgtcatagattccttaaatggtaaaatagtctccctgaatactcgttctagtgaattagttgacaccttaaaccgtcaaatagacgacttgcaaagaatcctggatactaccgaacaaactttacacacagaactgctcgttatacatgaccagctgccagtatggtccgccatgacgaaaagggaaaaatatgtttataccacattgaacaagttccaacaagaatcacagggtctaatagccgaaggttgggtgccttccacagaattgatccatttacaagactcattgaaggattacattgaaacgttgggttctgaatacagtaccgtctttaatgtgatcctaaccaataaattaccacctacataccatagaaccaacaagttcactcaggccttccaatcgattgtggatgcatacggtatcgcaacatataaagaaatcaatgctggtttagccacggttgtcaccttcccatttatgtttgccattatgtttggtgacatgggccatggtttcattttatttttgatggcactattcttggtgctaaatgaacgtaagtttggtgctatgcacagggacgaaatttttgacatggcatttacaggtagatatgttttattgttgatgggtgcattttctgtatatactgggctgttgtacaatgatatcttttccaaatctatgacaatattcaaatcaggctggcaatggccttccactttcagaaagggcgaatcgattgaggcgaagaaaactggggtttatccgtttggattggattttgcttggcatggtactgataacggactactattttccaactcttataagatgaagctgtccattctaatgggatacgcacatatgacttattccttcatgttttcttatatcaattacagagctaaaaactctaaagtggacataattggtaactttatccccggtttagtgtttatgcaatcaatatttggttatttgtcgtgggctatcgtgtacaagtggtcgaaggattggattaaagatgataagcctgctccagggttactgaatatgctaataaacatgtttttagcaccgggtactattgatgatcaattatattccggacaagccaagttgcaagttgtactactgcttgcggcactagtttgtgtcccgtggttattgctgtataaacctttaacactgagaaggttaaataagaacggtggtggtggcaggcctcacggataccaaagtgtgggcaatattgagcatgaggaacaaatagcacaacagagacattcagcggaaggtttccaagggatgatcatcagtgatgttgccagtgttgcagacagtatcaatgaaagcgttggtggaggtgaacaggggccatttaatttcggcgatgtcatgattcatcaggtaatccatactattgaattctgtttaaattgtatctctcatacagcatcatatctacgtctttgggcactatcgttggcgcatgcgcaattatctagtgttttatgggatatgacaatttcaaacgctttcagttctaaaaactcagggtcgcctttggctgtcatgaaggtggttttcttatttgctatgtggtttgttttaaccgtttgtatcctagttttcatggaaggtacttccgcaatgttgcatgcgctacgtttgcattgggtggaggcaatgtccaaattttttgaaggtgaaggatatgcgtacgagccattttcatttcgtgcaataatagaataataaccttaaattactgtaaattttctcatctacccactgcttttttcgttttatttttttttacacatacagacatataaacgttgtagaattaaacgataaaatataatatttcttcacatagtttacggtatatatatgtctgggtcggtcaagtggtctaccaataggtcataaatttgagcagggatcttagcgatgaacccgacgcccagccgaatgatctcgtcagcatcaaaatccggaaactgtcgtagtaaattaacaggggaatccgatttgaaaaccttggatctcattttaactaggaatgccaccacaaagagaatattcatatggaatccatatgcaaacatgaaatcccacagtttaatgacctgatcaagcggtttattgcagctggataacgtgagtatggaaggcataccataaatctctgctgtaagtaaattgtccgatagaaatttactcagctttggatcaatgattctgagagaaatatctagtagtttggcgccgttctgggcgccgtttaggttcttagttagatacgtcggtatcatttcataacaaagcttagtgaaaagttgatacgccataggttcagaaggacatgagtaaagcagaggagctaataacacgttcatgccctgcacatatgtgctcacaggaatgcgaccaaaacgagtcttttgtcttctttgttgtgtttgccaagcaaagcacgacagacaccggatgagggcatcctctgagactctatttctaaagtttggatccgtctgaaaagttctggatgtgtcgttcttgattttttggtaaatggttgtggaaggtgggcccagtttcaagagcgcaaggtaccgttgtgtagacgcctccatagaagtttgagagagcaccgtccacacgtaacatcgcgtgcgctgctgctgtttatcttcagatatgggaagcccttcactgagtatgaggtagcgaagttgagagagtgaggaatgcagtagcaggggaggatttgatatcagatcttcaattgaggtcatgcaaaagttaacaagtttaaaagtctgttgtttcttttacctttacgtcgttactattattactattattatcatttttttttttttttttttcaatgtttagcttggcgtacgtaaacggttcccttccgcacggcgtttactgaattgtcaggacataaattcaaagaagaaagaagacctccagtgtcattatagcataagacaggtatgtagcaagaatgaatatgtaaataaatagcaagaatatgtagaatttttagattttattcgtttgttgttttctttttttttcacttgaattttttgccaaacattatgagttgcaactgatcgtacaatgagatgacaccagctgcagcgactcctctaaatatgttggcaccacagcccttgaacaaggaatacgcgccctctttctgaacaatctttctcaaacagtccagagcaccgtcgtacttgatggtctggcccgaagtcatcatcatccttcttcttaccgtatccaagggatacgacgcagtggaagcacccatggtaatgacccaacctaataggaaagaggcaacaaaggacccctctagagcccccgtcaacagcacaggcttgaaagaatcgtacaagccaaagtacagacctctgtagacaatgatacccagaactgagggcacaaacccacggtacagacccaacaacccgtccgttttcagtgtcttcttatacacgtctagcaatccattaaactgtctttgcgaggttgacttagaacccctagcatccgctgcaagccgcgtccttgcgtagtccaaggaatatacaaatagaagcgacaaaccaccagccgctccaccagagaaaagatttccagcaaaccacttggcatacccatcgcgctctctgtcgtaactcaacaacgacttaattttgtctttgaaggcaaaattcagcgcctgcgtggggaaataccggagaacattggcggtgttacccctccagaacgacacaataccttcatgagtcgcagtcctcttgaagcaatctaaaattcccttgtaccgtgtatccaacgagccctgtttaagcatctcttcttgattctgcatcaacagtttcacccgttcaatgggagcggcacccgtcttcgcaatggcagcagaaacgccgcccataaggaagtccacaccgaagtgtgactgctgagtctgtgtttctgtgtgagacattactgctgtaaaaaggaaaaatagaaaagaataacagatacgagaatctgtgctgccttctttgcgataatgccttggcttgcctatttcacggttacaggaataataacatgttcataccgtttcaggaccaataaatggtcttctgcgagagaaaaaggacactctccgtccgacagaaataagctttactttccgggtgcgaatcagcccgttgcgcctggggtggtccctacagtacgctgagtcgccgataaagaccctccgcctagagctaggcgaggctgacttaggcaggcccaacaggcaaggcccatcttcaaaagtgcacccatttgcaggtgctcttattctcgccaattgcgacagaaaatgaaggatgcactcaaacagtcgatccttcgagggagtatgccaaggcctcgtgcatgtagtgcgattatatatatatatatatatatatatatatgtatgtaagcaggccatgccctatagctcttgttctataagcgatggataggcataggaaacgaagaggaccccagtgtaaggaagagtagcaaaaaattagaactagatgactaacgctttgctctctatagccgttttgcttttctcgatgctctcgctagcacaagcggagacgcacacgtttaattggaccactggctgggactacaggaacgttgatgggctaaagagccgtcccgtgatcacctgtaatggccagttcccatggccagatataacggtcaacaaaggtgaccgtgtgcagatttacttgaccaacggaatgaacaacaccaatacttctatgcatttccacggtctcttccaaaacggaaccgcctctatggacggtgtgcccttcttgacgcaatgtccaattgcgccaggcagtactatgctttacaatttcacggtggactacaatgtaggcacctactggtaccattcacacacggacggtcaatatgaagacgggatgaaaggtcttttcatcatcaaggatgatagcttcccctacgattacgatgaggaactttctttatcgcttagtgagtggtaccacgacttggtcacggacttgacgaagtcgttcatgagtgtttataatccgacaggtgctgagcccatcccacagaacttgattgttaacaacacgatgaatctgacatgggaagtccagcccgatacgacgtatcttttgagaattgtcaacgtgggtgggttcgtttcgcagtacttttggatcgaggaccacgaaatgaccgtggtcgaaatcgacggtatcactaccgagaagaacgtaacggatatgctttacatcactgtcgctcagagatatacagtcctggttcacactaaaaacgacacggacaaaaatttcgccatcatgcagaaatttgatgacaccatgttggatgtcattccaagtgatttacagctgaatgcaacctcttatatggtctacaacaaaaccgctgcgctgcccacacaaaattacgtggattcaattgataacttcttggacgatttctacttgcaaccgtacgagaaagaagccatctatggcgagccagatcatgtgattaccgttgacgttgttatggataacttgaaaaacggtgtgaattacgccttcttcaataatatcacctatactgcaccaaaagttcctactttgatgaccgttttgtcttcaggtgatcaagcaaacaactccgaaatctacggttcaaacacgcacactttcatcctagagaaggatgaaatcgtggagattgtgctaaataaccaggacacaggtacccatcctttccatttacatggtcacgctttccaaaccatccagagagatcgtacatatgatgatgccctaggtgaagttcctcacagtttcgatccggacaaccaccctgccttcccagaatacccaatgagaagagatactttatacgttagaccacaatccaatttcgtcatcaggtttaaagccgataacccaggtgtttggttcttccattgtcatatcgaatggcatttgttgcaaggtttgggtcttgttctcgtggaggatccttttggtatccaagatgctcattctcaacaactcagtgaaaaccacttagaagtttgccagagttgctctgtggccactgaaggtaacgccgctgccaatacactggatttaactgatttaactggtgaaaatgttcagcatgccttcattcctaccggttttaccaaaaaaggtattattgccatgacattctcctgctttgccggtattcttggtattatcacaattgcaatttatggtatgatggatatggaagatgcgaccgaaaaggttattcgagacttgcacgtggaccctgaagtcttgctaaatgaggttgatgaaaatgaagagcgtcaggtaaacgaagatcgtcattccactgaaaagcatcaatttttaactaaagccaaacggttcttctaataaaggaagatcatgtattttgcggttaacctgttttttttttttcggtcaagggttccaaatgcatttgcatgtaaagtgaatgcccttgtcttacttaatattacatagacatatacttaataatctaccacgtttcaaattcaataatgcatgcttcttggcggtttttgacatgagatcctcatctgtcacgaggctgatgtgcatacttttacttttaatcgatgacatgatcagtttcttttgaacaaaaagccgttatgggttgaaaaaaagtgaaaatgaaaaagtcatcagaaatatatgaaagatataataaattgtcgaagagaaattacgtcgaggaggttgaggaaaataagaatggcaacgacagatatcatatctctagtaaaaaataatttactctatttccaaatgtggacggaagtggaaattttacaagacgatttatcatggaagggaaatagcctgagattactgagaggtcgtccgcctcacaagctgagcaacgatgtagacacagagcatgaaaatagcttgtcatcgccacgcccgctagagttcatattacccatcaatatgtcacagtacaaagagaattttctcactttggaatgcttgagccagacatttactcacttatgtagtccatctactgaaagaatactgctggccataattaacgatgatggtacaattgtttattacttcgtttataaaggagtacgaaaaccgaaaagaaattgaaaaatgaacttaaagacacctttctgcattattttgtttatttttattatatgtatttacaggctaaattatataatgacatcacaacgtttccttgctctctaaattgaggatctctttgctccaagttattacttggtctatggacgaagtcatcaattttgttcgacatactattcaataattcacttccaaaggtttgttccagttttgaacggatgcggttaccatcaggtaggcctaactgaacgtaaagatttgcaaggaaaagaaggtcggaggaaagtattacagaatcatccagttttttacgggcagccaaccaattgctgacgcaactctgtagtctattatcaaattgaagattatatttcacctgttgtagctcttgcttacccttaattttgttcttatgcgcaattttgaaggtctttgattgtgctagttgcgaggctgactccattgctttactttctacaaattcttcatcatcctcaagggtcagtgagcctataatctcctcacaattttcacgtgcttgcgatcttagttgcaatggcgtattataccacataggaaaatatagcaattttgaaaacaacttcttggtatattcattgtaatttttggtgttcaaaaagagctggtagtccgttagtctggaaatttcaacgtcaacataattcaatagggaatactctaaaaggcgatccttttttctaacaattgctaaatcttcttcataatccgtacctttctcatatttgctagtacatatatttttatgtaagaattgtacgatgttcacgtaaccagatactttcgttccattatctaaaattaacactggtagttttccatctgatgataggtctgtattgtttgagaatacgatctgcaatcccgcaaccatactctttgcctcttctgaagtacataacttgataaaccatacaagcgcaatgctgtccactgaaatcaacgatgctttgccatcctttccccataaatgcacactacctttaaccattactgactcgataatagccttgctttgcgtttatttgaaaaatacaaattccagcattaaatagtagccattctaaatagcttatttcttattacatttcccacttcgtttaaaatgataacaatcgtgacaaaattgtcggttaccttgtaataattaagaagaaaagtgtagcttgtgtgatgaaagagtattctacaacgaaataaaaggccaaactggagagtcaaacaagagatatgtccagctctacgactcctgatttactatatccctctgcggacaaagtcgcagagcctagtgacaatatacatggagatgaactacgacttagagaaaggattaaagacaatcccacgaatattttatcatacttccagcttattcaatatttggaaactcaagagtcatacgctaaggtgagagaagtatacgagcaatttcataacacattcccgttttattcacctgcgtggactttgcaactaaagggtgaattggcaagagatgaatttgagactgttgagaagattttggctcaatgtctttctggcaagttggaaaataatgacctatctctttggtcaacatatttggactacatacgcagaaaaaacaacttaattactggtggacaagaggcgagagctgttattgtcaaggcattccaactagttatgcaaaagtgtgcaatttttgaacccaaatcatcttctttttggaacgaatatctcaattttttagagcagtggaagccattcaacaaatgggaggagcaacagcgaattgacatgctcagagaattctacaagaaaatgctatgtgttccttttgataatctagaaaaaatgtggaatagatacactcaatgggaacaagaaataaattccctaacagccagaaaatttattggcgagttatcagccgaatacatgaaagcccgttccttataccaggaatggttgaacgttactaatggattgaaaagggcatctccaattaatctgcgcacagcaaacaagaaaaacataccacaaccaggtacctcagactcaaacattcagcagttacagatttggttgaattggataaaatgggaaagggagaataagttgatgcttagtgaagatatgctatcacaaagaatcagttacgtttataaacaaggtattcaatacatgatattttctgctgaaatgtggtacgattattcaatgtatatatctgaaaattcggatcgacaaaatatcttatatactgcgttattagctaatcccgactcaccttctcttacattcaagttatccgaatgctacgaactggataatgattctgaaagtgtttctaactgttttgacaagtgcactcaaactttactatcgcagtataaaaagatcgcctccgatgtaaattcgggtgaagataataacacagagtatgaacaagagctgctatacaaacagagggaaaaattaacattcgtgttttgcgtgtatatgaatacgatgaaaagaatatcaggactatccgcagcacgtactgtatttggtaaatgtcgtaaactgaagcgtatattaacacatgacgtctacgtggaaaatgcatatttagaatttcaaaatcaaaacgattataagactgcttttaaggttttagaattgggtttaaaatacttccaaaacgatggagtttatatcaacaaatacttagattttttaatatttttaaataaggattcgcagatcaaaaccttatttgaaacatcagtggaaaaagtgcaagatttaacccagctgaaggaaatatacaagaaaatgataagttatgaatcgaaattcggtaacttaaacaacgtttattctctagagaaaagatttttcgaacggttcccccaagaaaatttgattgaagttttcacaagtcgttatcaaattcaaaactccaacttaataaagaaattagagttaacttatatgtataatgaggaagaagacagttacttttcttctggaaacggggatggccatcatggctcttacaatatgagttcgtcagatagaaagagactaatggaggaaactggaaacaatggaaacttctccaataagaaattcaaaagagactcagagcttccaacagaggttcttgatttattgagcgttataccaaaacgtcaatattttaatacaaatttactcgatgcgcagaaattggtgaattttttaaatgatcaagtagagattccaacagttgagagcaccaagtcaggttaacattacgttaataaataggtatatatgaatatttataccaacacatctattataataggcgaacctctgtatgtaattaagtaaaaaaaaaacgatgtgacaggatagttaaggtgcctcgtacataaataaaaacggaaatagttaattctttcaaaaatatggcaatagccaaactcattcagaaggtacaggaaacactctgtttctgtgcgtttatataaccatgcttataaaagaaagattgaacaaaatatacatgaatttatgaacggtaatcaccgttaattgttacatattcatgtgataaatcacaagtccaaaattgtgctgcctgatcaccggttcccaagtcgacagacacttccaaatcattcaaagccaatatttcagaagcccttgtttcatcgatctccaattgtggcacaccattagcgacaagcttcagctcacgaggttctgaattgtcggtagcaataaagctaacattaattttgttgacatctagagattttaagtcattcagctttgcatacccgatcgcgcacaatattcttccccaattggcatcttgcccatatagtgcggttttgaccaacatagagtttgagattgattcagcaattattttggcgtcttcaaaatgcaaagcatttttaacgttaacagtaacaaactttgtcgaaccttcaccatcgcgaacgactaactgggccaagcgctgagcaaattctgtgacctgcaattttacttgttcaaaatctttagagtcttcgttaatttctttggtgtcaatagcaccgttggccaacatgcaaattgtgtcattggtgctcatatcaccgtccaccgatatacaattaaatgaacgggtagtagcgaaagtcagcatcttctgcaacgccttgctttcaataggaagatctgtaactatgaaacctaataaggtagccatattcggacaaatcatacccgcgccctttgccatacctgtcaaagtatactcagtaccactaggtaatttgaatctagatgtaactaattttgggaaagtatcagtagtacagattgatttggctacgttcaaccaagagttaaaatcactgccgaacttttcttctccaaaaattttattgataccagtgctgatcttgtccatctgtagtcgttgtccaataacgcctgtagacatgactagggtagaatttttttgaccaattttatcgttaaccaaatcaatcattacttgggcatctttcataccaagatcacctgtgaccgagttagcacaaccggaattgactacaatagcgttgatgtttttaccacgagcagtttcaaggacttttttcgatgtcaaaactggcgcagctttgaatttattggtcgtgaaaacagctgctgcggttgaaggacgagatttattggtattcaagattacacccaggtccaggctcccgttttttttgactccagatgcagtgtagcctacttcaaatcctttaggaaaagagcccgtcttgggcacgtataatgcatacttatctataagctgcttcgagcgttgaagcaatgttgatgatattctcatgctatgttgaattttggacttctttaaataaagggaatagaagtattgctgatactagcccaaaaatcgtcacctttgtgcggcgagccgaggatgaggcttttatatactcgacgactaaagaagttggcaacgaattacgcagtgagtcatcctacctgtccatcgcagtagaaaaagaccttcgccaagaaaacaccgtcaataatgattgctaagcactctcacttagtactactatcaacgctaccttcaatttgggtctaaccacggccctattgcatcactactctctttattctatgatacagcgtgggggtgaagccaagagccctgtgttttacttcagcataccaacaaagtataagattacttttgctatacagcgatgaaaaatgtattttaatgtttgtaaatttatgatctactgacacgtctcagacagatcacatttacaacacagcatgctatgactatatacaaaacatgacttttctttatcactaaaagtaactgccaatttattgtcgaatctcgctatagtttgattttcaccagcggcgcgcgcaagtataagctaagaaacaatgaatatagatagatagtgatgagcgttgagaaccgggaaatgagtagagacgtccttctaaacaaagatttatacggttgagacagattcattgaggaaaagaggagaatggttagcatgatccatattgtggtgtttttgctagcaatcacaaccatgttcgaaatacttccgctaataaccgtccccgtgaccaagtacctatcgttatcgtcattcagaaaccactattatggcctgtttggctggtgtgtacgtggtcaaaaccaagaattgatgtgcacgaaaatgaagataggatatgacagtacagatgtcgactcctccgggcacgttttgaccctgccatcgaactcaaaagtggtcgtctccaatttattagtggttcacccgatttcactggcattcacaggaacgctattaattttagcagtgattatcatggtaactccactaggggactcacctgagatgttattgttcacggcccttttttcgctgccaacgttcatgctatgtcttttatgttttttggtagatattcttctgttcatctccaaactggactggcccggctggctaatgctagccgctactattagcgtagcactttgttgttccatgctgtgggtcatgagaagagttgtgtcagtcaaaaaatatgaatcgcaacagtcaattgcgcatgcgtgctcaatggaacagtactcaatttccgacatttaccagagtaaacagaacggcaatagctcagaatatgaagtggctccaacacatacagatagtctgattgctccagaagtgacatatagagggttcattgaataagtaacatcatgtgtcattttgcacgttacatcggtttgccaatcggcttccaaatatttgtacatttttttcttcctccatcactatctgttaagggtcttagaaaatgattactacagtgcaagaaatcagcaaatggagaaacctgtgcttcattaggatgcaatctcgcaaatggtacccagtacttaaaaagactcctttagtagcggacggtcgaaagatcattaaacatgccgataaagttcctcatccggaagaaataattcacccattttaccaaccaacagcaatagaacaattcacggcatgcgctacggaatacaatcctagcctgcttgatggcaaaaaaattgctccatcactgataaaacacccggtgagcctaaaaaccatactagttgatagcaaattaaagtttgatgatattaggggagtgaataaatggttgatggaattcgttgcaagacgacaacatcaaagaaatattgtacttacacctgcgagcaaaagcgttagatcttttcacgttctgcatttgtcttcaaccgatattgccaaattaagaggtcttgaaaatatattatcagagattgaaaacacgaatgatttgcaatccagggtcgagtccgtaaataatgaactacagaatatttttgaccgcgacagtaaacagacaagattattttgcgagaatatactggcttatttgataaagaattatggaaactcgactgaaaaacttatactactaataaatgttactgagatgcaattatattcacgtttagaccaaatgaaggccatgaacattattttatataatatcctttgtaaagtggaagcaaatgaaaacccaccgtacagtcccacattggttaccgcactagaaaacctattggcagcgatcaacaacagattttttccagggcgttgcgaaaattcattgcacccaatagtaattgaacaactattatcatatttcattaaaaccggcaatttgaatgaaagcaaaaattttttgggccatttaataaaaaagggtattttaccagaggctactatcattaatagatatttggaggcaattgatgttcatttcgataaaagcactaagatttttgatataagatccaaatttgcattcatagcagatcttgcacccataatagaaaattatggaacaatagacctgttcaaatttttgatacctatgtgccggcatttcgacgaattgtgttctctgctaaatattattcgaaaatccaataacgcaaaacgggctgtggatagcaccttacctatttttatcaaaaaagtattaacatttactaaagatccaatgatcaactccggaaatctatccactgttttcaatatagtgagcccaatatatggacaaaacgtgcccagcgaattcgtggagaaatttatactgtcttttgcacttcaaggaaattacactatgatggctcatatgatagatacatataagatcaaactaagtcataaataccaactacaaattattagggctctcaaaaatagtgagagaaatcacgcgcttaagaatacgggcgctgtaggttataataaggaatttaaaaagtacttcatcgagaaatatttgaattgcactgaacgagaagctttacgcccataaatcgtctatattaaaaaaaaggcagcataagagcaactcactgcaaagggaattgcgcattccacgcaaataaacaatgtaaataagaatacgtactgtaactgtgtcacactagcgggttgttttatcataattgtttgggattaatcctgaacaaattttctatatataaacactggttcggaataccaatgaagtatacatattctggttcaacaactgtttctattcaaaaactttgaatgtttgaaatgcgctacgtctatttgtttgcaatttgtattaagtttgtttcaagctccgaactaggaaaaatcaacaatctgctgcaaggaagattgatatacacagataattccgttgcgacaaatgtattagaatccaaatttccattcttgaaatcaacatgtgttaaagacgcactaaaattatttttgccacaatgtattgcaaatggacttgaatccattgacgctgaaacaagggtagaaacggccattaaactttcaatatgcgagtttcaggcatctggcttgggcgaaataccagaaaattgcatggttgacgacctaggatcaatgatggattgtatgtttgaactagaatcatcttcacagtggtggacaacttatagtggaaattatcagcgactatcgagtatttgttatgaaaatcttcttccttttgaaaaagaacagatactgaaactttttctaaatatcactgaactttatgattcatttggggatgatgtcgatactaagttaaatcatctgatgtttcaaatggagcaagattctcaaaattttttggacgatctggccaggatgttccgcaactatgacaatgaactgcgaaatgcgaccgaaagcaatcgaataatcttagaaaacgacctctcattttttagaaataaagtgaatgatgtactctatgaaacttccgaacaactagaggtccaaatcatagagaagaacagtcaactaatgaatgaagttgataccgtccatcatattatgagcgatctagccgatgagcttgctaaaaatgacataaaatctaagataaatgacttgaaggacgacagcctgaataatttacaggacctagtggaaatgtccaacgacgtaaaagaatattactctagaaataacaagttagttaataccgagttggaaaacttctcgatgggtttaaaaaaacagttaggaggcatgtcaaaggatctttctgaatcacaaatggaagctatagagctcttgcaagggttcaattccatccttcatgattcattgttaccatccatgacggatgagatagtacctgagatgacgaacttcaaaaataccttactacaagaatggacagctataacatctacactaaatggagattttgctttatggaatgaggagattttttcaacttttaatgatatttcagagaaactgaatggcacaaaaaaaaaattagacgacattgaaatcagagtctcacttgtccataaaaatgtcatgacaatgatgagggtattggattttatgtggaaaactagtaaaatgattataagatgtgggtaccttgcagtcaagaataaatactactggttactgtgctccgttgtgtggatttggtcaaaataccgtacgtctcgagtaaacgtcaaaatgattcctattaaacgctattaccaatgggcagctcttctactttcaatttatctaggagctaagactggctcattgattgatttttaacattaccgatgtaacaatatatgaaagcctatatatacatagatgtataggtatatagccgcattcaaagtctagcaaaataaatattctttaaaaattcaaggacaccggatcatggtggccataatacgggcaagtgaacctagagaaggtgtcctacgtcactatccaagttaatttgcttaagagagttcgagtgcagcacctacagctttatcattgaagacgaagcaaaaagatcttgagattctatatcatgggcacaggtagtattcattaggtagtagtaacgtattaaacaaggccatactatatttataactcatgttcaaatacaaccgctcactctgtagcagcgctttgatagcaaagtctcagattcgtttttatagattgaagcgggcgccattgaattatgcctcccatatacctgaagttcttaataagaccatcatagggccagacgaaccagaaaaatgtctcattttgaaaggaaaaacatcagaggaaatcgaaaataatcttctcagtaataagaaatttcaggagatcaatcctcttgatactatccaggaaacgttcattcaatatctgaaattttgtaatgaaactaactttaaaagaagtaacaagaatttaaacagattaaaaaaaaccttagaaagcaaggactctaatagcaccgtaaaaattaatgcagttttcaattatttgctcgaagagtgtgatttagaaatcaaaagattgaacacgaccggccaaacccaggtatacaatgaagagaaaggaaatgaagatgacttagagcaatccataatgaacgatattttccgatcagcacaagaacaatttgaagatcaagagggccatataccgttaaggagtacatcatttttactggagattttgaaaagttttaatgaacggtttaatggcataatcaaaccgaaagagtcaataacagaaatggtcacattcagccaacttgctcaagcttttgaagttgttaaattgataccagtgcaagaaatgaaggagaaagggatttacttggtcggaaatttactttatggcacagggaaagttcgtttagatcctataaatgagtcattctatattgaatccctactagtttttggaaactataaggctgcatacagtttatttattaccaataaagacaaagtaaacgagcgctggtggaatgaactaggattaatgatcacattaaggtctaaccacttgagaaacttcaggaaacttttagccgagacagatgcaaagtactcaacaaagtattcttatttgagcccaagagttaccaaattgagcatacgaaaatatttgtcgattggcaatgttactgaagctaatatactgactgatcgatttattaagttagtggaagaagttggaataatcagaatgaaagatgagcaggaggaacttcccacgggagttaaaaattttcagaatgagaaacatgcaactgagttcttaaatgaactagaaataccatcggatcatgattatatcagcattgttgatttccatctttataagagaaatattcccatggcggctcaacttatcagcaagtacatggaaatacctggaacgacacaagaagatgccgcatttctacttgttaaaaccaagctaaatatgttgaaagattttgaaaagctacgaaacatttttgctcaaaataaagattatgtagtgcctgagaataatgtgaaaatgttgcaagaggcatttgagagcgttattactaagtataacactaattctccaatatacaatgaattgctgtttgagaatgtttcggccttaacaaaaagtattgtattaactgattttctggaagagttcattactaaacaggcttctggacagtggatggaattaaacagtgtgtcacgttccagaaagtttaatggcttgttgaacatacttctcggtacaggtgaagaagaaaaagcatataatatcttaaaaaaactagaagaagcctcaaagaaatcaaaaacagatccagatttactctataatcagttttattcggaagttaatgcatatcattacgctaaatttgttgaattttatagtcttcaaattcaaaatatgaaggcacaaaatacgccctcatttagaaaaaaggaatttaagcagaaagtgaagtcacttttaaaaagaatgcaggagtcagaggttatcccaaatgctgtttttttgagagaaatactcaatttttatgatagcatgtatgactttaattcaagttttgagatcatcaatccgctacttgaatccaaacaacaggtgagctctgagtcttcattatccacctcaaacccttgccgattttacaaccgtcgcatcataacaaaaccgctgtaccacaagatttggtctgtgtattgccattattatcatgttttacaaaataattctaggattttatcgaaaaagtcgtccattgtaaagaaattaataaaaaggcagataaagattcacccaacttgtcacccaagagtattgttccaaatgacggcagaaaatggtgaaattttgccagacaaaactttttctaaattaattgtgtccacgttcatgaaaagcggggatttagaagcaatacctgccatattaacgtttctaacgaaaaaatttgacttgaatattgattacgatttgagtatgtatattctaaagggtttgaaaagacaatatttacgagatattagtaacatcagtaaagatgcttgtgagtacaagttacggaaggcggagctaatgaataatgagtcaatcttaaaaaacattccacagggtacaaatcaagagaatacaatatcccatttgatcagggagattttgatctttataaaatggaaggaaaaaagtgattgttctactttcttgatggtagaagatgcttttaaagaattaggaacagagtttactttactcgaagaattaatagaagatgtaaataagttaaagataaaagcctaaaaaaacggatgcattttatataattttagctatacgtgtacatatttgtaataaagttaaaagaggagactgtttagctttgtatttattttttacttaatttcatccatttaggtactctatttaaagtctttttgatacttgtagcgttatcagaagggccctgtggattggatttatttatcgtattaactgatggggttgtcctcgtttcgtgtgtgattttttgtgcgtcttccaaaagatgagcctttattaatgggccattagaatttgaatttgtttcaaaaagcagcattgttttagagccaaattccaggtcatccagtagcttcttatcgtctttagccaagggtttgaaaggatgagattggtttaacgtaaaaggcatgttctcatcgatcaggaactgcgacacgacgttataaactgtacgcatgtcttcattgggtttgaatgctatttgaatatggcttctatcggggaacttgactctcagcaaacactcagatatagccttatttttctttggcaagttgttggctgattgctctctaagtctctttgtcaaaataggaccacccaaagtaccagccttcgatgataacattttttggtatttcttggcttgttctactgtcaattcataatcttcttcatcctcgatttgatccttgataactgctaatggctcatccgagggcaaaaacacagaaggtttatgtagttcgtgaggtggtagtgaagcaaccgtttccgggttcgtcatcgtagggggagtttgttttgggtgaatagcgctattagcgctaatgccctcagaatgagatgtattattaaaaatcaatctaactgacgaaggctcctgaatccctaaattttcgagagtcaaattctcatccttaattgttttgaactctattatcttggaaaagacctggatcttaaaatcatctcccgcagcgccgctcatctgtcgcaagataggggcaattggttggtcagatggcatttctttaaccacggaatctcttcctgggatttgaaaccgtattttgatcgtattgaatggaatatcttcgcggttggtcttattcgccaccggaaaattactacttttagataattctaagttgacacccgttggtaagtttagaagcctccatggcaaatctaatggcaccggtttatccaaatgtatcaatgaccagtcgtttgacgaggtgtgcagttgaaagaattgtatggattggtgtaacacatcgtttagtgttgaattcaacgaaactttacatttgaaaagttggaagttatacttcacggtaaccataggcattgtattgtgcgcttattagtctgccttgctattcttcgcagtacgtagatttatcttagtttttgcattttttggttttcttttttttttgccacacatagtacaataaaagagaacttgaatctttgaagaaacgtctaaattaacatcgaagatagaagacagggaaacatctaggattgcaagaaatagtgctgaaattttgtaataaagttgcaagaaatagcatctagcgttttataaggcgtacatctttcttggcaagagttccaagagaaaagaggagcaaaacagcggttgaggcgcccgctatcttgaatattatacagtttctttaaaaacgcttgtacaacactgcataaacatggacaaattattgaaattgtttcaagatatttcccatatcatattccaatagcgttactctctcatcgcttattctggaatcattattttaataaagataactcacacgatatacgtgtactgagctgacctttatacctacccttacctgcttattcctgataaaaatgttcgtgcaactaattgtttgatttctcttgcggcccggttattccggagttgatactttttttcttctgtcttaattacgtttttttcctctagacttttttgatctggtacaattgaaaatgtataaatcaactggaccctaaaaataaaaaaaaaaaacgcccattagaaaagaggatatattgaacaaaagatgttgaaagagccctcagttcgcttgcgggaggctattattgaaggcaatttacttatagtgaaaagattattgcgacggaatccggatttgctaaccaacatagactcagagaacggatggagttcattacattacgcctcataccatggaagataccttatatgcgtgtatttaattcagctggggcacgacaagcatgaactaataaaaacctttaaaggaaacacctgtgtgcatttagcattaatgaaagggcacgagcaaaccttacatttacttttgcaacaatttccgcgatttatcaaccatcgcggagagaatggtagagcccccatccatatagcatgtatgaacgattactaccaatgtctgagtctgttgataggagttggtgctgatttatgggtaatggacactaatggcgacacgccgctgcatgtatgcctggagtatggcagtataagttgtatgaagatgcttctcaatgaaggtgaggtgtccttggatgataatgtcagggacaagggaaattggaagccaatagatgtagcacaaacgtttgaagtaggtaatatatattcaaaagtgttaaaagaggtgaaaaagaaggggccaccgttgggtgcaggcaaaaaaccaagttcattcagaactcctatactaaatgcgaaggccactttcgaggacgggccttccccagttttaagcatgaattcgccatattcgctctattccaataatagtccgttgccggtattaccaagaaggatatcaacgcatacaacaagcggtaacggtgggaatcggaggagttctatcacaaatccagtattcaacccacgaaaaccaaccttgtctacggacagtttttcgtcaagctcaaattccagctcgagactaagagtgaactccatcaacgtcaagactccagtaggtgtgtcgcccaagaaagagcttgtatctgaatcagtacgacacagtgcaacaccaacaagtccgcacaacaacatcgcgttgattaatagatacttgttgcctaacaagagcaatgacaacgtgagaggagactcacagacagctacaatcaacgatgacggtggcggcggcaatggcggtgatgccactataggaatgggactaagaaaggacccggacgatgagaacgagaacaagtacaagattaaggtaaacaatggcgagccgaggagacgagtgtcacttctgaacatacccatctcaaaattaagaaatagcaataacacgcgtgcagaagattgagaagactactacgtatttttttttatatgcatccttttttccacatatgtatgcgcggtgcgcgcgcgccattaaaagatttttttcttagctctttttcttttttctttttctttccactgagatgcgttcttcggtatatagtgagaacacttacaactgtatacgaacatcgaaggagcacctaacagaaagaaggagggtcgccatggcgccaatgttccaacatttcttaaacttatgcgtggaaaaatttcctgaatccatcgagcacaaggatacagatggaaacggtaacttcaccaccgctattttagaaagggagattatctacatccccgaagatgacactgacagtattgacagcgttgacagcctcaagtgtataaactacaagctgcacaaatctcgcggcgaccaagtgctggacgcctgtgtgcaattgatagacaagcacctgggcgccaagtatcgccgggcctcgcgcattatgtacggcaacaggaaaccatggaaggcaaacaaactcgcagagatgaaaagcgccggccttgtgtatgtctgttactgggacaacggcgtgctaggtgcatttacttcattcatgcttacagaggagacgggtctcgtcgaaggtgacgctttacacgaggttagcgtgcccgtgatatacctttacgaagtacatgtagctagcgcgcaccgcgggcatggaatcggtcggcggctactggagcatgcactgtgcgatggcgtagctcgacacacccgccgcatgtgcgacaatttcttcggtgtagcactcaccgtattcagtgataacactcgggcccggcgactatatgaggcgcttgggttctaccgcgctccgggatcacccgcaccagcatcacccacaattcgtcacacgcgacatggtgggggacgtgtagtcgtgccctgcgatccgctttattacgtatattgccttcacatgccgtgaaagccgacagggacaacgcgcgataaaaaaaaaattaaaagtaaaactacgtacgcggcggcgcgactcgaatccttgactccgactgaggagacccgaacaacgctccctgctctccgccttcggcgccttccgataactgcgcacggcaaggagtagtggcgataacggtgtttattgccggttttttcgtttttcttcttgattttcttcttttttttcctcaaaagatgtgctgtagcctccgctgttgtttttttttatcctaccaaggcgcatcatcctgtcatgatctgcgctggatagtatttatactactactccgtctggatttactaaactttgtctctcttttgatgtaaagttaaagaagaattacgaaaaaagagagaaaaaatagaaacaaataataggaattaaggccttgtagcaatcaaaaaaaaaaagaaaaaaaaggaattttttttggaagaaaacttgaacaaaacaattcctcaagaaggaacaggtacaagaaaagatttaacagaaggaaaactaataggcaacagtaggcaaatagtaaagggacatatcatatttgagcaatgaatgcggaccatcacctgcaacagcagcagcaacagcgacaacagcatcaacaacaacagcatcaacaacaacagcatcagcatcagcatcaacagcagcagcacacgatattacaaaatgtgtcgaacactaacaatatcggcagcgattcgctggcgtcacagcctttcaacacgactactgtttcctctaacaaggacgacgttatggtgaactctggggcaagagaacttccaatgcccttacatcagcagcagtatatatacccttactatcagtatacaagtaataacagtaacaacaataatgtgacggctggtaacaatatgtctgcgtcgccgattgtccataacaacagcaacaacagcaacaacagcaatatttctgcttctgattacactgtcgcaaacaacagtactagcaataataacaataataataataataacaacaataataacaataatattcacccaaaccagtttactgcggccgcaaatatgaactcaaatgctgcagcggctgcttattactccttccccactgcgaatatgccaataccgcaacaggatcaacaatatatgttcaatcctgcttcatacataagccattactattcagcagttaacagcaataacaatggtaataacgccgctaacaatggcagcaacaactcttctcactcagccccagccccggcccccggtccaccccatcaccatcaccatcatagtaatacacacaacaacctcaacaatggtggtgctgtaaatacaaacaacgctcctcagcaccatccaacgataataacggatcaatttcaattccaactacaacaaaacccttctccaaatttgaatctcaatattaacccggcacaacctctgcatctacctcctggttggaaaataaacactatgccgcaaccacgtcctacgacagcacctaaccatccccctgcgccggtgccttcttcgaaccctgtggcctcgaacttggttcctgccccatcatcagaccataaatatatccatcaatgccaattttgtgagaagtctttcaaaagaaaatcatggttgaaaaggcacctattgtcacactcgcaacaaagacattttctatgcccttggtgcttaagcaggcagaagagaaaagataatcttttacagcatatgaaactcaagcatacaaattatttattagacgaactcaagaaaaacaacatcatctttaactacaacaattcttcctcctctaataataacaacgacaataataataataataacagcaatagcgctagcggcagtggcggtgccggtgccgcggcggcagcagcaacagctcccgaaaatgaagatggaaacggttacgatacaaacatcaagactttaatcaatgatggtgtactgaataaggacgacgttaaacgtgttttgaataaccttattgttagtcacaacaaatagatagactttatagacacacaaaatatcccttcccactcatttaacaatcaagataatagtaataatcacaaatttagaaagtaattatgcatatatacattatatacatatagtttatgtatggtacggaactgattacaacatctctctaacaacggcctcgtgagggaaatcgtcatctgtaggatttttgataatgttcgtattctggaactcttggtgtttagtatatgctaccgcataactgattgacgatatcgttagcccgacagctaccacaattagactcgtagccatcactgcaatggaaatatactggattatcgccattgctagatagaaaagacatctccatccatttgtttcaaatctcttgatgaattcaatgaaattatcgctaaggggacagattttcaacaaaaatggtatttcaatgaataggatcactaacccttggattatactaatgataccaaaagctatcaccccactaacgtggaacagattcgctatcccgagtgcaatacacaagattatgttgatatatccaaaccatctaccatatacgctaaagttgaaacttttcaaatccttcaccataccacccacattgatgaactgtcctaaacttaaagccattattgaaaactagtatattttagttgttattgctcttctcctggtgacctacaatcccacttcactagtaggggaattctggatctttacttcgctgatatagcaccttttttcttttttttttttcttttgccttttttacgagccacagactttcctcctttaccctactattcgtagccgtctttttttgttgttttttttttttgtgaaacaacgtagcaagaaagggatcctcatccaaactaggataaacaagtaaacagattaacaaagaagccaatcaattacaacaacaaataaatgaacagttacagcctattaactagatctttccacgaatcttctaagccccttttcaatttggctagcaccttgttgaaggcttccaagagaacgcagcttagaaatgaattgataaaacagggtcctaaaaggcccacatctgcttatttcttatatttgcaagaccacagaagtcaattcgttaaggaaaatccaaccttacgtcctgctgaaatcagcaagattgccggtgaaaagtggcaaaatttagaggctgatataaaggaaaaatacatttctgaaagaaaaaagttgtattctgaataccaaaaggcgaagaaggagtttgacgaaaaacttcctccaaagaaaccagcaggacccttcattaagtatgccaatgaagttcgttcgcaagtttttgcacaacatcctgacaagtctcaattggatctaatgaaaattatcggagataaatggcaatccttggatcaaagcattaaggacaaatacatacaagagtacaaaaaagctatccaagaatataatgctcgctaccctctcaactagaccgcggtactctcacaatgttttttatgcctttattctttccgttcctatccaaacaaataaataaatttaacttaaccaagcaagtgtgtagtgtttttatatcctatgtaagtcttcaaactttttttttatctctggtaacctttattcgcatacaacgccaatgaaacaaacctgtaataatttttcatagttaacccattgatgatacttattaaaatatgtaatcaaatcgtcactattacggtgctttattaagatgtccgtaccacctggatggaacttcaaataactagaaatgtcatagactttgccgtttataacgcaccataactcgtcctcacctttacaatgcttctttacgatttttctgtttattcttaagggtggcattattttataaaggggtatcttttggacaagcaattggttcttcagttgtgaaggtgaaaacttgaagttatctttttgaaataccggatcatcgagtaaatcctggataagctgtagcgaaacgaattttgtataataattcgctggattggaggttagagagtgccagtccagagcactgtgcccaggatctagtcttattttggttcttacaagaggctttcttgacgacttcgacatgggcatatgcagcggggatgatatggcaggatgagcaacgcttagtcgctgaggagcagcgaatctgacatttggtttcgagtttgaaacatctctgttcatgccgtcactactcatatctctatgagtgtaatctaagcacctgctaatatgttatattctgcttattcgtccttttgctacacataattaatgtaactttaactctagttctataaaggatatgatttgtactaaatgtaacattatacgaaaaaacatattattcgtttatataaactaatcaaagaagtcgtcatcatcttcgtcgtcatcatttttagcattctgcttgtcaaatgaattcagatcttcgctgaaatctttccgttcgaagataatcttactgttattttgtgaattttgttgcttggcgataccattcaagattgaaacaatttcagcttcagtgattttatgagtgacgttgtttgtagcaatcagtttctttaagtatgtctctactgcttgggccctgtctctacggaccaaggccactcgagataatctttctaaagcttgtggctccaagaaatttgcaatagctgcaccaacgggagcggaattttcacctccaccattattagcaccgctatttctatcgccgttggtacccccactgttgtttttcaactgagccaatctggcttccctaatagcttgtaactctgggtccatatctgagcacacacttcctcctgaattgtaatccagagagcaagaagatttttcaacttttactcttggttctccttgtagaaccacaagtggtataaaaattctcgcttacccagcccaaaaattctcatctgtttctcatctgtttctcgtccgaataagtttcccgttcgcagctaggatttcacctgctcaccataataggcaactttcttcctcatgtaggaaattatactattgctctctgttgcaaggttatttttgagccttaataccatattagtagatataaatacatatatatcgtgttaacccataagtggtagttttagtagctcgctgcaagatctgcctcattcctttgtagagaacgacgtacccactacgcgtttgaacatttgcaacaagcacgagaggaaggaagaagaataccaagtataaacgagaataatcaccatagaaaaacctataaaagacacttccattaccatctgctaataataatacaatggacaccagcaagaaagatactactaggtcgccctcacattccaacagttcttctccttcatcttcttctctctcttcatcttcttccaaagagaaaaaacgtcctaagagactatcctcccagaatgtaaattacgatttgaaaaggagaaagatcatcacttctgaaggtatagaaagatcattcaagaacgagcatagcaatcttgcagttgaagacaatatcccggaagaagaacccaaggaacttcttgaaaaggactccaagggtaatatcatcaaacttaatgagccatccaccatctcggaagattcgaaggtatctgtcactggattgccgttaaataaaggtccttctgagaaaatcaagcgagagtctctttggaattatagaaaaaatttgggaggccaatcgaacaactcagaaatgacgctggtccccagtaaaagatttactcaggtgccgaaaaattttcaggatttgaacagaaatgatttgaaaacgtttttaactgagaacatgactgaagagagcaatatacggtcaactattggttggaatggcgatataataaacagaactcgtgaccgtgaacctgaaagcgaccgcgataataaaaagctatcaaatattagaaccaaaataatactttcaacgaatgctacctatgattcaaaaagtaaactatttggccaaaattccatcaagtcaacatcgaatgcgagtgaaaaaattttcagggacaagaacaattcaaccatagattttgagaatgaagatttttgttcggcttgtaatcagtcaggttcttttttatgctgtgatacatgccccaaatcctttcactttctttgcttagacccaccaattgatccgaacaacctgcctaaaggtgattggcattgtaatgaatgtaagtttaaaatcttcataaataactcaatggcaactttaaaaaaaattgaatccaacttcattaagcaaaataacaacgtcaagatttttgctaaattacttttcaatatcgattcccacaacccaaaacagttccagctaccaaattatataaaagaaacctttcctgctgtgaaaacgggttcgagaggacaatactctgatgagaatgataagattccattaactgatagacaattgtttaacacttcttatggccaaagcataactaaattggactcttacaacccggatacacatatagattcaaattcaggtaagtttttaatttgttacaaatgcaatcaaaccagactaggttcatggtctcatccagaaaattcaagattaataatgacttgtgattattgtcagactccatggcatttggattgtgtaccgagggcttctttcaagaacttaggttcaaaatggaaatgtcctctacattccccaactaaagtttacaaaaagatacaccattgtcaagaagataatagcgtaaattataaggtgtggaaaaaacaacgattgataaacaagaaaaaccaactttattatgaacctttacaaaaaataggctaccaaaataacgggaacattcaaatcataccaacaactagtcatacagattatgatttcaatcaagatttcaaaattacacaaatagatgaaaattccattaaatatgatttttttgataaaatttacaaatcaaaaatggttcaaaaaagaaaactctttcaatttcaagaaagtttaatagataagttagtatcaaatggatcccaaaatggcaatagcgaggataatatggtcaaagacatagcctctttaatatatttccaagttagcaacaacgacaagagtagtaacaataaatcggcttccaaaagcaataacttaagaaaattatgggatttgaaagaactgactaacgtagtcgtgccgaacgaactagattctatacaattcaatgacttttccagcgatgaaataaagcatctgttatatttaaagaagattatcgaatccaaaccaaaggaagaactgttaaaatttttaaacatagaaaatcccgaaaaccaatccgaatagaaacggcgtacatacataaagaataaatcaggaacgtgaacaccttccttacatatatacacacatacataggcatatgtatcgcatcttaaagtgagagatctacctattttccttttttttccatttacaacatagcaattgatgtttttttcccttctaagtcatctcgatgtcatcatcttcatcgtctttgtagtcaacttctttcctgaccctcaatttcttcatcacaatattttcgtgccctttcttggtttcatttttgttagacggtgaataactgtcatcatcactgtctgattctcgatccccatcaccttcttcgtcgtcagcctgtgatctcgcatgatgaactttcttcttttttttttgtgattcattgttttcgtgagctaataacctcttttgaagcctttgtctttgagtttgtgacgtgtgaagaatccgtccgattttagcttttatattgttttgtattttttcagtcaagctctctggtatgtatgttttgaaagataactgggcctcctgaaccgttgcaaaaggtttgaacaaatctgatggtaagtttaatttacctggatatgctgaatgttgccaatttttcttctcttttaaattcaatagaatcatttgcgacagctcacctatgatatacattttctgaccgtaaggtctatgcttctttggcgcttcttctttttgtggtccttcttcttcatcaatttcatcctcaactaacttatcttgatagttttttaccctttctgataaataatagagcaaactgaagttctcttgggcggcaatagagtcaaagtaaaacagcaaataatcaatcgctgttgttaaagcatttagatatgcgtctccttcggaatctaaacctcccacaatatcagggtgatgtgcaatcgcatgtatcaacctaggcaaagctctttcaaatatcgtcccttttttaaatgattttaagccaaatgtaaagtttatccatatcttcgttgtggttttcagttcgacatctggttcataagcagtaaaaaatactagtggtaggaactttatggaaatcagttcattagcaacataatctttcagttgttccaaaaatgtttttcttactggcagcgattcatcttcaaccaaattaattaatttaataatgtccgaaggtttgataaagttgttcaaattagaaatcctggccagttttaaaacttgaattcctgccacacacctcaattttgtttgataattactgggggtgggataaaactccttgttaaactcggaaatcagctcaccaccacttgcaatcaagtaaaagaataacttcatagttttttcggtgaaactttctgccaattcatctcgtggaacatccggagcaattgatctcaatttgttggtgaacagctttaaagtaaacaccttattacctattgcagaatatttcgtgtcacttaatagagaatcttctacccagtcaatttctttttttgaatcaccaacgacctggtttgataatagaacttctttaattaggtatgatatgatatcagtggaatcatcatttaggacgtgagggaattttttaaatatttccatgagtacaataatatgagatgtaaaatacttgtctttttgcaaatctaaaggtaggatacgtatttttatctttttcagagtttcttcagctttgggcgataaagcgataagttttgtggcgtatttcgttatttctggtttactttcaactgcaaaatcgtataatttggtgaagaaaaacgtgtcgtcaaaatccacttgatcctttaatgttttggaagccttgtaaagggtttttaaagcttcttccaatgacaagttatcatttttttctgcatctggatcatccaaatccttgataatggtttttaatgttctaatctgatctttaaataatgtgggattgactttcgatatatcatccaagattcttcttttcaaatccaattgttttgcgtcagaattattagataggttcaataaaacactgatgttggatacattataaattattggtgaggctctaaaaagcaaaatttgtattaccttggcgatatcacgtggcataatggaagcaccagtagatatattatattttttaaatagtcctggcgtttgtaacttactgaccaattcattgtaacaatttttaaaagtaagaaacggaatatcgttggtgacacaggcatttaataaataaaagattctttcgtcgttaaattgttttattgtttcgagggcgtcgattgctttcgtagagtcagaaaggccagaagctaaccactggagagtttggttgtacttgttcattacaataggaccttgagacgagctcatactttcttgattgttcaaaaatttactaaaatcaatatatttggatatagcgaaggatattttgatttgtcttgcattgaaagcgaaaaatgaagtgaatgccttcttatcaaaatgtgacaaaaccgttagcagtctgtggactcttttatcgttatctggttcaaacggtagtaggtattcgaaaattacgctgtcgacttgttcattgatgtttaaatcattgatataatagagattgtataaagtggatggtatggtgtctatgatttcccaaatttctttattttggtatgtcctttcgatctcattcaatgaatttgagtaaaacttggccatagtgttaatgcagagttccctaacctccttatgtttttctcgggccaaatgaagtaaagatgtataaatggctttattggttatatttttccaaatttcagtaacgggaactttattaaaaatcataacagaagtcctgcgtacacgaggatcagaatcaataaaggtttttgccagtgcctgattcagttctttggatatgtcttctctcgtggcaatgatttgaggaattgattctgtccattctactctaacatcgggactaatatcagcaattttggaaatccatgccttgaacgtatcggaatgtgtagaaacaaaatttaaatccgaatatgaggtaagtatttgaccaattaattttgtagcttcttttctgaaaagctcgttttccgaagataattcgtggtatataaatccgattactgcattgatcagttcgggtactgtttcccaaagtctcaataccagtttatgtaatttcactaccacagtgagaagtcttgaattattgtcatcattagttgcttcatgaataatctcggaatagtatttagttagatgtctactcattctattggaataagtatcacacaaaattagactaacttcgtagccacagtcagaagtaacgttcaaaccttcaggaatttcattcgggttataggtcaaaaacttattaaaaattaatcttagtacttctaggggaacagaatcgaactcagagatgacttcaccgagaataccgcctattacattgaagagccttgcggggaagctcttgttaggatcgtaaaaaatatggaatagttcgataagtaaattgtttgaactaggtaaatcggctaataatacgattgatctgtattctagtagcttagtgatcaaataagtttgttggatgtgatagccgttttcttggtcacctaattgttcaaattgtgagagcaccagcttgaaaatgtccgttagttgagcatccgtataaggcgcatctggagcatataatctcaggatatcgcttagacaacaagcggtgaaagcgcggatccccacgtctttatgttttaataattttctgctaactagtgcgtccctatatttatctaatcccgttaaatctgtattgtcttgatccagagaggctaattcctcatgtaaagcttttaaacgatctaatagttcatttgttgatatcagctgatcggaggtagatattataggtgagttaaacttcagtttagtaacagcacctttagccattttgttcgcactttatttcttgcttctttacaaatatacctgtaaaaattgagaccggatacaaactaacaaggtggataaacttcttttaggtctttttacaattaacaacaatttcgatggagcctaggtttataaactttcacttgtttatacaactttacgcgtcgcgtcgcgacatgtctatagattaagtcacttttaacgccatcattccgggtagtgcatattttcccttggcggctaaatagatgaaaaggtaaaagtttaatctgagaaaaaaactgcattgaggagtctgaaaactgaggataaaacaaacagtcgcagttgagttgttctttttcatggaaattcttactatgtactgcatttaggaggggagttcatcacactattataaattaaaatatacatcctgcttcttactaaattatgtttttaactattcttactgccgcaattccaagagggtagagggtaacttcagagtctttacctaaaaggtgggacgccagacgggcgttaaaaaactttccgtaacggctgagataaaaatgatttcgcccaggatcgaactggggacgttctgcgtgttaagcagatgccataaccgactagaccacgaaacctgttatttgtgatggtctggacctatacttatggttttatggactaaacattttatgtaatcttttatagaagaacatttcttttttcaggtcaaccgtacaggaaactttcctctaataataggatcttttttaatgtagctctcaatatatggcctaaatatcatgtcctattctttttttgaaatatctccgacatttaacaaaatagtattatttcatggcatgaccattgaaaattgtgcaagaactttaatttaggaaagttcattgattcaggataaatatataaagaaaaagccactatccccagaaattttgctgttgatgaaggctacgatgctgtgaattcagattataggagaaattcacctcgaggacttgaaatccacattaaggaatcgatatttttacacgataatattataactttttcctctattttgtttttcttttaatatattgtcattcatcattttatttcaagcaaaatttaaaggttaacataaattaatagttgccataattgggacagaaacttccattacatctctagacttttctcaatctttatatcatctttttatgtcgtatatgataatcttctagtagtatggaacaagtcaagagatgatagctgatgcttcattttaacaataaaaattctaacgactatttatcacgtcttggcttagctataaaagtactatataaacttagtatttatttttgaaaatactaaacaaattctatcaacgaaaaacctggaaggaacctatttacattccctttatttttaattttgaagctacatacagacattcaggatagtaatgctaaaggttccttagtgtctgatctctcctccgtcgcgaattcctctctttctttttgctcggtttgttctccttgaggcaatgatggcaaaccttctgttgatggcatgttagctacttttgcgttattcatcttctctggattgagttcactttctagagcatccaattccttatctagatcgtcttcataattgcttgttccgactaagcttctagataatgtctcgttaatttcattttgatacgcaatttgatcttgtacatcgtccatcagttcatcaacattgctaaattccttgtttagttttttcaagatttcatttccatttttcagtccattaataaattgcttttctaccattttgaactcaagtgttgacaccatattttccaaattaataagctgatccgaagcctgctgcaacaaatgctcctgataatgaattctttttagtagaaatcgtaccttcatgttagatttataattttcaggattttttcgtattaggtcttttagttgactcttctctaccaaaatcaaattatctgtcctcctcgtaaacttatgaatttcatctttagatcgttttacttctaggatcgccctatctgttttggttatatgcactttactacttttttggcccattcgatatatacaaaagcaccaagtggagttaattcagcagtctgtactatttttccaaactatctatgttttgttcttttctatgcgctatattgtatcccacagatagtaattcgattttcggtctttctgctcttcggggttccatttatgtagaaataagaacgatagcgaagagggtaaaagatcacgaataaaaaacgaacgctgcgtgacaaaatcggagctgttgcgactaccggcaggattgattgctaatgttctttatttacttcttttagatttctatgtaagctgctggtccatatacaagtatgcttcttaagagagactgcgtatatatcttacgtcatttattcccacaggttattccaagtcacatttttcctgacagcgttagagaacccctcattgtatttcacccatattttaaccgtttgattgcagtcatctgcttggttggtttcgtctgatccaatagttttttgtgtctcttccaattcctgagtttgcttcaataatccgtactgattcttgaaaaagtcgattgtacttgaggaagaatttaacccagttttgacttttttgctatgcatttcctgtgactgtagtctatcctcagtcacttggtctatatgccttttcttggcccggttttcctcaatctttgctaacagtgaactcaaattattagcccgtttatgttggacttcgttaatatgtttaggatttaacaatacgacttcatcgattgggggatcgattgttaggccaccccttacatcaaatccttctgaccgattttggattagattcagttgaaagcttttcagcaattgaactaattcctccatgatggcttgtttgagtttcaggttccttattttattaaaatcggaagagatcatcgaatctagatatggtagtatttcaaagattaacgattttctatccgtaaaacttgccattagtggggactgaaccgagatatgtctcataatcagactaactatatctgaattggctcgttttaattcacgttgttcgtattcactattcttcattctaatatcatctttgtttgcgatatcgccaaacgtttggaagaagactaggggcacaagggcggagtaacgtaacaattcgccattatgcgcatacattgattggtacattaaatcatggaaaaatagccaatctgaaatgtttgctggctttcttataccattgtcggaatattttacgtagggaaatatattaaaacagccttgcaatatcctgtcagagttaccattaagctctacttggtttagcaattcataaaactgctcctttatatcacgatgtggatcctttctaaacaattggttcacgattttaaaccatgatatgggggagtccttgttggatgacgcccacgtattttttgcacaagcaggtttatctgatgcagaggaatctcttgaatcaacattcgaggccaagaattgtaaattgtttatacaattccttacgtcaccttgagccaaatcaattaagtcattgattgcttttataggaatattcatgttttctttatggcagataaggttcaatcgctctagtagggtagtatcggaaggtcttttcacagcaataatttcacagaatggtttcagcttttccaaagaaggagcatatagattattgcaaatacaaataataggtcgcgtaagcaatttagaccttttctttttgcgctttttgtcctttttatctggttgaccgtataatagtttattagtggctttaatatcgctttgcataatgtcaactaaaattctaataaatccactctcaatacttccatcaatctcatccgccactaagcacacaggatttgtatcgaaagtatgattgaataaaagattatatattttctcttttaccataggtccagccctttcatcacttgcattgatttctgagacagaaaaccctgattgtttggcaataacgtgagctactgaggttttgcctattcctggtggcccgtgcagtagtaaaattttctttggtggccttttcaatggatcgagttccatatcactgacctctttttcggttggcaatttgggtaattgctctttaaacacagccggcgtccattgtctcaaccaacctaacattctcctgtttgtcttttcattaccaaccaaatctagaaattttttaggacgccatttctctacccagagtgtgtcgctacctatcttgccagttataggtgaagtcttttgtgcgttagtgcggtcatcgccagatgcctcaattttgtctaacaaatagtttatattgatgccgtacgtgtcgtctgatctccaaacagtatctgggttagtgtatagactaatattcccggttgctaacttcgcaggcttcttctttaattgaaccgtttcgccagtacttgatacaaacgcgtgaatatcttcctcattaataccaattgcattattaccaggggcttgttctatatcaccagtatcaaaaagggaacttctccctagtgaaccaatgtatggtgcggtatcaaccatgatccctgaccttacatccaccttttgggtcaaatagtgtacacattaggaataaaatatatgaaatcatgtttatttacgtgttagatgttccgtacaacgcgactggctagttcgttttttccacattttttttttcaacgttgatcaacaataaaatggtacatcttcctttgtttgtgtcttaagtgtcctttcctggtatatcgcttgaccagcgcctgtagcatcaaaccaaaccttcatcgccctaaaacacaatggttacagtatgttgttgcttttatttactttttctttttttgacattcattgtgacaatattcacattcttcagatagttctgtctatatgaagcaaaaatgatatatcaataagtttactaacaaacacaagtggtattactatgacttcactttaaatagcaacaagaaaaggaatttttagaatcctaccctcaaaactgtcctccagatgccttgcctggtactccaggaaatttagacagcgctcaagagaaggcattggcagaactaagaaaacttttggaagacgctggtttcattgaacgtttagacgattcaactttactacgttttttgagagccagaaaatttgatgttcaattggctaaagaaatgtttgaaaactgcgaaaaatggaggaaggattatggtaccgacactatcttgcaagattttcattatgatgaaaaaccattgattgccaaattctacccacaatattatcataaaaccgataaagatggccgcccagtatattttgaagaattaggtgctgttaacttacatgaaatgaacaaggttacctctgaagagaggatgttgaaaaacttggtttgggaatacgaatctgtcgttcaatacagattacctgcctgttcaagagctgctggtcacctagtggaaacttcatgtacaattatggatttgaaaggtatctccatatctagtgcatacagtgttatgtcatatgttagggaagcctcctacataagtcaaaactattaccccgaacgtatgggtaaattttacatcatcaacgcgccattcggtttctctaccgcatttaggctatttaaacctttcttggatccagtcactgtttcaaagatttttatcttgggttcttcttaccagaaggaattattaaagcaaattccagctgaaaacttaccagtcaaatttggcggtaagtctgaagttgatgaatccaagggtgggttatacctatccgatatcggtccatggagggatccaaagtatattggaccggaaggtgaagctccggaagccttttcgatgaaatgatattatttttaaagacatttttttttcgagagagaaaagaggagttctaagtaacgatattttacaactgagataagtacaagtatgcttatttactctattctacttttttgaataggcatagttcacacttttatctccttagtttgtactactctttttttattttttttttttcttccactcagctattagattatttattattttattatctgtggtatcattttctacagccataccttgattttagtttattttgttggcagttatatacatttatcttatagaatacatatgcacgtattaaacaataaaaagaacataagcaaaaatgaaacctcgctacaataaaactttattacgcattgcagtgcgccgtaaagagtattcattagaagtacaatggtagccctatttggttgcaacatgttttagcaaagagattagtaggctaggatatcaagtccatgcccctttatcacatactgtaatgatagatgcacctccggaaaagtaaaaaaagtttttcaggttacaattgtgcaaattgcgagtctatctcgaataattttgcagcgctcatttcacggttgagccgttttgtatcacaagccaagtttaacattttattttaacagggttcaccgaattatattcccaaattgctgaagtcttttgacaattcatgcttttgttcttctctctgtaactctctcgcgaagttagagttcaaatgagaagcctcctcctggtacaaatttctatcgtcaatttcattgcgattttgcttttgagaaaaagcacttttaaaattctcaaaattccaatattcattattgatgtaagaagaaagttctgtgttgtcaacaaatgcattaccaaagtccccaatttgaccactgaatgacaccatactctgtgcatcaaaatcctggaacttcggaaagtcacccatttcagattctacgttaaattgagcgttcattggccgttcagtctttcttggctgaggacgaactaattgaacagtgcataactgtaagttatccaacgtaccttcgactaaacaacccttctctctgaagtggattaacagatggttccataatgtgtttcttgccaaagatctaggattaccaagaataactagaccatatttggcacgggttagacccacgtttagacgacgaggatcacgtaagaaaccaatggcctgttgttcattggcacgaacacacgataagattatgtaatccttttcacgaccttggaatgcatcaactgaggcaacttccactttgatatacaaatccttatccaatgaaccattcatttgcatatattgtaaaatataagctctttgtccctcatatggtgtgataacaccaatttgctcgggcttgacaccgtctctgaaaagtttagtgatgattcgttcacaattcatggcttcaattctgtttaagaaggaagtaccgttagcagaaatctcctctctaccgtaattggcccaaaacatcattggtataccgcgaattggccatgggaatttgctgttgggaacggtacgctgttcaatcgttacaccattttgtaggctgccttcataaaacatgttacttggaaactcactcaaataaggattcatacggtattgaacttccaaacgaatcggtacgtggcctagagagattaatctttcaaagagagattgtttcaaaccagcgtctgccgcctttcgttccaatatgactgggcccagttgctggtgatcaccaacaagtataacttgtttcgcacctttaacgattgggattaaacattccggctcagaagcttgagtactttcatcaattaacacagtcctaaatttagtgtctaagcgcttatcaccagcaccaacacatgtgcaacatacgacatctgccttattgagaatttctgcttctgttttccttactaatttaacaaaccgttttgtatcagaagcagataattcgccaacttcatcctttaactttaataggttttttaattcccctttagcaccacggccaaccaaattatgcaatgctaagttggagacggaactctccacatcttctctacttttcgcggtaagtctaacaacttttaaacccaagtcacgtaatttggcagccaaatgatctacagcaacgtttgatggggcacacaccaatattctatccttgtgtattttggaaaggtgatacacaatcgttgctgaagtaactgttttaccagtgcctggtgggccttgaattaaagataacggacgttgtaatacatgactaacagcgttcgactgggatgagtttaattgtgcaaaattcggaattgaaaactccttaggtaatgggacatcaaatgaaatgtcaaccacttgatggcctaaaattttatagtacaaataacctgaaatagattttttatcaatggcaaattttttcaatgcgtcttgcatcctgtcataagaggtacctttccagatgaactcagcagtaaaaccagtggtcaaatgtgttggaggtggcgttttacttggttttaactctaatgtgaatgtgtcctggaagctatttggtaaccgaacaatgtaaccacgaccttcccaatcaggatgttgcatgccagagtaccatagtatcatttcatcaccgatggcaactttcaactcgttagattcgaaagtagataaagtgaaagatgctaaatgcctattatttaaagctaaggaccatgaaacagaaatatgttctaaagcttgagattccttgagttgtttatcatagtcggcctccaatttgattaaaggcccgtaagatctttggtattcgtaggcgtcttgatatctcaatagtaaaggtgggattgcttcctgttcctctggggcgtcaatatcattaattgtagcgtctttattggatctccattttgcctccaacttggaaatttggctaggagtgattaaacgagctttcaatttttcttcttcagttggttgctctgcgacccatgataaaagttgtctgtcttcaattaatggttgccattgatcagtatcccagttcgcatttttcgtctgggcacaaggtattctacaaagtaaaacaaccacggcctcacttttagcggaaacaaatcccaataaaaacacgttcttacgtccacagttataacattccaaaacggtatcccctaagtcagaatctggatgtaaagaaactacgttatggtgggataaaactaagtgattaacaatgtgggagctgcttgtaccgtttttagtgttacaaaaccatttcttacatgaattacatttgatgacacactttgcagaatctataccacaatacgcacatgaattgtctgaagctgaaggcgaacggaatccagtctcagtgacttgagcctcttcaaatagctgattatctacatcgtcatcctccaccaaggtggaatttagttgtgttgcgggttggacatttacatcagatggagagtttgatatatcataaggagtgtgagaaccggaaccgaccatttgataatgacaatgattgatgtaatataaaaagtatattcggtcttgctgcccttccttctttcctgatgaaatcttcaacgtttgttggctgacaagagaaatagagtcttctgttagtgtgcgttaaaacgatgcctcttttcgctttttttttctccttcacaatagcatcgtaagtttctggtaagcttttcatttgatcagttagtacgaaagcgtataaaggtgtccctcccaaatcaagtaagcaaagggaaactgatgatactaaaataatgtaaattaagattaaactaaagttaaaagtaaaagcattcactcgtttaatattattgagtggatagtaactaactatgtatattttctttttgtttttcttatttcccgttcatgaattcattaaaagttaggcgaattacggagttcgccagatgcatatgtttcgttttcaattggagaatgaactcgctagtgacaattttatgaatgattttctcctgggattcctttcctccaggcaattagaagtgtgaggactagattcttcgttagaagaagccacactagtattcaatgaactattggaaggagatttcaccaaagagttggaatacgagttgtttctagtctgcaagggagaggaagaggaaccattggaaagaagcgaaaaggattctcttcttagatttgatggcgttcgttctctgtgatagtggttaaggtttccactgtgacctgggacgttatttgatgatattttcccatgggaaatcaattttagtcgattattcttttcgttggagagataagacgacggatatgcagccgaacttgaattcagattcaaatacgagttggaattcgaggcgggtgttgaaacagatgttaatggggaagtgagatcatttgactggtcgttagctactgctagagagtctagctcggatgaaacgtatttttcaaggccgtatagatgtgttggtataccgtaacaggaagaatgcctggatcttggctttatgcatttgtggtcaaaacaggaatccgccgcgtcgcccaaggaagactgtcttgtggattgtctggacaactggtgaatgagggtgctactatttgctcttattcttcttggagaagggcgaattggttcattggaattgttcgttgaatttgctgggacgaagccatacaagtgatgcggagctgtcttgatttttctcaaatggtggccaatagtatgattgcctatgtgtctgcttgtattaccggcattggtactgctgctgtggtgagaattatttgatttcgaggaattttgaaaactaaaggacgctaatttggaatttacaaaatcattcaaatcatttgaacctaaaaaactttgtacgtctgtttcatcttcataatcacaatcttgacaaaatggatcttgtacacctctttcaaaaatttctgaagcaatcatcaaaatacagcgactatttctattctttgatgttttttattccactgaggagataattattcaaactgaaatattttacgcaaacctttctatttatgtgtattacctttaatctaagtggttgtagctcatacacttattataattggtagagaaagaagaaaagaaaaaaagacaaatttaagtagacttgaataaaagtaagatagaaagagatgtgagattttcagatgtttgcttacagaaaaaacaagagttcttaaacatcaagaaatcggtaaaagtgtaattgtatttataatagtgagtttcggaacttaaaaatccgtttccccgtcaagagaagcaaagatcagttcatatagtgatttcccttaaaaagttaccacagcttctgaattaactgtaatccttatctactagtatcaaccaacccttgtgttttttttttttcacacttcctctaggaaaaaatccaggagtaagacggcgtttttttcaaattttctttctccagtttttccatgctgggtttcttttcgttaatagtggtgggtaaaagaaaacgtacgaataaaatgctgaatgtagaacatactgtaggctcattaatacacagtagaacgcagacccattcgaggggctcattggaaacacgtagtcgacattagttctagataatccgcttgatgggccacatatggtaatggcttctcgaagcagatgttacgagccgccagaacgaggcggtggcatctgcctcgcgctgttttctagcggcagagaaaacccgtagatatgtttctaatgcgcgtgtgcggggaatttcgttgtcacgttgttttggtaagttccttcgctttctcgtaaaaataagtaaaaatccggggaaactattatttgcggttcgaaataaaagcattttaatttccttccttggcacatttcttggccacggatgacctaaaacattgccaaataaaaaggggtaagagaacttttgtcttatagttatttcagcgatagtcattcttccagtttctgttttgtaggacaaggggattgctgcttagataatcagtgccgcaagaaatctcagatgtggggccaaaggtaaaaaataaaaaataaaactgaaagataaaaaataaaaaaaagatcgtctcacgtacatcgtatctgctcgagtgaaatcactgtatggtaaaaatgtattatgcatctcttgttagcattaaatgagcgtaaagccgcatttgtgtaggtggactatcattgataaggaattcaacttgatttgagtcatattcttccgaatgatttctggtttagttttaagttttcccttttgccccgctaggatctagtttgtctattcaaattacagtgcatgaaagttaacttcgaattgatagggatgcgtcgctacgctcacgggacagctcataaacacaaggagcttaatgagctgcaacgctaaaaaggggtagaatgattaaaaaaaaatcttggacagcgggccactgataccacggtagggaccaaatacttccagaagctttcgtgagatacgaaacattactatagttttactgcatgtttacaaggcaaacattaaactttaatagcaaaaagtcatttttttgtggattttaaatgcaacgttgctcctcacctgcatcttgtaagctctaagttttgattgagcatatttataatgttgctacgagttatttattcgggaactttatggtctcggagcgacaattttgttatcataatgtcatattataatgtgatacatcgtctgaagaagagaatgctttcgaaaaattcaccttaacgctatgatcgaggtttgctaactcagggtaaataaatattacatttgtgatatttcggcggttgtgcctcttttactactttacaattagttacaatttctttttcttgagttacttttcctcaaaaagaaaaaaaaaagaagaaaggcaaacctaaactaacttatgataatatagaaatattcaaagctaaataaaagtaattctggtcttgaccaaccgtgatgttcaaaatcactcgaccaattttcactacgtcgtcctgacagcccatagatgggataccagttcattagtccaaggagtagcttccttcaagattttcttttttaagtagtaaatccatatcaagaagtgttatgaaacatattattggaggcatgcactattacctaacgtcgccatatgcgctcgtatcgattgtatcgattgttacgggttctcttccacccctgtagcgctgtctgtgaagctttcttattacacatctccgcgttcattgacgtcaatctttttagaagggatcctgatcacgaaggaacgcatagtgcatcgcttaacctggctagttggttgcaaaggaatgctatttttaaatactagcgtcttgcaaataaacaatcggatatgaaaacaatatgacgtattatatcggctcgtattaattacattatactgatttttaaaggaatcatatagcatgggtctttgcacaatgcattacgtgggagcacatccctttgaaacgcacccacgcatttgctaaagaaaaagaaagtaataaaataaaagagggcaaaagaaagaaggacaagagaaattcttcgccacggcattgaatctatttctccttacgaaaaaaaagatcaaggaaacatgtcggaaacaaatgggaaacaacaaaaaggacttatcattcctacttttttgtcgagggcatttgtcgagggtaatactgcatactgcctattgtcggtcccgcagaattaatagtggctgctcatacacaacgaaaaaaattgttaacaaaatagaaggattcgtctatgcccttttttcagtgcggaaattatataccacacaagccgtcgaagcccatagggtcctttaacaataaagactctcctaaaaaaatttttcttgtgacacgtcagtgcaggatataaatgtagcaagcgtatataacaaatgacaaagggttcttgcgcaaggttactttagcgttgctggataatgatcggattgtttttagatcacgatagcacatttgaggaatcgtatcgaaacggacagggcaagagtacgagggcgaaatgaacttataacaccattgatattttctcctcaatcttatcattccacgcacattattttcctactatgttatgcgggaacagttcctaaggaatttttctaatggcatttcggcagcgtcatcaaatgtacgcacccacttcaagtgatcattcgctcgttactacctatcacgtgtcgcatcactcgcgacgtccatgcgcatgctgtgccgcaggagaattcgagatgcgaatgagcagcagccattttgatgttgtgagcatcggaacgtttctgcgtccgtacactgtccttttgttacttagataatggctaaggcaagcagtccgggccacaggagtcaaaggcttttcgccagctcctaaacgctggaagtgtaattttttttcgtcttataaaattaaacaaacccttttagaaaggaacactcgctttatctcttcgaccgaatttactatacatggatatatatatattatcttctgttcacagttaaaactaggaatagtatagtcataagttaacaccatcatgttgagaacgtcaacattgttcaccaggcgtgtccaaccaagcctattttctagaaacattcttagattgcaatccacagctgcaatccctaagactcaaaaaggtgtcatcttttatgagaataaggggaagctgcattacaaagatatccctgtccccgagcctaagccaaatgaaattttaatcaacgttaaatattctggtgtatgtcacaccgatttacatgcttggcacggcgattggccattacctgttaaactaccattagtaggtggtcatgaaggtgctggtgtagttgtcaaactaggttccaatgtcaagggctggaaagtcggtgatttagcaggtatcaaatggctgaacggttcttgtatgacatgcgaattctgtgaatcaggtcatgaatcaaattgtccagatgctgatttatctggttacactcatgatggttctttccaacaatttgcgaccgctgatgctattcaagccgccaaaattcaacagggtaccgacttggccgaagtagccccaatattatgtgctggtgttactgtatataaagcactaaaagaggcagacttgaaagctggtgactgggttgccatctctggtgctgcaggtggcttgggttccttggccgttcaatatgcaactgcgatgggttacagagttctaggtattgatgcaggtgaggaaaaggaaaaacttttcaagaaattggggggtgaagtattcatcgactttactaaaacaaagaatatggtttctgacattcaagaagctaccaaaggtggccctcatggtgtcattaacgtttccgtttctgaagccgctatttctctatctacggaatatgttagaccatgtggtaccgtcgttttggttggtttgcccgctaacgcctacgttaaatcagaggtattctctcatgtggtgaagtccatcaatatcaagggttcttatgttggtaacagagctgatacgagagaagccttagacttctttagcagaggtttgatcaaatcaccaatcaaaattgttggattatctgaattaccaaaggtttatgacttgatggaaaagggcaagattttgggtagatacgtcgtcgatactagtaaataatagcgtgttacgcacccaaactttttatgaaagtctttgtttataatgatgaggtttataaatatatagtggagcaaagattaatcactaaatcaagaagcagtaccagtattttttctatatcaagtagtgataatggaaatagcccaaatttggcttccgtcgacacatagaacgtttgagagacattatcaccatcaagcatcgagccgcccaaacctaaccgtataagttttttcacgtttttgatttttccttgcacacttcgatattactctcacgataaaagggccgaagagaatatttttcttgaacatccagaattttaattcggagaaatttcacaagccgccgatttaagggtcctgtgttcttaataatcagcctctctcaaagcaggtaagaggcagtctttcttttaacaataggagacattcgaactaaaacatcagccccaaaaatgcgcttgaaggtcattaggatttggatttcttcctcatttttaaaggcgccccttttcgttttagtcatgctgggctagactagcacgtagtgtatggaatcaaactgatgccgtcccctgaattatatttacaattcagaaacgtctttgaacatttataattaaattataaaacaaaaggaatttgtaaaaaagactttcaaaagatgatccaataaactagattaaaaacccaatataagaagaagaatgtgtggcatttttggctattgcaattttttaattgagaagacaagaggagaaatcatcgacactttaatcgaagggttacaggcattggagtacaaggaatatgactccagtggaatttcgatccaaggtgatgagctggagtctctcaatatttataagcaaaccggtaaaataagcagtttgaaggaagaaatcgacctttacaatcttaataagaacctgccctttatttcgcattgtggcattgcccatactaggcgggcaacacatggagggctaagacgtgcaaattgtcatccacataactcagatccatctaatgaatttgttgtggtacacaacggggttattaccaacttcgctaatttgaaagccttattgatggcaaagggctatgtgttcaaaagtgacactgataccgaatgtattcctaaactgtacaaacacatttatgatacaagcattgaactcgggtacaacctcgatttccatgtattaacaaatttagtacttaaagaattggaaggctcttatggtctgctatgcacttcttctcattttcccgatgaagtggttgccgcaagaaagggttccccgttagttattggtgttaaaggtaaaactgacatggacgtaaactttgtcgaggtggaatatttggatcaagaagaagactacttgaagcttaatactcaaaccaagagttctggtaatgtcttggctgccgcacctgtaaaatataacacttgtttaaggaagtcaccccccttcgttcacaatacctgagaaactctacaacttctacattcaatcatggctcatccacagaaacgccagccgagaacggcttgccgcgacccatggaattctatttgtcatccgattgtgcatcactagcgcggtatgtgagtaaagtagtatatttggaggataatgatattgcccatatctatgatggggagcttcatatccattgttctaaaattggttccgaggacttttcatttagaacagttcaaaaattagaattggagttgtccaaaatcaaaaaaggcccttacgataattttatgcaaaaggaaatatacgagcagtgtgaaacaacaaaaaatgtcatgagaggaagagttgacgcctttacaaacagagtagttttgggaggactagaaaattggttgacagaattgagaagagcaaaacgaataataatgattgcatccaaggcctccttccattcatgcctagctgcccgtcccatctttgaggagttaatggaagttccagtaaacgttgaattggccttggattttgttgaccgcaattgttgcattttcaggaacgatgtttgcatatttgtttctcgaagtggggagacaactgatacaattaatgctttgaactactgtatcaaaaaagaggcagtcacaatcggggtagttaattgcagcggttcctctatctcaagatttacacattgcggtgttcatacaaacacaggccccgagaaaggtattgcaacaaccaagtcttatacttctcaatacatcgctttagtcatgattgccctatggatgtcggaagatttggtgtctaaaatagaaaggaggaaagaaataattcaagccttaactatagtcccaagccaaataaaagaagttttggagcttgaaccattgattattgaattgtgtgacaagaaactaaaacagcatgatacatttttgcttttaggaagaggttaccaatttgcctctgctttggaaggcgcctcgaagatgaaagaaatttcttacgtgcattctgaaagtattcttaccaacgagctaggacacagagtcctagctgtggcatctgataatccgccaattatcgcctttgcgacaaaggatgctttttcgcccaaaatcgcgtcttgcattgaccaaataatagaaaggaagggcaatccgattatcatttgtaacaaggggcataagatatgggagcaagacaaacaaaaaggaaacgttgttacactcgaggtaccccaaaccgtagattgtctccaagggatacttaacgttattcctttacaattaatttcttactggttagcgatcaagaaagacatcggagttgatttgccaagggactcggcgatgtcggccccggatatataaaaaagtgttctttaattccttctaatttcattaaaacaagtacttatattttgggcagtatgtagaatagatgttcacactctatagccaaataacttaattattggtcaaggtaatctcttgcaattggtgtcactgccacatcttttaacgtcaacagtaaatccgcaaaatcccgtcgcgtcgccgctaagcaggcccaattttagctcactgcggcagcgggctggccgtgtggcgcgagggtcaacatgcaaaaaaggacgatagataaccttaaaggaagtattcatttcttcgctaaattttcagtgctcccttactttaccgacaaattggataaaaacatataaaacacaacagcaacacgtagccataccaaccaattccacaaatcaccagccgttcgttcctaaaaatgtttagaagaagaacaactgcaccagaaatggaacaggcggacccgacagcagtggcagctgcagcaagtatcggtaaattattaatgaagaagggtaatcaatctgataacgaacaaaggccgacctatcgatccgcttcgatgacaaacttaagaaaaccttctgcccccaaaagaatgtcttctatttctagtatatcatcggaatctagaaggagcgatggtaaaggtcgtcccgggaaaataaacagccttacccaacggtcatcaatggggaagggagattcattaaattctcctttaacgaaggaaccgcagcacaaaactaggtctcacaatagaacttcgagtctccctaaccagagaggtcagcaaagcagaaacagttctggtttacaacgtcaaaagtccaaaacacaccaaagaataagctatgatgaggctcaacgtacgttcaaggattttggcggaccacaggccagaggaattttaacgggacaacaccgtactgaaaatcctagcgggtctattcctttgaggactacgcgaaagtatattcctgggcccaacgggctggttgcaattgaggtccccgttgaaaaaccaagcaatgccaatacttctaaattgctaaggcgttccaactctgcccacagtgccttgaatgcaagaaatggttcacttttaagaaaaaaagtatcgcaggaatctttacattctcaaccaaagaagacttcgtctttagggaatacatcaagtacacaagcaaaaaaaggccaaaaggcggttcaggagagaaatcttgccaagaaacatccaataaattcaaatgttcctctcattgaaacacaagttcgtgaagaaacagaccaagagttgaaacttgataattctaactcttccgaatccgaaacagtagtcaatagcgaaaataatctagaaaaaccttcttcactaaacattgaaaaagatgatctaagcaaactaatacatgaaaacattgagttagaaagttttattgaagaaaaagggaaggaaaaacctttaaattctgatcaagaagatgttttcataagcgaaaaaactgtaaaaggcgatgtacaatggccaaaaaataaccgtcaagcatctactcttgagaaaacttttaattacgacaacgaagagaagagggaggggaataaaccagtagcagaacatcctcttccggaggccgaagtggatgacaagtcggttgaacaactgaacaacatttcttctagcggcagttattcggcccaaggatcagttgaaaactccaaaccagaaaatggcaataaaaatctagagaatgacacaacatcgtctcccacacaagaccttgatgaaaaatcccgctcaatagaagagaaggataccttggaagggaccgagagttcaaaaaaagttgaaaagccagacaattgttgtgagaaaatttctggtgctaatacttcttccaaaaaagggaatgttggcgatactaaggatgaattcttcgatacagtagaagaaagcgatcagaaaacgagcaagtcgaattcctccaagaacaccgatcattctaatcaaacagaaccaacgccttctttggctcagtatttaaggacctcaaatacctacctttctcgaaaaaaccaatcgaaacaagctgagcaagaaaagtttcacaagcctgaagctcctatggttcctgtaacgaaagtagttacaccaatcaaatctgctcttaaaaaatcgtcaggatcgtccaaccatgactcatccatgtactctgataactctcccgccaatggcgcatacctgtctcttacgactgctgaaaatacgagattaaatgctcaaatgacgatgtccgacagcgtatcacgcagagcaagtttaaaacgatcttctataaaaagacctcagtcagtaggccagttcagaagcatcagatcaaattcgccttctcccccagagaaaataaacaataaacgccattctgctatacccctaggaaccccagagaagggtaaaccaaaaagaaattcggttatggcttctctgtctaaaaattcgcagcaaattcaagagcccgcaagtgtatatgagtcaaatggcccaaataaacctaaaaaccaaatcaataagaatataaagagaggatcacagatcgcgcaaaacaataaaccttcaacgaaggacatgaatagtattttgtaccccaaagaaccacctcctcgcaaatctagttttgagaagacgagaagcaatgaatcccatctcggatttaaaaagctttctttgagaaatggtaattttgaggaggcattgagtgaaagctataatgggcaagctagccagaatagcacaaatgtgaatcgaaccgatacagcacaggagtttttcaaatatttgggtcattcatcaagatttgcggattcagactcagaagatgagtcccaatttttcaaccaaggcccatcaaaatacaacacagaaacagaaggcaataaaaccagcggtaacaaaaatagtaatggtggtaacggtgctttttcgcttttcaagagcaaaagtaagcaaaaggaaaataatgtggtttcccctggagtctcaagtcctaatcatactaccaccgatcctgccattacaagtaaaaaggtggacaagaaattcagcgggttatctttaagagctgccagtgaagctgaacctgcaaaaaattcaaacccttcgatgaccaataggttacgcttctctagtaatccagagaacggcgaaagcaggctcccacaagcacaggaagtcagcgttacaaaagaaaagaagggtagtttcggcaaaaaactgaaaaaaatctttggtagaaagaaatagggactctcggcagaaattctctccttgtacaagttatgtattttattctttttcgtgctcgttcaacttctgaacgatggcttccatgcactgtaacatataaaggattttttaataatgaataatcaagaaatctccattttatatgcttttttttttttgccgtttccactgcaatcaatggcgatataatcggatgaacaataaatattcgtgttcctattcgtgttcctatacgtgttcctagcagcaaacaataacagaagagaagcatttgattttcgtaaaaacttcaggtgtgggtgtttcttattaacggttaaactttacgaattgaatcccctatgtataatggtccataatacatcttaaaccaccaagccatcttcgtaattttgaactgggaaaattgggaaaactgcagacattcataatcatgacaggatctttaaacagacactcacttttgaacggggtaaaaaaaatgagaataatattatgcgatacaaacgaagtagttaccaatctctggcaggaatctataccccatgcatatattcaaaatgataagtatctttgtattcatcatgggcaccttcaatctcttatggattcaatgcgtaaaggtgatgcaatccatcatggccactcttacgcaattgtttcacctggtaactcgtatggctatcttggaggagggttcgataaagctttgtataattatttcgggggaaagccctttgaaacatggttcaggaatcagcttggaggaagatatcacacggtcggatctgctacagtggttgacctacagcgatgtcttgaagagaaaacaattgaatgtagagatggtattaggtatattattcatgttccgaccgttgtagccccatcagctcctatatttaatccgcagaatcccctcaagacagggtttgaaccggttttcaacgccatgtggaatgccttgatgcattctccaaaagacattgatggtcttattattcctggattatgtactgggtatgcaggtgtaccacccattatcagttgcaagagtatggcctttgcgttaagactatatatggcgggagatcacataagcaaagaattgaaaaatgtgctgatcatgtattatttgcaatatccgtttgaaccttttttcccggaaagttgcaaaatagagtgccaaaaactaggaatagatatcgaaatgctgaaatcctttaatgtagaaaaagatgcaatagaattgctcattcctagaaggattttgaccttggatttataaaggtatataatataaagtctattttcaatttttcaagaacttgaactacgtttgtaagtatgtttcaccagatataacgataaaacaattcccactgctgccagggctatatttggaatataggaaatcaggaatgcctttttgtagacatcaagaatgcgaacaaatatatccgttggaaaattgggccctctcaagtaactcgaatcattgataagggagtagtactgctttttggtgaagtgatattcgtcatcacgcttggttttgaacatataattccataacatggacgacaggctattctcataggacactaaagttaaagaggcaccaagaacgttaccaatggatctccacaaatagaaaacaccagtcatggttccttgctgtgatttttcgacggtgaatacgatgcttactaacgtggccactaatagacaagcgtaaccaaaggacacaaggactgatgcaaacacatatatcaatttccaccatattgagttagatctgaatgtaatagactcaagcatatcatatatggtgtagtcaggattcaagtgtgaaagtaggaaatagcccaatcccaaacccaatagctgcattatcataccaccaaaaatgatttgatatgcacagtgtgctaggttaattttcgtattccgcaatacccatcctgttaccaatgatccgactgcaactgatatagaggggaaaatcaaaaagaggccagtctttgttacactaatattttgaagcaattgtaaatagattggtgacctaaagatttcaccaaatacaacaaatgaagatataaccgttaccgctgagctcaaacagaatgagcgagtcaatagttcgaatggtaaaattttctcagtcgcgtaataacgttcaaccaggataaaaacaataaagctaccaatggtaaacaatgctaaatacaacttgttcaactggctagagcacaaaaataaaactccactaatggtcgccaccaggcttaatgagccaaatatatctatccgtgacagattctttaaggtatatctttctttcataggaggaacatggaatagcttaatattaatgtttttgattgctaataccgagcacaacattatcacgggtacttggataccaaaaagagccctccatccaatggtttctataaatacaccacccaacggagcacctagtaattgaccaaacccgaaaacaatattcgcatatccctggtaaacgcccctttctcttgctgtacatatgtcactaacagcaatgctactaatagcattcaatcctcctgcaccaataccacatatggctcttgctattgagaattccgtgacgtttctggcaaaacatgttaataagcacccaaggccaaaaaaaaattgagcggttaataatgctgacttccgccctgttatatcagaaagcttcccatatagtggttggaaagccgtatttgtcaaaagaaaactcgtcgcaatccattgctttttacttgattcagagaattcctcagcaactctattcattatatttgcgacaatagtgctatccaaggaactcaaaaaactacccaaccatagcgaaaacaaaatgggaaacttaggtaaggccaaattatattcatgaaatttttgttccaagggaggggcttcagcttcctcaggtggagggagtagatttgaagtctcgtctagtgtttgcattcttcttgttccctcaacaactagggctctgagcttagtgaagaacaaagaggagacaaaaaacaaaataattcgatagaaaaaaatcgctgctgtattcttatattttgggaatgtgggttggcctaaagtggaaccgcatgctcttctctatcaccggcccttaagatgacctacgtttattgtcggacagatatcatccaacaaaacgacgcagtgaaaaagtgtatcatgcgaatactgaagataagataggctaagccgtggaatcagcgataaaaaaaagatcgcgtgtattaaccaatgacagcctcacagaagcgctttgatcatatatagatataggtgcatttatacacgtatatatatttacatgttttcagattagattatatggtaaatacgtgacagtgttctaccgaaaaagaaagatgtctggctttcaataaaataagcaagatatgtagaacagtcttcctccatttctttgtattgtgaaatatcaatcagtttgtagatggcttaggctcattacgtttttcgtttttttcttcttccttcctgattttttccgtttcgtaatcgttcaagtacttatcaaaagcatcattcctttctgggaaagggcgcttaccaagtaaatcaatcatatcttctcttgtcaaaacttcttttttcagtagtacttgagcaatcttctctacatcttctgctttttctttaagcagctttgtacatctgtcatggcattcttggacgattctgtatacttcggaatcaataatgtcacctgtctcgtccgaaaatggttttgtcaaatcgctatcatctctcttctggtaattgacccagccaattttatcactcatgcctaattctgtgaccattgccgtggccatgctagtaacttttttgaagtcatcagatgcgccacttgtaactgatgggaaatgtaattcttcagaaactcttccacccagagacatggtcattctgtccttaagttgctgttcagttagtaagaagatatcacctggcaaatactgtgcataaccaagggcgccctggccacgtggaataatactgactttcagaagaggatctgcgtattttaagtaccatccacatacagcatgaccagcctcgtggtaagccactactttcttctcttcgggagagagtagcttggatttgcgttccactccaccgatgactctttcgatagcttgttcaaaatgattcaattttactgcatcttcatcacttctagcagcaatcaaggcggcctcgttacaaacgttggcaatatcagcaccagaaaagcctggcgtcaaagccgctaatctatttttcaaatcaaaaatttccccggcaagtttcaaatgatgtaaatgaacagcaaaaatggcttttctaccctcaagttcgggcttgtcgatattgatatgcctgtcaaatctaccaggccttaataatgctttatcgagaatatcgggtctattggtaccagctaaaacaacaacgtggtcagctggagtgaaaccatccatttctactaacatttgatttagcgtgttctctctctcatcattggcacctgaaaaattacccttttgtcttgcttttcctatagcatcaatttcgtcaataaacacaattgagggtgcattttctcttgcagttttgaacaaatctcttactcttgctgcaccaacaccaacaaacatttctacaaattctgaaccagaaacaaaataaaacggaacaccggcttcacctgctgttgcctttgcaagcaaagttttaccggtacctggtggaccagatagaatcgcacctctaggaattttagctcccattttttcataacgagaaggttctttcaagaagctaacaaactccataatttcttccttagcctcatcgcatccggcaacgtccttgaacttgatcttaacgtctgtttcagtgttaaattttttagccttagaacgactcagaccaaatatgcctccacggctaccgcccgctgcttgtgccgatcttcttgtcaaccaaataatacctgcaatcattaaaacagttggcaaaatttggaacatagctttagcccaattgccttcttgaacatatagtacaggtattctgaaatccttatcaatgtccagttcgtcctgtgctttctgaagtttgtgttcgaagctatcaattgaaccaattgtgaaataatagaagttgcgaccgtaattgtcggcttggttttttccgttgtcatttaacatcactttcaccatggacttgttgacaacaatcaacttcgcaacataaccttttgccaatagtttctctctaaaatcctgccacgttatctcactttgctcttccaaactgttgaggagatccaataaaaacgaaaggaggaaaaaagttagtcctatctggaataagttaacatttttcgatacaggattactaggatcatttagaggtggttttgggggaggaggtggtggtggcggtggaatatttctgctattgttaccttcaaagtagccctgctcttttgttctgtttgacttggcttttgaaggaccattttcctcctctttttcctttctttcttcttgaattctgttagattcttgtttcaatacagcatcttctaaacgcctaatactttcatcaattttgcgtttctgttctttccagttagccggtatagtattatttttagtttgttcgatatatttttctacttgttttcttattgcttcaacctcttcgtctgtgggaatttctttgttaagtttagcgtcttcgttattgtcctcgttcttgttaccgctcttattctcttgcagcctattgagtagccgatattgagtatgtaaactcttgatatgggtcaagccgtaataggaccggaagcgaacgggccttctaactaccttagtagcaattcttgaccaagaaagtagcaacattagtactctttctaactttaaagttgcttgccaagactcttgagtgtgctatattgtattcgttggcagctcaaaatctttcctttaaaactatagtggcaaaagttagagatcgttttcacgagaaaatgatggggaaaaatggaccaaaagacaaatgtattcacaatgtgacaccagatagcttggtgattagtatatagatcttacaggacaccgaataataccagaagggactttcttattgaacgaaccgatatgtgcatgcgttatcctataaagaaatacgtccggatgggatattcaaacaagacgccggacaaaataattcacacatatggaggatgttacgtacatgagcacaagacgaaccgtacaaagagaaacatacatcatcactcagacgataagatcataaattagcagatgacactttagtttattctctttggtaggttttctacaatcagaattatctaacggcgaacttctgtaggcagagttttcgcatcgcccaatgagataatgcactttcaaaagaccacgctgcacttgcatcaaattggtttacgaaagagcaaagtcgaggattagcacattccgtgtgcccatacgttaccatttttgacaaagttggcaacatcaagcgagacatatctacaaatatacgtatcagaattgtacccgaagtatttctggttatattcgttgctaaccattttaacgtattcagcctagtagcctgcaagaactattaatacaaatcgtgaaacagaagttctttgagttaaagtacaaagacagacaacagccctcggtgaacctgttggtgtgtgtttcctgtatcacaaaacacaagcgagcaaagaaatacgacgttatagcttttaataatacgacgagacaatgttagtggccgtaataactttccaacaaaagtactttccaaactttgctgttacctctgtgattgtttagtacgaaaattgtatcgcgctgtcaacagcaaggggctgcaagtattacgtaagggtacactcgaagtagggatatatatttaaagtcccatcgtgacgctcataataggatactttccctccaaataaaaattcattgaagttatatcatcggtattcatatattattgacttaacagccatgtctcctatgaaagttgcggttgtcggtgccagtggtaaagttggacgtttattgataaaccaattgaaggccaacgatagtttctcaacaccattagcgattgttagaacacaggatcaagtcaattatttcaagaatgaagtaggtgttgatgctagtttgacagatatagaaaacgcgtccgttagtgagatcacagacgctattaaggcttatgatgccgtggtctttagcgccggtgcgggtggtaaaggaatggaaagaattttcacggttgatctggatggctgtatcaaagttgttgaagcatgcgaaaaggctggtatcaaaaggttcgttgttgtttcagcgctcaaggcggaggatagagatttttggtataacattaagggtttgcgtgaatactatattgcaaagagatctgctgatcgtgaggttagaaactctaatttggattacactattttacagcctggatcgttggaactaaataaaggtaccggtcttttgcaaccccttgacaaattagaagagaaggcttctgttaactactccattaacagggaggatgtagcttcttttattgtggaaagcttgctacatccaaatgcaacagtgaaaaaaaccatttcgttggtaaatggcaacgagccaatggaaaaattcattcaaagtttgtagatcaacctatttacgcgtgaaatgcatatgtagatgaatagtcaagaaaagaaaaagaaagtgagaatatatgaatttttttaccttgatttgaagataaaaatttgttatattgttacattgagtatactaaatatattcgttgcatttttcgaaattttgttgttcggtgatagcccttaaaacgtcttcatcaacaacgtcttcatagatctctttcgggatttccgacagtcccgttttcggtttattcaaatcgttatcgtgtataacggtctcatacacaatgcttgtgtcgctgggactatcgttttttgatctcctccatcctaaaacagtggttgactgtgtggattctggtatgtgtaatatatttgtgtatgcatctctcaagccttgttgatctacaagaagaaccttcactctatcataaaacaaatcgctattaaatctactacacgcagcagaatgctgatagagccaatttgtagagctcagcttactacctgatgcaataatattagaattactcatgtgaccatgtggcctgtgttcaaagaattccacctggttttttgcagggtttatgccattctcggaagcaggatacatcatggtttctaaggcccttgcggatttatcaataggatcaccagcaagttttccttcaattacatttccctttgttcttaattcagaagcataataatcatcggttatatgtttgccgccacgaatgattttagcaccaaattctttaaacacgcctctagcggtgactagagcgatttgtctatttctatatgaataaggtaaaacgccacggtctatcaagtcgttcttttgagtttgattcagaatgaacttataaaggttggggtgagtttgaaaaaataaatatgaatctctaaaacccactatcctagccggttcggtggccagcataaactttcgattccccttctcagttaatgtgaaggtgcgcactaaaaattctctgcctcctaatagatcaccatctgcagttatcttcgtctcaccttcaggatcatctggtagaacatattcttcattgaccactttcaaaggatttaagttctcctcagcatcatcgattccgggaaatactggttttttgaactttgaacggtttctagatctagtaacgcctttatcctctgacaaatcctcttcttcgtccacgtgcctccttttgtttcttccgcttttatttatctgttcctcctcatcacttatttcttcttcattcactccctcattggcttcttcttctctgtaatcatcatcttcattctcatcattttcatcaatatctaaatcctcagtatcaattgcataattgggtctgttgctagtagatcttgaccgcttctcatgttcaacttcggaagctagacctccctctgaatctgacatttctgctagatggtatttccttcttcaaaagtaaatgtactgtattcagtaatgcttaaactttataaagctgttttcttgcaatatttttgtctgctcacagtaacatgtttaatagttcgaacgggtttttttttaaaagagcgaagtaatcaaagcattcgggtaataattacaagtttatatggactgtggtaaaaacagtgtaaaacttttttatatctatttttctaaggttacgtaattgtttactttatattcttatctcactcgaggacaacattccaccttttaatgcaagcgtccgcaccagaactaaccaaggtagatggtgtttcccataaaaggttgttaacaccgtccttgtgagcattcaacgccttaatgattttcataggtcttttgacggagtaaataaaaatattggtgtctaaagaaccagtggcaactaagtcctcttcaatttcctcttcgtttgctcccttttcagcaggtttccatgaaatggcgttgattttactggtgtggaaagcccatcttgaagttttcacttctcttgattgtaaatcatatagcaatatcttgcccataacatctccagcagcgatgtatgtttcagatggcgaaattgatatgtacgagggttttgcgcgaagaggtgtttttaaatcaaaactgacttccaaatctgataatttgaatacctgaatagtattaccttcttccaaaccaactgcaacgtaattttggctcaagctaacggcagagcctggtgagttcagtcttacactcttgattatatcgcccgtaaaagactgtaatatcaacaaatcatcatcatttgttagtactgcagtgaagccatcattgttcgcactagcaacctttggttgcgatccaaattcatgcttagtaataccgttcactttcaaagtatcatcccaagaaatactggagtattcttgcgctttactattatccaatgatacaatcaagttggagtgatcttggtgcatggaagagctagaccattccataatcctaccatcatatgacccactgattagtgggttgactgtcaaagcagtaatacccttgttatgaccactaatggtttttaaaacctcgtcatgtccaagttcatagaagtttaaggtcccatccagtgaaagagaaataatccttccgtttcctgttgcaacaacaccaacttgttgatttcccagttgttgcttgtctaaggtccatttttgaacgcattttgaagtcgtgacgtcccaaaccctaatggtagcgtctgctcctacggtagcaaacttttgggaatcaagccacgatagtgcaaatataccaccttgaactggttcttgatcatcctctatgtatttaagaaactcacctgatttgccatcaaagcaagaaatctttctgtcagaccctaccgtaataacaaattcaccgctgtcaggtgaaaattcaacatccctgacaaatgagccttgtttgtggtgtgttctgtcactggcagagaacttaaatggaggtccttgataaaagacaacagatccatcatctccaactgtcatagatctcataggtctagattgcttcaaatgacaagcattgatgcgttgtgagtgacctgaaacttcacctaaggaattaccagaatcccaggatatgaaaacaccaaagttatcacgaccttctcccacaacgcagagtcttcgcccttcaaaatcccaggagatatcgctgattggacctgctaaaacttggaattcagacttaacattcacttcaacagaattgctttctttgtcaaatgtccatccccaaacaatcacttttccagattcgtcaccggagcataggtactgggaacccttaattggagagaactttaccgttgtgactaccgaagagccatgaccagtaaattgtactactggaggtactttactgtctccatcgtccaaacaacgtacaaatgcagattttccacatgggtaagcaattgcgttggttgtagggtcatacgataaatgcgtagtaaagttacgctgtgtcgaaggctgaggtggtataatttccttcaaagagatagatgacattatttttgtttactttgctacttttgcccgttaatataccttaaaaactgtatttgcgagttgcaaaaggcagaatagtgctgagttgcttccccttataattaaataatgatcattaatcaaagatctgacatatatgccttcggtagaaaaggtggcaggttacagggtgaaaacatccgtacatcatatacaattcattgtttcgaaaacaaacgaacgggacactagagaccaataaaaacgtttcagaacgtcttggtagcgttcagttctgattatgaacggaaagcaatagctagtattgatacacctccagtttctagtcattcaccccaagtaagcataatatttaacgttctgtgacctacatacctcgtaattagtgataattatcttttgaaaatttttggaataactgaaaaattttgaaaactttcgagctttgaagaaaaaacgatgcccatcactaatagaagtcccttgaaacagtttttgctaagaacaggcctaaggatcataatatagaaataaaatgtcgactgctaggcctagaataatcacttcgaaggctccattattgcctcaacagactaccccggagcagcgttactggcgtcaatacacttccgcacaactggttaaagaacataatagcgttactcacatatcattcaatcctcaacatcctcatgattttgcagtaacttcctcaaccagagttcaaatattttcttcaagaactaggcaagtgatcaagaccttttcaagatttaaagatgttgtctattctgcatcctttaggagtgatggtaaattgctttgtgccggtgatgctaccggtttagtgtctgtatacgacagttataatcccaggactatccttttatctataaacgcttccacacatcccacacatgttacgaaattccatacgcaagataacaaaattctggctacggcgagtgacgatagagtgacaagactttgggatatatccaacgcatatgagccacaattagagctcaccggagctactgactatgttcgtaccttatcatttatcccagcagccccacatttggttgcaacaggctcatacgacggtttgatcagattatatgacacaagatctagcggatccacgccaatttattctctgaatcatgaccaacctgttgaaaatgttattgcagtatctccaacccaaattgtttcttgcggtggcaataatttcaaagtgtgggacttgaccagtaacaagaaattatacgaacgtggcaatttcaataaggctgtgacatgcttggactatgttgaaaattttgattctccaatgcaatcggcgttgatcgcttcttccttagatggtcatgtcaaagtctttgatcctttagacaatttccaagtcaaatttggctggaaattttcgggtcccgtactaagttgtgctgtctcccctagtaccgcacaagggaataggcatttagtagcaggtttatcatcaggactactagccattagaactaaaaagaaagagaaacgttcttccgataaagaaaacgcacccgccagttttaataagaatgcgaaaagtaataacttccagagaatgatgcgaggctcggaataccaaggtgatcaagagcatataatccacaatgataaggtaagatctcaacgtcgtatgcgtgcattcgaaaggaacataaatcagtttaaatggagcgaagcactcgacaatgcctttgtaccaggtatggccaaagagttgacacttactgttcttcaagaactacgcaaacgtggcaaagttcgtgtagcgctatatggtagagatgaatctacattagagccgctactgaattggtgcttaaaaggtattgaagatgtgagatcagcatctattgtagcggattgggtcgccgtggttttagaattatatgggaatacgttagaaagctctccagttcttcaagaattgatgatagatttgaaaactaaagttagacatgaaattcataagtctaaagaagctcaaagaattgaaggtatgcttcaacttttaacgagttaaggaaatattagcatatagattttaatttgtatctattttatagatattcaggcatacatatatatctctttctcattgtaatcgaaaaaaataatatcttctctttttattgaaaaaaggaacctgtataaatttcattttagagtgctttgcattttgatacgttttcgcgtttaactaccttcgagggcttgaaaacaaaacattgtgagatgagatgctatcaacagaaagctgactgtgagtccccagaagtccatgtcgcttgatgccttctttcaatcctgttagattcttagagttaccaattgacattagaaaagaagtttacttccatttagatggtaatttttgcggagcacatccctacccaatagatatattatacaaatctaatgatgtggagcttccaggaaaaccaagttataaaaggtctaagagatctaagaaattattgagatacatgtatcctgtttttgccacgtatttgaacattttcgaatactctccgcaactcattgaaaaatggcttgagtatgcattttggttgcgctatgattgcctggttttggactgtttcaaagtaaaccatctttatgacggaacgcttatagatgcattagaatggacgtaccttgataatgaacttcgactggcctacttcaataaggccagtatgttagaagtttggtatacttttaaagagtacaagaagtgggtgatagacagtgttgcttttgacgagcttgacttacttaatgtaagtaatattcaattcaacattgataatctaactccacaactagtagacaaatgcttatcaattttagaacagaaagatttattcgcaacaatcggggaggtacaatttggacaagatgaagaagtaggagaagagaaagatgttgatgttagtggagctaattctgacgaaaactcctcacctagctccacaattaaaaacaagaaaaggtcagcatccaaaagatcacattcagataatggcaatgtgggagcaacgcacaaccaactaacaagtatttctgttataagaacaataagaagtatggaatccatgaagagcctgcggaagatcactgtgagaggagagaaattatatgagttgctaataaattttcatgggttcagagacaatcctggtaaaacgattagttacatagtgaaacgtaggataaatgaaatacgcctatcacgcatgaatcaaatttccagaaccggactagctgactttacaagatgggacaacttgcaaaagcttgtattaagtagagtagcttacatcgacctgaatagcattgtctttcccaaaaattttaaatctctgacaatgaaacgtgtaagtaaaatcaagtggtggaacatcgaggaaaatatactaaaggaactaaaagtcgataagagaacttttaaatcgttgtacataaaggaagatgatagtaaattcacaaaattttttaatttacgacacacaagaataaaagagcttgacaaaagtgaaattaatcaaataacataccttcgatgtcaagcaatagtttggctatcttttcggactttgaaccatatcaagctacaaaatgtatctgaagtttttaacaatatcatcgtacctagagcattgttcgatagtaaacgagtagagatttatcgatgtgaaaaaatctctcaggttttggtaatataaaaatgtggaaaaccggcggtattttaattagaaacaaactgtctgataaaccaatcatgaaatcttgtatcactgtcagcaagctctggatgaaaagaagtcacaaggatattatgattttgcgttgcagctacaaccacatcctttccattcactggcaattcatataaacttttaaccgcgataggatcaagaattctctcgatcacgggtgcgcgaataaatgtagcaggaaaattatcacagccaggtatgaaattggaaaaatcacacttttgtgtaaaagattgagcttgtcttccaaatgcgtttcttctcacgtcgaccttcaacacacctaaagtctttactagggcactttcgttttctaattgcgcgcttaaaaagatgagaccagcacaagtaccccaaactaccttttccggattatgaacaaattcgtataaacaaggatataagcctgttctttgagcgatgagggacatcgacgtagattctcctccgggaataattaaggcgtcgcactgggctagatcctcaggagtttttacagttttgatttctatctttattccgtagtcgttttcagccaaacacctttttaaatggttggtatgctccaaaaaggcaccttgcaacgccaaaaccccaattactttcatcgactttccggacattgtactgtgggttttgtgcatactttaagatatggtttttctttctatttaacgaaatgaaataataagaaaaaaaaacctggtggcatcaacgtgatttttggaagaaagaataaaacattcaaagagttcgtgaccagttattgctgataaatgccgtttactgactcagttggaatttatggcactagttggaatagctcatcatgacataatgactcagccgacaagggtaagggttgaaagccgggctttttcactacttttcaggtagcgccgccatttcttcatgactctgacacactctgccgcaccgttagttacgtctgtaattctggctgcgaagtaccattttcgatataaataggaggacgctgagagctatggacgaagtctatggtattgttggagaaacctttaggaacgactagcaaatatacacagtactaatattcagttaattatcacgatgactggagaagactttaagatcaagagtggtctcgcccaaatgttaaaaggtggcgttattatggatgttgttactccagagcaggcaaaaatagctgaaaaatctggtgcatgtgcggtaatggcattagaatccatcccagcagatatgcgtaagtcaggaaaggtttgccgcatgtcagatccgaagatgattaaggacatcatgaactccgtttccattcccgtcatggctaaggtaaggattggccattttgttgaagctcaaattattgaggcattggaagttgactatattgacgaaagtgaagtcttgactcctgctgattggactcaccacattgaaaaggacaaattcaaagttccatttgtttgtggcgctaaagacttaggtgaagctttgagaagaattaatgaaggcgccgctatgattcgtaccaagggtgaagctggaacgggcgatgtctctgaagccgtcaagcatataaggagaattacagaggagataaaggcgtgccaacaattgaagagcgaagatgacattgcaaaagttgctgaggaaatgagggtaccagtttctttgctgaaagatgttttagaaaaaggtaagttgccagtagtaaattttgctgcaggtggtgtagcaacgccagccgatgccgcattgttaatgcagttgggttgtgatggtgtgtttgttggctcaggaatttttaaatcatctaatcctgtaaggttggccactgcagtagtagaggctaccactcactttgacaatcccagcaaattgttggaagtatctagtgacttaggagagttaatgggtggtgtatcaatcgaatctattagtcatgcttccaatggagtaagactttccgaaattgggtggtgatttctttgaacaggtattttgagcattataacactttttcccccctcaactttgtattactcggtacacattgtaaaatgatctaattattagataagcttatgtatgctggatattatttactagaatacttgattggggttcccttttagtttgttagacaatccctcatacgaaagatctcctaacttttccaattgatcatttacatagtttttataagaaaactcgtcattattcaacagtacctcagggtcaaatatgataccctttccatgcaacctccatttgttagtccactcgatagccgttgatttttcattttggcttttattcacttgaagccttcttaaaacatcatatatatcatttgtgggagaattggtgcttccagggtaaagctctgttcttccatcgttcaaattttgcaagttcattaggtataaaaggtaatccgcttgaaatattggatctacaaggttatttttaacactaccacacaacgccagtcctagcattctattatgatctgaaacgcgaccgggaacaccgattcctggagtatctatcaagtatatttcatttcttgattccgtattccgtgaagttactctaataacctcgcttgtggctctagtaacaccagcttctgcaccagttttggctactttcttaaattttcttcccatattcacttgattgtgaaaaattgtcctcaagctatttattaaagtagattttccaacatttggcatgccagtaatcaatgctcggtatcccataggtagatatccgccatttgtttctagttcgtaattttgccattctagtatttttagtagattcctgacgtcagttttgtttcggcaatccagtaaaataaacttttctcccagctcttcatgccaattctttaactttcctatatatggcttattgccgggcataagatcctttctagtgtataccactaatttcatcacatcgtgttcctttcttgctattcgatcgaaaaccacattccttgtagataacggggcacgtatatcacgtagttctattatcatattcatttgaggaagcaacttttcaaatgttttaagagctttgacttggtgtcccttgaaatcagtgagaggcatactgtactttggaaattcatatcttggtgtgaaggatgaaacgttggaaattattttcctagttcctctcacatttatgtgcatttctgtatttgatttggcttttttgcattcaggtctgagtaatgagcattatcattcgttctttcttctcctaataactaaaccaaattgtttcgaaaagacaaaaattgtgtacttttgacatgatggtccgtgttctttgatctgcggcaaaatgaacctaccatgtggcagaattaaatatttgattcaaatataaataaggcgaacgacgagagattaagatattatatacaggtaatactattgattgtttgttccacggactaggaattcttccaatgtggaattctccattccagcggtttttaataacgctttaatggagttgcataactccggagttacgttaacatttaaacgtctgatccatagcaaatgaccattatttacgattttcgatataacgtgactatcaccgctttgattgataacatttataaattcattccagggccttttgtcctgaccttccccttccgttggtgtgatagcttcccagacttgaagtagcttattccagtctttgattttggccaagttttgcaatattgagacaatcatgcctgaagtcaacttatctccaaatgtttggaaaatgtggtctattgtctcgtagagtgatctcaattttacccgttcatccgcgaccatggaatttaaaagaagggatattaccacttcatcgtaaacaactgagccatcgtcctctgtttgtagacctttaaataggttcaaagctctgataatcaccctattttgctttactaggttaaagtatgaatgactagaatgctgcgttttcaaaaccatttctaaaagagcgattagatcttcccttattaactcttgccccaacgatttttttaaaagtagataatccttgaggaaaacacgatctgaataaaattgtgggtctgctttgtttagaagtatcgcatattctagtcgtagtggccaatatgcagccgattgatttatggttaaaaaagttgaatgttcgtcaaataaggacttccattgaacaacatctactttcctctcttgtcctaccaaatcctttaaagtatttttaacatgctccaaagtacgtatattgtgagtttcagtaccactactactctgaattatcttattggctcctttgaagtcttccttttgtagaaagtatcttaaattacttagcccgtttgggttgatagttgaataccttctcctttgctgggccagtcttcttaggcctaaaagaatattattgttgcttgaaatttcatttacccctgaaatagtagggacattacctgaatctatattttggaacttagatttctcattttcaggtgcatacagctcttctaaattcaattcattacgccttctctgtgtcaaaatatttacaaaaataccatcgacacgacaatcaatcatataccaagcctcactatttaagtcttttgcagagcattcagagcttctacctaatagtttactaaggttggattttcttgctaatcttctttttcttctactttcttgtcgctcattaaagtttccttcaacgtatgcactactacagaattcgtgcttcaaaaacttgttcaactctaagaaacttttatgacaatgtttggtagatcttgctgtacatatgaccatgaagtcacccaacttattaacggctgaaacagagtttgggcttttcttccgtaaatcgaaaaccaggaagtcatccagaccaagtttaccagttaggaggtctgctatttttcttaatgagtttggagaggttttaggtatctccaattctttgttcatcgtgtggtggttatttttcttaccttccattagttccttttcattgtcaacaatcctgaggtaccaaggtgtttccagaggggtaaaagtagactttttggatacacgactttgttcatgactgtcatttttgccctttgtcgagtaataaactgctgtgatgtgactatgaagaaaataagggccctttttgaataatatggtaaaaggaatattggccacgcctatcctcttgccatggaaaggtagtagacagaatttattcatgtcaacaaacctcaatttttgaataagcaggctattacacttaatcttcacttggtgtcgatctttcttagtagcttaacttgctttttttttttttggctgaatggtcctcattgtttctctttatcgggatgaaaagcataattatcagaagattgcaagtatattagaagagaggttagaaaaagatgtcaagaaatactagtaaaaacaaataccattactgtgtactagagtactatttaagaaagacggattatttctaaagttacgatagttcggatgattgtgaccccatttctaataaaaccaatattatcaggtatatagaaatgctgcaggatcttttcaagcatatatgataccaccaaaaaagtgtaaaatcccatataatataacgttcttctatttgtttcgtacagttcgctgattggtattattacatcaggaatattgtatgttcgcttcgttaaagtttgatcgctgtttcctatatgcggcgtctaatatatagatgatgagaatttgacaaataatgagaattgttaggatccaattatacttaacagctataataatagtacacaaaatatactaaaagttctcctcgaggatataggaaccctcaaatggaatccatatttctacataatagtattacgattattcttcactctgttttacatgtttcattatcctattacattatcaatccttgcatttcagcatcctctaacttcgatgacagcttctcataccttatgccatcatctaacaccgtatatcataatatactggtagtgtgactactagttgatagacgatagttgatttttgatttttattccaacagtcctgatgataagttactgtcaaagacataattattatcaaaatatatggtattagatggactggtaaaagtacaaaacttcagaaatttgtccgtgatagtttaatggtcagaatgggcgcttgtcgcgtgccagatcggggttcaattccccgtcgcggagatttttttatcagaccaggtgggtgttgtttgatcatcacaaagtagaattcagtgtcatttttaaaaacgttacttaattttacgataatatgctgccagaacaagtttaacaatacgcttttggcaatttgttcttgctgcacttggaattaaataagagtcttagtaaacagaatgttgctttagttgttcgtcaacaaaaacaaagataaaggatggaggtaatcaaatagcccacattaagaaaagtatacaactgggaatttactttataaaaattaccgttgctacatttttttatattatttattgaatagcttgatatttcaattcttctttgcaaagtaattgataagcattccattttttaccaggagccaaggaaataaaatcatgaacatgaccaggttcaatacatatcatttgttggtaaccagtttttggttcgaaatcggccatcccttgagacttctcaatccatggattccaaacaacagtgtcgggcaagttgtatctttttagagtgtgaatttgaacgcccttgtcaactatttgaatggcccgttcggcgctgacattctgataaattacatcggtttcttgattgaaggtaacgactgggtgcttgtcgacgtaggattccttcaacagttggtcataaagtttcatgccagctaaattagagaccattgttccttcaatatcttcgatacggaagtatgtatggaacaaccagttgaactttaattccttggaactagatgtgttttctacttctatggcagttttcaaataatcggagcctaattcaacagtcaaaatcaaaagataatccattggccacaatttggtcaattctgggttagcaatttctggtttcaagccaaattgtacggtcggtgggttttccttagtttgacccaaaaactcccaagtagaatttcttgcaagaccatgttgaggtaatttactcaaatgttcatcggtgctatttttcccgaatacaggaaagaccaaaggtataccacctctcacaggtttgctaccatccaatttagcagcagtagacaaccacaactgttcttcagatttcaatttccaagaataaactgtagcaccgtactttagaatatgaacgctggtggtctcatcagctggatgagtcaaaacaacttctttatcagtttctttgataggcatggctttgtgttttaatctttcttggttcaagttttaccaaaggcttataatgaacctcagaatcacctctttattcatttctagggacctactaagttttctttcggcgtgaaaaataaaaggcgcattggtgaccccatttgcgatacctttttatggaaagacagcttgaagaaagaccttgttatcattgactgcgtctagcgaacgaggacatctacacactatttcttctgctgcaatgattgatgccgtttagatgaatggtcgggacgtaacttatgttttaagaagaaggcacttttcctggtgcaatagatgaatctcggtttcaagttaactatataaatatggggttggcattatatgtcatgctttattataattaggcatataaaactacatggttatgaaaggcgctggcagtaaaagggttgtttgtcaatggcaagaattaatcattctcgcattgaaatatatgtagatcgaggtgaactgttagatggtccatcagacatttattattttgacttatgtatttccctctcaattttgttatcagtaatcgagtcatgtgtactttaaagttcatattctcacgtttttcgcaagatattagccgccaatagcaactccgaataataagagctatataaaggccgttgaagcccacggaaagagaaagaaaactaatagttattacaatatagaccgttggttttttctttccctcctggagcagctgcgtatagttactacctaagaagtgggctagaagttggctagaagtgggctacttaatatatatctttggatacatagaaaggaaccaggaaaaaggaaaattatttagatggcttccataagtttatgatggttcaaacggcaaaaagccttttgactatttttcttggttgaactatcttcttattaggcctactacaacaatgcatcgagctaggataacaactagaatactttggttatgtattgtatgggtgttcagtggcaaaatttgagagttgggttattgatggtcggcctatacaaacgaaagacctagagcagctcacaaggaagaaagtgctggacaaacttccctacctgaagagaaaaatatccgttttttatatagtttctgtaagtgtgcacagtgacttcctcattagagcgatatagataatttgagactttatttattttttatttttgttggttctcatattcaaccttccatttatctaagttgaaccattaaacattcccttttttactttgctaatttcatcatacccattgatcaactataagtgaaacttgggaatcttccattatacaaaggtgaggtccctatttgttgcatttttcaattcatttccctgggagtttttgtttgtttttgctatattaacatatcataacagcgtatagaacgtaatttgaaatattcaaaacaaagaaaaggtaaagaaatgagagactctaatcatcgatcattaacgtcgaacaagcctatagtaacaataacatctactgtctatgaccgaagggcattggatatcaactctagtattccgttaataaactccctaaactacttaacatatctaacctctaattcatcaaaagttagggaaacggtagctaacgacggtgctctcgaaagattagtctcaatattgaggagttgtcatttaagtttgtttgagttgctggatttggatttagaaaattttaatgagcacgaaaacataaaggatctatggaaggagaaaagactagcactatgcgcttggaaatggactttaacatttcagtgcttagtattgacaggtactagagggacagaacaaattcgtaaaaaagtggtaatgtctggggtcttatctgtgctggtcacagtattggataactatttactatatcataaaaattacgacttcatcaaagatcaaacaatgacctttgacttcaaagggataaccacggagacaatgtataaattcatgagaaaagatgagaatgaaacatatcagcagtatatagagttcattacaggtcaggataaattgaagttgtcaactgacaaaaattttctaaacgaacgattagtggcaccgtctatgacaattccaactgattttagtgatatatggggccggtttgcagacctagctagcaattttgaacctgaccaggaaagacacgacgacgacattgatattgatagtgaagtagaaagtgaaaattttgatgcacataagaatttcttttcgcaaccagacattaatagacctacaatttccactccacgtgaattttttctcggaagaattgtccccaaacaagacgacgttatatggtcgcttcagttattagcttttgtttcgaagtatacatatatgaaatcaacccttcaaaatgttgagctggttgaatccctatcgttcagaagtatggcttacaaaattaaacagagaatctcagaagagaatgacttagaagaacaagaaagagacgtaactgtaaaattgtcttcattatatccttatttatcgaaaaatcctgaaaacaattccaaagttaaggcactagatactagcaaaatggatccatttttcaaagaattagaagaactctcaaacagatgtcaacaagaagaacaaaatgaaatatgtaataaccactgtcccgttcttaatttgtttgagcgctaccgtgtaccgaaacctagcgacgacaatgcctatggcaaagacaaggaaagaattaatttaaggaagaaaatatctgataactttgaaaggcgctggagctacgataaaatgaaaaaggaattaacaaatattgtttacaaaaacaaggtactaacaaatgttgtaaacatcttccccttagtcgaaaaatatacagtgagcgcagaaaatacacatgatgttatatattggagttctgtcatcatgagaaattcatgtcgaaaaaatgagatcttaggtgtgcgtcagtgtgccaatttttcgtgcggaaaatgggaagattttccaagacaatttgcaaaatgtcgtcgatgcaaaagaacgaaatattgctcacgaaagtgtcaattaaaagcatggggatatcataggtattggtgtcacgaagttggatcaagtcatatgagatccacgaatactaccacaggtgtcaataccccaaatgagcctagttctttaaatgccaccgctactacagcagctgatgtttcgaattctaccagtacgttcactcctaatatatccaccaccgtacctgatgaaataagcaatagggatgaaaatagcatacctgagtaaagtacaaggggatttcgatgacctaggtttaacaagatcatgaaatattcattaacggagttttttgttttcgctttttttattttttgttcctaattttttttttttttacattttattagctatacacttggcgcaaggatattttatataccggatataatagataattaaaagactactaattaaaaatgatgtaatatggtaataggtatggaagaatcagggagttttcagaatgttctttgccctctcttgggctttctagttttgcacttttacttattcatctcctgtaaccgaaactgaaatgggggggtttggaaagttgtacaaagacatagctgttttcttttttttaaatattgaaggaacgctttcatgtattttttcaaacaatgagtgattcttctcattatatttttgaatggtggaaaagaaggaccatttgagaatcatcaggtacatagcaaagaagctaaaatttggccacaacgtatcactaaattcaatggtggcattttcatgtacttgccatagcatatagtctgagagcctcctatgcccacttgttctgattaataattcacatttattggaatggaaacccatgtacattttattagtaaattttcttatattaatccttggtgatttattttccaaatggtcttcaactgaatcacgaatagtatgtaacatatcatttcttgaagtgtaaggaaaacatataaataaagtgaaatcgtctccatcctgtgtgatttcttccacttttttaattttttttctcatttctggagatagtaaagattgatcacctactattcttattttagatccgtataagggatccttatagtccttggctctttttgcgaattcatcaagctttaccgtaaacaaattcattagcgtatctacttcttcttttggtctattaaaattttcaatagaaaatgcataggcggaaacacattttacacccaatcttttgcagatatacagtagtgttagtaacgttaacccaccagcttcatggcctttttttactggtagccttcttgacttggcatatctccggttaccatccatgataaaggagacatgttcaggcactggccctacccttaatgcttttatcaaaatattctgaagatttacataaaaccatgaaaacaagcttaatgacataacccacgcaaatactctctgaaatatacttttcactgcgaagcacatctgttctttggtttctaccaaaagcctttttagggctacaaactgaatctgaataatactgggcattttcattatggtcaacagaaacgtcctatgtttgaaaggcagcctgttctttataagttgataaattgagaaaagtgcaccaaatcttaatctactctgtgtgtatttttaggtcccttaaataacagaaaaagtatagctttagccgccgaggtccactcagtttggagtagttacccttaacaggcactcactccgttttgttctttcgaagagatacgttatagtatatcggcaacaaatgataggctcattgttagcgttcattaattattagattaaaatttatttaagtgtatcgtgtttctttactttatgtacgaagattaatatgcatttaaaggtatcatccacggaaaaaaaatactccatcagcgttagcggaagttattaactactgtaccgcagtctacgcaataatagtttctatcttgttggtcattagcaccagaaaaagcctcaaaccttgaaccgttacaaacattgcaacggataggtaaattcattgcgctcgttggagtggtaggcccatgtgcattggagaaaatagatgacatgctttcccttggtgttcttggctgtgcattactgccgagtgtttttagtgatgtactgcttttgggacatatattagagtatccacgtcccgttgcatagccttttccagtattagtatacgccgctgccggttggccagccaagtttgatttcgctctcgagttgaagcttcgactcaaagaatgcaaagaatcagaactgttaaaccttctccgaacctctctattgtattcttctagtttgagtaacacgcgctttcttataacagagggcatatctgctctaaacacacgaatagtccctacgttatcagtactgatcaatatcgttccaattgcgtcaacgacatctgggatagcactggtggcggaagcattagaaattgagcctggtttagaattgtagcccaaagacgactctacatctgacattatgccatcgtcgttactccgactcaaaacatcgaaactatcggatgtctgaaaaaactctagagatagctcgcagataacatcgttagacaaagataatgttttcgaagtttctggcggtgcaatgctaacacaagtaacaggggcattgtgtgcatgaaaagaaatgtaatccgtatttttgatataatgatcgttgctatgatgaggcaagggaagtaagttagtaagttttaaatgatgatgtggtttttcttcgttattctggctggaagacctactcattgatttactaaatatgcttctcaaacttccggaccgagccaatccctttggtttccttttaggttcgtcttgatcattctctctatccgaagactttaacctccagccgtaaacccaatggtcatcactactatttacaacgattggctgaccatgccagatggacaattgtgccttgtgttgggaagatccgctatggaagcctttcaatacctctagaagcttcctctgttctaagtcaaaaattcttatcctcgaatcattcgatgtaactactaagcggaaagaattgtccagttgagatctaaaagcttgcaaacccgtcacacgtggaccatgacgaatttttgagtcagtttccgtgaccatgacgtgagcgttttgttcttgtgtttgtctatcagctacgtgaaatgaagaaactggagtgagacctctggtcatcagaatatgaacgtatccattaaatgttcctattatagtgtattttccctcctcaggggataatgtaacagatgttattaagtcttgacaatcgtactcaaagctaacttcatcatccagtatagaccataacctgcatttgtgatccagacagccgctaatgaaaaatctatcgtcggtggggtgaaattccacacaagtgacaaaatcaggatgtatgaatgtcttaagtgaatttttcctatcgggatgccatagttttactgtcttatccatcgatgctgacaaaataaaattatttttagaccaatttatatccagaacatcttgcacgtgttctttatacagtcgcaaaggcgttgggtgaaagacaggcgcatacaaattcaataatttttccttctcttcgtatttctctgtagcagaatccaaaaattgtttttcttttggattgttcaatgaactgacctgctgtttgatccgcatcgacttggctcgtgcctctttatttgattccgcactcgagtccaattcggctctttcaactggagagccaataactttccatattcttattttaccatctttgctaccagtggccataaattttccatcgcggctaaactttgtactccatatagctttagaggttggttcagatgatttggaagtggaggtaaccgtttcaccttcgtaggccattagttcttgcgcgagaaacaatcttctaaattgtttcaggtttttccgacgtttcaacattttaatgtattttggctctctcaaatagttttcaaattgctctgtatcaatggaattgaaagggtaaaactcattgaccctaagattcgaatttaaagtattgcctctctgtaaatgttcctttagtctcataaatgaatcagtggcgttgccgttgttactatattttaatttgtcatttgtattattagtttttgtcattctgaacttcaatggctcgatatctgcagaatattcaagatttagtttgcttttacttttactttcaccggaactggactcgccgtcgaagctctcttgatgcgaccgactctcctcttcagatccagtggtattcgaggaattgctgaattcagaatgtaccttgcttatacttgttttatcctccgccatattcgtcatatttctaattctcgtactatattatacgccactaccgtatacaatatgccaagagctcagcaactgctttctattctttttctttgattgtctttgttcctcttttccctctttcttttcctcctctgtttaacaagttggagagagttgcagtcttgttccctatacggtccagctgtgacttgtacgaacgcgtattgtatcccaggaagaaataatgatgtaactcgcttacgaagcttaagaaagggcaaaaaaaatgtgtcccccctaactgcgaaagtgaaaaaaaaaaaaattaatgcgttgaatttacacagttctatgtataattaactgctacgatagaaactggacagtagtaagaaagattggactaggcatcacccagactttactttttcggcatacatatctatttatatatagtttaatacgtaaatacaaatatatatatactgtaaattttaatcattaagcttttcttttttttttgttcacgctttcaccctgtgaggcgaatgaggttagctttttccctttacgggactaggtaaggctccccatggctgagcccgcgcaaggaaatccaggatcatccgcggaagaaataagctgctcccggcccagactatgtaagaaaagtggcaacaaacagaaaagcgaatctttcctttcaggcaatgcaagggtcctttgccgtttggcgaattccggtaacctcgacttgcgccccgcgggcttcgctttgacatccgcgggtataagcgtccgtccttcggccgacaacaggtcggtctttgatctcaattccgtagatggaagaattctgataatgctgtaaaagaaatgaataagcaacataagtcgtgtgagagttgctaaaagaagagcgcagcctctgcggaccattctattttctgtagttcttcttgtccccgttaaccacaatagtaacggagtgcgtatcgcaatctacttgaactatccatttttgaaaattgcaacctcttgcggctatagctataaattccgtccggctcggctcggcttgcttcggcttgcttctaactaatgcttctcccctgcgaaggagaatcacccaactgttcgtcaccaatgtacgtccacccaccaaactgcttttgaatacttgcacttaagtactcgtccactacactatcgatcggtttttccttagtgaactcttgatcaaaatttgcagtatctatttcactctttacaattggcttgtaaggcggaatatagcccttcaaaagtagctttttccatgagatgtctttaaagaaaggatggttacgaatttcatctgtaccgttaacgccgagtcttctgcttgggtctctgcttaagaggccaattaataggtcttttgccgcagggtcaaatccatcaggaaatagtagcggttgctgcagaattttcttgtacataacaggaacgttctcatcatagtatggtggcagccctgtcatcatctcatacagtaagatacctaatgtccaccagtcaactgttttagtatagccctgccccaacaagatttctggtgccaaatattcgggagtaccacagaaagtgtctgttttgtcattatccttcatgttcagcttgcaaagcccaaaatcacacagtgcaatatgtccttggtaatccaatagaatgttttcaggctttaggtcacgataaatgacgtcaagtttgtgtaatgaatcgagagcacataatagttctgcaatataaaaacgggagcgtgctagactgaatcgtccctcgtgttgtaaatggtagaacagttcaccgccattaatgaaagctaatactaggtacaacttctccggagattggaatgagaacttcaacggaacaataaaggggcagtcaactcttgctaggacagtcctctccgctaaagtatgtgtcacttcacatttcgatacaatatatgcttttctcagagccttcaaagcgtaaatcttttgggtatcttttttccttacttgcatcactttgccgaacgaacccttcccgataaccttcaatagatcaaagtcatcaatggagagaggcttgttcttagaaggtttgtagtccaccgtgatatttaatttaccatatcccctttctaaagaaatccaatggtgattgtatagtcttatttgggctgcagaatcgatttttaaattcaaaggtaaatggaaggagtccaaatggatatcctgatttgtattgattttttttaaaatctccttcagtacttcgtcctgctcgccaatctcctgttgccagtttttagagggtaaaagtagggatggaatccttgcaaagacatcgatttttaaaaatcgtaattttcttgttacatcaaatgtcgatattttgttaaacactggttgctccatcgttcccatatctggactaatagtagtaatagaattatcaaattcaattgtaaaataaagtaatgggcttgaatttgttgacccaggtaacaatatagaggaaggaatgaatttagtggcaaaagctctatctatcaagccttcccctgctgaatcttgatccactctcttgtatcgtggtagctgccgcattatggctgcaacttcggaagcgtcattggatgatgaagtaaggatgccggaacttagtagtttttgtaaaatagtagagttagaggtgatagggaagggaagagtaaaatctttaccagaatacaccttcactgtcattagtccggattccgaactcggtccctgcgtctcagtagacgactgactagctttcctttcggaagccttagaattgtcatttcctatccccgatggattcttgaaggatgcatcattacgtaattttggagaacttaaggaacttgggagagtctcatttgtattgatctttcttatatggtgttcgtgttcatgattatgattcttcgggctaccatcgtgatgtttttctccatggtggaaatgaaacaggccattaccccacgatttttcattttcatcttcactactcccatcatcttctttggaccttcctaacttaaacttggatattcgccaggaatgcatgttactatatgtatatttgtatacgcgataatttgacccagttgaacaattctggtttaggagcactttggctgaattttatcattttatttataaatctaaggatgacggccattttacagatttctcgagggaaatataataaaaaactcggggtaggtaatctgaattcggggatacgctaatttgggaaaaattcgtgaattagatataattagaaacagcacttatgaagaagatactgcgattaaccaaaatattctcctccttatgaaaaaaaaaaaaaaaagactcagaaacctatgcaatcgtttgctaatatgtcgaaatatggatctattaagtatataaagtatgtgttcaaaaaattgaaattttcttctttaccgttaatattcattgaaaaaggtgaaaatcattaagccattagtaaatcattcgttttaagtacgaaccgttggttcttcagttcctaaaacttgtttaaagttcaagaacttgatgaccgagttaataattggcttcaagtattcttcagctgtcttttggtattgtgatttatcatcgcagtatttttcaatgtacaatctaatggtagcacctgaagaacctgtacctgacaatcttagaacgaatcttgcaccattggaaagcttgacatataaaccttgatggtcagaaacagaaccgtccaaatctgtgtatgaaaaatcaccacaatcggtgaccttaagagactcatcggctgggaaggcggaattaacaacacccgatttggtaacatatgctctcaattgatcgacaatcttgttagctttttctgtttcaactttttcaaaatcataacgagtgaagaaagtacggccgtactttgcccagaattcattctgtatcgtcttaatagaagcttcgttctccggatgatgcttgttgtaaatggccaagatgttcaaccacgccataatggcccaaacaccgtccttttcccttacgtggttggaaccagtaccaaacgattcttcaccacaaatagataattttttagcgtcgaacaaagcacagaaaaatttccagccagttgggacctcataacagtttagaccatgggccttggcaacacggtctatggctcctgaggtagggaatgaacgggccagaccatatataccttgcttggcgaaatatgggatttcagctgcatattcggcaataattgcgacggagtcacctggagaaacgaaagatgggccgtaaccgtaaatcatatttctatcaccatcaccatcggatgcagcaccaaactcaatcttttcacgatctactcttttcactaacgaactggcataagttaagtttggatctggatgcataccaccaaaatccggagaaggatgccagttttgtaaaacctcatccgccggtaaaccaaattcatcaacgaaaatagccttaccgtatggtccagttacaccgttcatactgtcaaacagtaacttccaattcttagtagaacgttgattatcgatgaatttcttgattaagtcgaaatcgaagatttccttcaagaagttgacataatcttttgtaatatcgataatgtcaacgagtaatggaccgtatttcttgttcttgcctatcgtacccaagtctagttctgggaagtctttgataatcttatagctggtaagctttttggaaatctcccaaatagcatttgtgacggattcaggagcaggacccccattggataagttatacttaatacccatgtcattttctggaccacctggattatgtgaggcggttaagataataccaccagtacatttttcctcgtaggttctcatgatgtgagaagcggctggcgtagacagaagaccatgctggccaataactaactttttaataccgttggcagcaccgatagcggcaatcttatgaagaatgacatcattgtagtaacgcccatcaccaccgacaacaagagtggcacctttagaaccctctggaatagcttccatgatcgattgaatgaaattttctgtgtagttaggttcgtctttaaacacctttgtcttcttacgcaaaccagaggtaccaggcttttggtcttcatatggtttggtgggaaccgtttcaatttgaaatgacatgttatgttaacttttgttactttttttactgagaaagattggttgatcttcttcttattatcctattgttcaagcaacgctgaagaaagacatggaacactatcttcgaaaatgaaacaatattaacggtacctttttatatttcccacattgttcgggcggcagtcatccagattctgaaagaatcaactatttcttttacacttttcaacccctgtttgttcctggaactgcacataacaaaagtataacgtcccctttcacgtaagttccccacgaaaaaagtagtgcgcgacaccaccccttttcgtgagctccgcgcttctcttcaccgagcctaagttgggcctctcccccctagaaagaacaagttggccctgttgtccttagctcgcaagctcaggggcagcagcgtgtgttgagattagagaaccgctcgacctcaacggatgatagtatgattttagtacatacagggaacgtcctctacccacgttttattgttgttgcatttacttttgaacagcgacaggggggaaggtgtaaaggaggaaaagcaacctgcatggctagtgttcaaagttacaaggtaacaatgcaaatcagtagtatgacaattatttacccgctatttatttttttttctctttaactgtggtgacgaaaacataactcaaaggatgttagaccttttttaattattgctattgtttggacttcccctactgtgttgttcaccgcgcttcaatagcgtttctaggtccgggatcttttccctctcaagctcagtttttagttcggagtcgagttttaatttgtctactttcttgatgccgagcacttcaaccaattttgtgctatcaaatttcttgtgcgtgtaaggacttattttgtttttcaatgagtcaggaagctctgggatttcaaattccctggaatcattgatcatcagttggtgaatccattccagtagcacctgttgttgcctgtagacaaaaaccgtgggtattctaagaggatcctttttgttttcctcttggtctttatttaaagagggaagtgggagagtggtgtctgttgttacttcgcctatgggttgatagtagttgcctaacggaatctctggtagctcatctgtatccattgaatctacaaattgttccataagctcatcgatttgatgcccgtctgtttcctttttcagcggtaccccggatgtagttgttcgatccagaagttttggaaaatcagttaccctctcgtcttccgcgaatggtaatctacacaaggtaaggctcttaacaaacttcttctcggaattaatgttactgtgctcaattagaacgggacacaatgcacacatattcacttcactgtctttcttgctcacatatcttgcaacagcaatttttctattttctagcataacatccactagagcactgaaagccattaagtcagattgacagccaagtcttgtgtcggcggtaatgaaggaggattccgacgtcaaaaagtaccttggaagagcttctctattcaaaaatcctcttaaatccaagcctggaaaagattcatatacagtttgatcgactagaacggacggtagcactacgtagtctgcaccataacggtatgccttcgttacagagtctttggagatggtcacgggaatgtatgacgatccagactggtcatcttcactgacatttttcttatttccttcgttgtgaatttcatattcgattatggatttgacccccacatacctttctttcttctgggagtcttccacctcaacagcggttttcctatttaagcctgaaactgctttcgtagcaggaaaagcctctaccttgatacataagcaattttcatcttgcatgctgccgctaggattcgatgtttgtgttgataatatatctgcccctaacctaagctcgcctgagaatactcttactggcttaacgacagatgttgctggggaagtgatttcaacaagaagttcattcatattgtagattcttgaattcggtatcgcttcgaccaactttaaccagttcgattttttcctctcctcttgagtgtctttaccgcaatcaatcaaaatgattcttgtgcttaattcttccgttagcaggtctatttcttcatcagtaatatccagatcatctaaattgtctgtaaatacaacaatttgttttagaatttttcttgcttgaaattgttgtttaatatctaatgagacgaccaacagacattgaatcattgattgtaagccttcattcgaactatcatgactgtgctgatcacaatattgtttcaggcgttttataaacccaatggtggccgtcgtggtaacaggagccaaaaaggattgtatttggaacacatttggtatttcctgggaattctcagatacgggacaattagcgagataacagcttatccaatctgtttttctactttttttagatttgtttaatagagtgtactctagatatgccatagatttggaaacattattatttttcatcattgatggtgaaacatccacgatgaaagttgttgactcacttgacattattatggtgtgagatatattatttgtgcatatgtcctgcactctcgttaattaggttttcttctcttgatgatgccctttttttttattcatttttttgcatgacaacaaatgccctgacggacatgcggtaatctagttgaaaaaatagtcaaattgtgtcgacactgtaaaaaggtacttccgctaatagactacaaacattactccaagaccagaaacagaaatacgttacaatagtgttgtcgaatcctggcaatggtaaattgtttttaacgccctccaactgctaatctttggttgacggtacattcatctattataagaactaaatatatagattaactagaaaaggccagatgtcttaagtgtatatattttgaatgagaattatgtatgcagcatatttacttgaatcttcaaaaaaagaagccctgtagggggctcgaacccctaaccttatgattaagagtcatacgcgctaccgattgcgccaacaaggctacttattgttatttaccgtcagcttgtattcttatatgttgagctggttttttatctcagcttttactttctcaaagttaataaaactattcttctagaactttttttctggatttcggttgctgaactagttcaacaaaaatatttattttaaaattaaactggttcaaggtctcatagtcgatcatttccaatcaatcaaagcaacccacaaatcctaggctgaatcatgatatcgatggaagcaatcaacaattttatcaagaccgcaccaaagcacgactatctgacaggcggagttcatcattctggtaatgtagacgtgttacaattaagcggcaataaagaagatggtagtttagtatggaaccatacttttgttgatgtagacaacaatgtggtagctaagtttgaagacgctctcgaaaaacttgaaagtttgcaccggcgctcatcctcatccacaggcaatgaagaacacgctaacgtttaaccgaggggagtcacttcataatgatgtgagaaataagtgaatattgtaataattgttgggactccattgtcaacaaaagctataatgtaggtatacagtatatactagaagttctcctcgaggatcttggaatccacaaaagggagtcgataaatctatataataaaaattactttatcttctttcgttttatacgttgtcgtttattatcctattacgttatcaatcttcgcatttcagctttcattagatttgatgactgtttctcaaactttatgtcattttcttacaccgcatatgattatatactagaaacatgaatactactaaatagatgataaatggagtttcattgcaatggtgataatgattgtgattttatttgttggaataacaatcaactatcatccattcactggtatcaatattactggtatattatcttatatggtgtaggaagatggcataatattgagaaacggctatcggatgtggtaaaagctaaaatgcgaagattgataatgtaacaggatagtgaacgacaacgcataaaatggaaaaagaggtaatatcgttattatgtaaaattatttgtgtcctttgtggactctaagatccttggaaatttaaatgaccggagaatgaggtcgctataatagtttctatactcatggaaaatgcaaccgataaaccattataaatcttcgcggttatctggcattgttattaaccaaaaaaatgccggcctattacaagctactgttcaataaatattgttgtaatgaagacggtccaactgtacaaatacagcaaactgtcatatataaggagtcttatgtgacagcacttgcgttattgtcagccggagtatgtctttgtcgcattctgggctttttactttctgctcagaaggaagtacgaacaagaaaaaaaaatcaccaatgcttcccttttcagtattagtttcatatttgtttacgttcaaactcgtcgtttgcgcgataacctctaaaaaagtcaattacgtaactatatcaatcagagaatgcaaaaagcactatcataaaaatgtgtctaggggatgtgagacatgtcaattataagaagtgatggtgtcatagtatatatatcataaaagattatcaaagtttcaatcctttgtattttctagtttagcgccaacttttgacaaaacctaaactttagataatcatcattcttacaatttttatctggatggcaataatctcctatataaagcccagataaactgtaaaaagaatccatcactatttgaaaaaaagtcatctggcacgtttaattatcagagcagaaatgatgaagggtgttagcgccgtccactgatgtgcctggtagtcatgatttacgtataactaacacatcatgaggacggcggcgtcaccccaacgcaaaagagtgacttccctgcgctttgccaaaaccccatacatcgccatctggctcctggcagggcggttgatggacatcagccgcctcccttaattgctaaagcctccacaaggcacaattaagcaatatttcgggaaagtacaccagtcagtttgcgcttttatgactgggttctaaggtactagatgtgaagtagtggtgacagaatcagggagataagagggagcagggtggggtaatgatgtgcgataacaatcttgcttggctaatcacccccatatcttgtagtgagtatataaataggagcctcccttcctattgcaactccataaaatttttttttgtagccacttctgtaacaagataaataaaaccaactaatcgagatatcaaatatgggtagtttttgggacgcattcgcagtatacgacaagaaaaagcacgcagatccaagtgtatatggaggaaaccataacaacacaggagacagtaaaacgcaggttatgttttcgaaagagtaccgtcaacctaggacacatcagcaagagaacttgcagagcatgagaagatcttccataggatcacaggacagttccgatgttgaggacgttaaggaagggagattacccgcagaagtagaaataccaaagaatgttgacatctctaacatgtcgcaaggtgagtttttaagactttacgaaagtttgaggaggggggaacccgacaataaagtaaatagataaatggaggagatattcatagtgtcttttcttgtgttgtctatttattctaacatgattatatatttattatgcttttcagtgtttccattagttttatatgatagcatccttatgtcttttttcatacctatataagcaataagaagttatgtaaacagaactttgccactaataccataattactgtcttttagtatcattgtctgtcagtcggcacggatgaaaggtgacaaacgcctagccgccggagcctgccggtaccggcttggcttcagttgctgatctcggcgcggaaaaatcagcgccccacgccaaaaggttcgtattttttctttttttttctaatcttccatctattcggtagcgatgattcatttctctgaaaaaaaaaaaaaaaaaaaaaaatgaaaaagaatatttttttgatgaacttgtatttctcttatctggttgatatatatgctatcatttattttcttatcaagtttccaaatttctaatcctttctccaccatccctaattaataattcagatctacgtcacaccgtaatttgtattgtttttttccttcattgtctaaaaccgaagaattcatcagccacagttactagttcatttgaagcgaaattacacacattttccctgttacaatagaaagtattttacaaaatctaaaccctttgagctaagaggagataaatacaacagaatcaattttcaaatgatcagacaatctacgctaaaaaacttcgctattaagcgttgctttcaacatatagcataccgcaacacacctgccatgagatcagtagctctcgcgcagcgcttttatagttcgtcttcccgttattacagtgcgtctccattaccagcctctaaaaggccagagcctgctccaagtttcaatgttgatccattagaacagcccgctgaaccttcaaaattggctaagaaactacgcgctgagcctgacatggatacctctttcgtcggtttaactggtggtcaaatatttaacgaaatgatgtccagacaaaacgttgatactgtatttggttatccaggtggtgctatcctacctgtttacgatgccattcataacagtgataaattcaacttcgttcttccaaaacacgaacaaggtgccggtcacatggcagaaggctacgccagagcttctggtaaaccaggtgttgtcttggttacttctgggccaggtgccaccaatgtcgttactccaatggcagatgcctttgcagacgggattccaatggttgtctttacagggcaagtcccaactagtgctatcggtactgatgctttccaagaggctgacgtcgttggtatttctagatcttgtacgaaatggaatgtcatggtcaagtccgtggaagaattgccattgcgtattaacgaggcttttgaaattgccacgagcggtagaccgggaccagtcttggtcgatttaccaaaggatgttacagcagctatcttaagaaatccaattccaacaaaaacaactcttccatcaaacgcactaaaccaattaaccagtcgcgcacaagatgaatttgtcatgcaaagtatcaataaagcagcagatttgatcaacttggcaaagaaacctgtcttatacgtcggtgctggtattttaaaccatgcagatggtccaagattactaaaagaattaagtgaccgtgctcaaatacctgtcaccactactttacaaggtttaggttcattcgaccaagaagatccaaaatcattggatatgcttggtatgcacggttgtgctactgccaacctggcagtgcaaaatgccgacttgataattgcagttggtgctagattcgacgaccgtgtcactggtaatatttctaaattcgctccagaagctcgtcgtgcagctgccgagggtagaggtggtattattcatttcgaggttagtccaaaaaacataaacaaggttgttcaaactcaaatagcagtggaaggtgatgctacgaccaatctgggcaaaatgatgtcaaagattttcccagttaaggagaggtctgaatggtttgctcaaataaataaatggaagaaggaatacccatacgcttatatggaggagactccaggatctaaaattaaaccacagacggttataaagaaactatccaaggttgccaacgacacaggaagacatgtcattgttacaacgggtgtggggcaacatcaaatgtgggctgctcaacactggacatggagaaatccacatactttcatcacatcaggtggtttaggtacgatgggttacggtctccctgccgccatcggtgctcaagttgcaaagccagaatctttggttattgacattgatggtgacgcatcctttaacatgactctaacggaattgagttctgccgttcaagctggtactccagtgaagattttgattttgaacaatgaagagcaaggtatggttactcaatggcaatccctgttctacgaacatcgttattcccacacacatcaattgaaccctgatttcataaaactagcggaggctatgggtttaaaaggtttaagagtcaagaagcaagaggaattggacgctaagttgaaagaattcgtttctaccaagggcccagttttgcttgaagtggaagttgataaaaaagttcctgttttgccaatggtggcaggtggtagcggtctagacgagttcataaattttgacccagaagttgaaagacaacagactgaattacgtcataagcgtacaggcggtaagcactgaatttcaaaaacatttatttcaaaagcattttcagtaaaaaatgcagactttattattatttaatcgtgcttcttatatatgacattctaccaaatcggtagtcatgtatatttttttcgtatatactttatatatttttttctaaaaaactaatgacggctaaaattaagtcatagatgaataataagttcaattcaagtgagttggtagtatttgataaatctaaagtggatacgtagcatatgtattcaaatggtgtgttttaactcgtcggacacgacttctttctcgttttgtcaatcatcaaaaatatttctcgaaaaggggccgtcaaaaattgcaagcttggaaaatacaaactggactatgtatttaaaggttatagtttataataaagcataagaacagtggccaatacgaatttaaccgctttatagaaatggctatcttaaaaagaggagctagaaaaaaggtacatcaggagccagctaaacgctctgcgaatatcaagaaagctacttttgattcctcgaagaagaaagaagttggtgtgtctgatctgacgcttctttctaaaatctccgacgaagccataaatgaaaacttgaagaagagatttttgaatgctacaatctacacttatataggtcatgtgttaattagtgtcaatccattccgagacctcggaatctatactgatgctgttatgaatgaatacaaaggtaagaatagattggaagttccaccccatgtatttgcaattgcagagtctatgtactacaacatgaaatcatataatgaaaatcagtgtgttattatttcaggtgaatcaggtgccggtaaaactgaagcagctaaaagaattatgcaatatattgcggctgcttctagcacacatacggagtcaattggaaagattaaagacatggttttagccactaatccattgttggaatcttttggctgtgcaaagactctaagaaataacaactcttctagacatgggaaatatctagaaataaaattcaataaccagtttgaaccatgtgctggtaatatcacaaactatttattggagaagcagagagttgtgagtcaaattaagaatgaaagaaatttccatatattctatcagttcacgaaaggtgcttccgatgcttataggcaaacatttggggtccaaaaaccggaacaatatgtgtacacagctgctgcgggttgcatatctgctgagacaattgatgatttgcaagattatcaagagacattaaaagctatgagagttattggtctcggtcaagaagaacaagaccaaattttcaggatgttagctgcaattctttggattggtaatgtttcctttatagaaaatgaggaggggaatgcgcaagttagggacacctcagtaaccgattttgttgcttacttgttacaaatagatagccaattgctgattaaatcacttgtggaaagaattatggaaaccaatcatggtatgaaaagagggtcagtgtatcatgttccattgaatattgtccaagcagatgcggttagagatgctttggcaaaggctatttacaataacttatttgactggattgtgagtagggttaacaaatctctgcaggcttttccaggcgctgaaaaatccattggtattcttgatatttacggctttgaaatttttgaacataactcttttgagcagatttgtatcaattatgttaatgaaaagttacaacaaatctttattcaattgacattgaaatctgagcaagaaacttacgagagagaaaaaatccaatggaccccaattaaatactttgataacaaggttgtgtgtgatttgattgaggcaagaagaccacctggtatatttgcagcaatgaatgattctgttgcaactgcacacgcggattcaaatgctgctgatcaggcttttgctcagcgtttgaacttgttcacaacaaatccacattttgacttgagatctaacaagtttgttattaagcattatgccggtgatgtcacatacgatattgacggtattacagataaaaataaggatcaattacaaaaggatctggtagaattaattggtaccactaccaatacatttttagccaccattttcccggatactgtagacagagaatcaaaaagaaggccacctacagcaggcgacaaaattataaagagtgcaaatgatttggttgaaactttatcaaaagcacaaccttcatatatcagaacaattaaaccaaacgaaaccaaatctcctaacgattatgacgatcggcaagttctacaccagattaagtatctaggtctgcaagaaaacgtgcgtatcagaagagcaggttttgcatatagacaagtgtttgagaagttcgtggaaagattttatttattatctccacactgttcttacgctggtgactatacatggcaaggtgataccttagatgctgttaagtatatattgcaagattcctctatcccacagcaggagtaccaattgggtgtcacaagtgttttcatcaaaacacctgaaacattatttgctttggagcatatgagagatagatactggcacaatatggctgccagaatccaacgtgcttggaggagatttttgcaaagaagaattgatgcggccactaagatccagcgcaccatcagggagaggaaggaaggtaataagtatgagaagctccgggattatggtacgaaggttttgggtggaagaaaagaaagaaggtctatgtccttattaggttacagagccttcatgggtgattatctatcatgcaacgagtccaaatcgaagggcgcttatatcaaaagacaagtgagcattaaagagaaggtcatcttttccatacatggtgaggccttgcatacaaaatttggccgttctgcacaaagattgaaaaaaactttcctattaactccaactacattgtacattgttggtcagactttggtccaaaatgctatgacctatactcaggattataaaatcgatgtgcgaaacattcaagcggttagtttaaccaatttacaggatgattgggtcgccattaagttggctagctcaggtcaacctgaccccttaatcaacacatatttcaaaacagaactcataacgcatctgaaaaggcttaacgacaaaattcaaattaaaataggctcggcgatagagtaccaaaagaaacctggaaagttgcattcagtgaaatgtcaaatcaatgaatctgcaccaaaatatggcgacatatataaatccagtacaatatcagttcgtcgtggtaacccacctaattctcaagtgcacaaaaaaccgagaaaaaagagttcaatctcttcaggatatcatgctagttcctcgcaagcaacgaggaggccagtttcgattgctgcagcccagcatgttcccaccgccccggcttctaggcattctaaaaagcctgcccctccaccaccaggaatgcagaacaaagctgctacaagaagatctgttcctaatcctgcttccactctcactgcatcccaaagtaatgcccgtccttctccccctactgctgccactcgtgctacacccgctgctacacccgctgctgccgcaatgggctctggtagacaggcaaatatccctccaccacctcctccacccccaccctcttcaaagccaaaagaacccatgtttgaagcggcttacgattttcctggttcaggatcaccatctgagttacctttaaagaaaggagacgtaatttacattacaagagaagaaccaagcggttggtctctcgggaaacttctggatggctctaaggaaggttgggtgccaacagcttacatgaaaccacattccggaaataataatatccctactcctcctcaaaacagggatgttcctaaacccgttctgaattctgtacaacatgataacacctctgcaaacgttattccagctgcagcccaagcaagtttgggtgatggtttggcgaatgcgcttgctgctagggccaataaaatgagattagagagtgatgacgaggaggctaacgaagatgaagaggaagatgattggtaatcaaaatgtatttagcgagtatatactctatacgagcaaatagagtaaattgtaattaataaatattgatatattatcgcccatatgaaatttttaaacgaaaggttacttatacatcaaataattaattaaccttaaacattacgttcaggaagaacaatgagcgtaaatggtactaattaaaataacggcggcagataatgaaaaatattggcgtaacccccacttgttattgccatttctgtcaaaccaaggttttctttccatcgcaaaacggacgagcttttccttttgtgcgctatttggagggtatctcataaaaagggtaaaatcattccaatatggttgtttaaaaattgttctttcatgactaaaggtattgaatccataatatccaccatagttaccataacctgaagtaccgatccctccaaatggagcgtcggtaattcctacatgaatcactgtatcaccgacaacacagtcaccagatcttaagcgcgtcaagatacgatttatttcagtttggctatcagagaatatgtattgcaccaatggagtgtcatgttcttctattatcttgttaatggtctcatcaagatcctcgtactcaatgatgggcaatacaggagcaaagttttcctgtttcatcaaaggatcatcccaaccaatgttataaactatggttggtggtacaaggcatagatcctcagtatctgaattgatagaaatttttgaaggcacaatcttggagccgttagttgagtttatacttgcaacggcctttttgtaagcaggctcatgaatcatacgagtgaaatctgtttgttcatcaaagcttggataaaattcatttagtactgattcacactctttaatgacttttggatagatagatttatgtactaacaaataatctggtgaaacacaaatctggccagaatttccgaaagcaccaaaaaaaatccttttcaaagcaatttttatgttacttgctttgaaattttctgtaataaaggtaggtgatttaccaccaagttcaagtacacaaggtgttagactttttgctgctttctcagcaactattgatccgacacggggagaacctgtgtagaatattaggtcaaattttccacaatctagtagtcttgtagtttcatctatagctccctgaactacttgaatcaatccatcagggaaaccagctgtggttaacaaattttccataactacagcagtgtgtggtgttagttcacttggcttcagaacaatggtgttacctgcagcaagagctgctgccaatggggcaaatgctaaaagtaggggaaaattgaaaggagcaataatcaagacactgccccttgatattttctccacgattgttttaccaaacataaatggaggagaagaatcagatactctccgaggtttgatcaattttggtaaaatctcaattaggtgaagtatatcgttcataagtttggtcgtttcattcagaaccgattcaattttgttccgatgaaagtccttgtacatagcatcgatcagttcttcctcatgatctttgacggcataatagagttttttcaactgcaactgcctgaattctagatcttttttccttgggttattttcgtgggacaatttcaattgtttctcaaagaagaaatttcttgagatttcaactatttcatctattttagacactggggtataattcaatatttttgagccgtcgtttgacatgttggtgataaattactatggctatggttttagaatattccttttagataatcaatatgcctgaagttttgttttttatatatggagtatccgtttatccctaaaatccgaagaatctcctcctaaaacgacaaaaaaaagggtaagcaatccaccatctaattaaatcactaatattagattgaattttcgaacctatctaaaagtgggatcttgatgtaaaattgactgatagataaaaggcttggagtcgatagttgatatatcagtacaccggtaattgtctattatataccctgttggcatgaaatccatataggacggtatatatttatatataaaatgcatgtaaaaatctttcatcatgaactactcggaatttttggctggaaattcgttgttccatttcctctaagtgtcttgatcatgttctggtgtgcctgtactggaatttggtatactatgtggctgctgtaatgataatctagcttctctctcttctaacaagaaaattcttcttggcttccctcttctctttagagtaagtgaatagtcttcgagtttgtccatttttttggagaagtattcgtataactgggacattgataatcggcaatgatgtcctttgaaggtattgtttcccaatcttatattttcgacaaccttgatggcttggtttctacttattttattctcaggtagcgacaaaccatatttgcttggatcatcttttatatctattattctttttatgatggtcattcttttagtgaacaaagtcctttctttggcagatcgcctccaagtggacccatatctcctctcaagggaaagaactgacggttggcccggtaagccttcaaagtattcacgggccgcatctgtaacgttctggattgcacgatttagtttatatgacgttccaacgcaccctcttctgtttctgatatcattctcgtttcctgttccatcgagttggttattactgtcatcagcattgctaacagaatcggggttatttaaaggtaggttcctggtggtagcgttctcatcactttcattaccatcgtattccccattttcaaagtctgacagccctggctcaggcttgatacgaggatcgccggctaatatgcttgcgtgcatactatattcttgccagtttgttgatcttgactgactttgatgagcttgcgtacttgttgatggatttccaacacgagcagcttcctgaggagtaacattttccccagtatggtctataaatcttattctctccccagtcataataccaactacctctttgaagacttctttcattgcggaaacatcttcaacatacttattgatgtctttaaatcctttctccaacttcttttgattctctagaaagaagagttcttgttcctttttcattaggctgatttcttccttcagattggcattttgctcctccattctggttagttgtgctataagaaatgcattgaaatttgtttcaggggtttcttttatccttccagggcctattctgttggtcggttctgttgccgatgctgatgtggatgtagacactatgggaggttgagcagcgtctgtcggtctgaaaagaggattgatacggcctgggatcatgtacctatttaatgcagcatgtcttgatactcctgttggacttgtggttatagttcgctgccctagatcgtgattcctgcgttcagaatctctatctgaatcatcatcgtccaacgagccgtacccaccaaaaccttctacatagttatattctcgagcgggcatgtttaattaatgtgttgactcctggactaacttctcgatggcacaaaatgtagtcttctggcaaaagacgaagttgattgttaaatattttaagctagcaatgccctttgtactctcgtttgtgtttgagtttcaagtacgcttcctttttttaatttttttactaatactaaactcgttctctttagacaatactggttgaagtaaagtaaatgctatatcatcatatggaatatgatatccctgtgatgtttatataattatacatttgtacttgatacaaaagtgttctagtcctaattaaggtttacttggatttcgaaggatctaatatagccgacaataaatccaattgttcttccattttttctgtgtcttggcctagggccttcttgttgacattgatgggcagtagtcgtgttccaacgttctcatccaacaactgtatctccttgcgtagctgtgtggttgatttatctagtcgttcgtaaaactgtttgacatgattttcgaattggggtttcactgattcattacctctttttagttcaccaaatatgaacgtgacttgagacgcctcctgcaacatggagcataactgggtctctatatcatttaatgacttaagacgttcttgtatatatggtggctgcattgtttcgttttcttgtttcgtttcactcttcgtattgagaacctgcatcgttgttcatttggatttgatagcgtccttctaataagcgcgcctctggcttgatgagaagatttgaatcgaattagcagatctaacgactgggtcaaaaaaccgctaagatgagggcctgcatactgtccaagtcagattttcgtactcattcgattactttcaaaatataaaagccgccgcaatgagcgacttaaatcaagtttttaaaatgtccaatatacatatatataaataaagtcaagatttttttatcactggatgtttcaaagcttctcatacggtggctacgtcctggttaccatatttcttgtgttatatatattatttataggcccttctacaacattggttagttcgggtgttttcctctatgaataattgttatttaaaaattgagcagaaaaactcaggattgtttataatgtaaatgttttgaatagaccgataaggtcacctgttagtaagttgatctagtgtatttattgtattttgctatatcaatggccattgaattgggactttcccgtattacaaaactactagagcatttaggcaatccgcaaaactcacttagagtgctgcacattgcagggacaaatggtaaaggttcagtatgtacttacctatcttctgtgttgcaacaaaagtcctaccaaattggaaaatttaccactccacacttggtgcatgttactgattccattacaatcaacaataagccgattccgttagagagataccagaatattagattacaactagaagctttaaacaagtcacactctttaaaatgtacggaattcgagctattaacatgtaccgcattcaaatatttttatgatgtgcagtgccaatggtgtgtcatagaagtaggccttggcggaagacttgatgcgaccaatgttattccaggcgcaaataaggcatgttgtggtattactaaaatcagtttggatcatgaaagctttttaggtaacaccttgtctgaaatctctaaagagaaagcaggtataataacagaaggggtacccttcacagtgattgatggaaccaatgaggcaagtgttataaatgttgtgaaagaaagatgcaaggctttagggtctgaactatccgttacagattctcaacttaacggaaatatgattgacaccaactcctggggttgttttgacttggcaaaattgccactgaatggagaatatcagatatttaatctcagggtggccatgggtatgttagactacttacaaatgaacgaacttattgatattaccaagaatgaagtaagtacgagattggcgaaggttgattggccaggaaggttatatcgtatggattatcgctttgacaaagtaagtaataggacagtgcctatattaatggacggtgcccacaatggctcagctgcagtagagttagttaagtacctaagaaaggagtacggaaaccagcctttgacctttgtgatggcagtaacgcatgggaaaaacttggagccgctgctccagccattattgaggcctatagatcaagtaattcttactcggtttaataatgtggaaggtatgccctggattcatgccactgatcctgaagaaataaaagattttattttgactcaaggatacacaaaggagatagtgattgaaaatgatttacatcaggtattgccttctctggcgcatgtatcagacgagcaaagacggccaattgttgtatgcggttcactgtatttatgtggtgaattattacggattcacaatagtcacttgagaaactaaataaaataagtaacaacgaacattatatagactatcgatgataaacaaactaaaaaaatgtcatttttttatttttttcttgcctctggagtctttctggtttcccaacatatttactatatttctcttctctctgtttccctctcttttgggtgacaaattagcttcttctctcttcactcggtcacctatacttccttcctctggtaaagttgtttcctcttgttcttcattcttttttaatccatcataggaattccttttgaggcttttcttttgattaaaaacatcttcgcctttcaacgatttgtcaccctttacacctcgattatcaataccttgttcgttatcattttctagcaaggcttcttctttttctctctttacgctgaacatgtccgaatcctctttcaaaagcggttttatcagccgctctccggtgttggtagtcttccccacatcatcggtaacttgatagaattgtaactttgattcatcgtagtccggcttcagcagctttaccagttcttcagtgctccatgtcgttttatccacatccatccatgcatcccaactttcggtgcctggttccagcacgcaaggcattctttcgtggagccattctaactctctggggccttgtgcagttattatggtgaacgtatataaatcatccttttcgacgtaatcatacattcctgctacaaacatcaatctgccgtctcgtctagaaatgaaataaggcgtcttctttttccctacggttttccattcaaaatatccgctcataagcacagcacaccttttcttctcacagggtctcatccacattttgctctcttgtaaattctctaaacgggcattaaaggtacgataggtcttgaattgtgaaacgtccttggtccagaatggtacaaggccccatctcataaattgtattgctttagtatcaggacgatataccgcagagtagtttgtaggggaaatattgtaagaggccttgaagatatccttactaacggtaggctgatctttggtgtcttcctcgtcatgtggatgctggctgttcgatgaggcgtccttgggtgtattaaccggtaagttccaatctcttagaagttgcggcaaatctccgctatcgtaagctaaggcaaacctaccacacatcttgggttatgaaagtctggtattagcatcaggtatactttaattaagtctcttggttcaactgttcattgctttgttcccttttttgatccctttcattcagatatttttcgtgggggttcggcctcacaaaattgcatttacaaatcatcaacatttttatgcaaaagtgggctactttcatttactcacaaaggtgtaaacacaagcaggaagatctcagtttaacaggctaaaagtccctccttttcggtatgcttttacaaggaatgcgtttatcgcaaaggttacataagagacatctatttgcttccaagattttaacgtggactacgaaccctgctcatatacgccacctacatgatataaggccgcctgcatcaaacttcaatacgcaagaatcggcccccataccggagtctccagcaaactcaccaactcgaccacagatggcacctaaacccaatttgaaaaaaaaaaatcgtagtttaatgtattctattattggggtttccatagtaggtttatatttttggtttaaaagtaactccaggaaacaaaaactacctctttcggcgcaaaaagtctggaaggaagccatatggcaagaaagtgataaaatggattttaattacaaagaagcgttaaggcggtatattgaggcgttggatgaatgcgatcgctctcatgtcgatttattgtcagatgattataccagaatagagctgaaaattgctgaaatgtatgaaaagctcaatatgcttgaagaagcccaaaatttgtaccaagaattattaagtcggtttttcgaagcgctgaatgttcctggcaaagttgatgagagtgaaagaggcgaggttttaagaaaagacttgagaatcttgattaaatcgttagaaatcaataaggacatagaaagtggcaagagaaaattgctacaacatttacttttagctcaagaggaaattttaagcaaatcgccagagttgaaggaattttttgaaaacagaaaaaagaagctctcgatggtaaaagacatcaatagagaccctaatgatgattttaaaacatttgttagtgaggaaaatattaagtttgatgagcaaggctatatgattttggatctggaaaagaatagcagcgcttgggaaccctttaaggaagaattttttactgcgagagatttatatacagcttattgtctgtcatcaaaagacatagctgcagctctaagttgcaagataactagtgtggaatggatggttatggcagacatgccaccaggacagatattgctatcacaggcaaatttggggtcattgttctatcttcaagcagaaaagctagaagctgacttaaatcaattagagcaaaagaaaagtaaagagtccaaccaagagttagatatgggaacatacataaaagccgttagattcgtacgcaaaaatcgtgacttatgtctggaaagagcacaaaaatgttacgacagcgttattgcgtttgccaaaagaaacagaaaaattaggtttcatgtgaaggatcaactggatccttcaattgcacagtcaattgctctatctacctatggaatgggggttttaagccttcatgaaggtgttttggctaaagctgaaaaactattcaaagattcgatcactatggccaaggagactgaatttaatgaactccttgcagaagctgaaaaggaactagaaaagacgacagtcttgaaagcggccaaaaaagagggtttaaactaataccacaataaaggaaataaaggaagacaaaaataataaatatttcaactgtacatatgtattttcgcagcaaacagaaagcatagtttatagtacctaatgataacctttctttcattacttcgaaatctatgacgattatattatacactaaaatatagaaattattttctttatttttaccattttaaacatgaccaataactagaagatacataaaagaacaaatgaactttatacatattcttagttagcagtcataacttgccaaactctaatgacgttgtcggtgtaaccggcaaacaaagtttgaccgtcagcagaccaagccaaagaaacagcatgtggttcagcggccttgctgtaaccagcaaattctggtctcaagtcatcgaccaagtattgtgggtccaaagaaaagaccttaataccggtagcagtggcagcagccaaccagtatctgtttggagagaaagccaaagagaaaacttcatcttgggcagacaaagtgtacatagccttcttagcagccaagttccacaacataatttcaccgtccttaccagcggaagcaatcaaagttccgtctggggaagcagtcaaagtgttgatgttggagttgtgaccgatgaagtcagcttcaatttggaattggtttaagttccaagcctgtcattatatcatttttgttagtaagggaacaaaattaatttaaaaaaaaagtttccattttgacataacgagtaaagagaagagcagagtaatgctaaaccattcatcagagatcttggtgataattggtatgtctcattcggaactcaaagttccatctgaagtagcaaatatgttattacatcatttgaatggcatacacaaatccacttttcttcttctactcgattgtcatcatattctatcatggaaagaaaatatatcacataccttaaccattttgtcgttaccggcagaaatgatggtgacagagtcatcatcagctttttcgtttggaacaactctgacttgggaaacccagtcattgtgacccaacaaagtggccaaacattgacctttgatggtccagaccttgatggtcttgtcacgggaaccagagataatcatggaagccttcttgtcaatgtcaacggacataacatcggacttgtgaccgacgaatctttggtaggtttcaccggtggcaacatcccataatctcaaggtcttgtcccaagaagcagacaaagcgtaagcaccgtcagcagtcaaagtacagtcttggacaatgtgactgtgacccttgaaagatctaactgggacaccaaacttttggtcgtcaccagtcaacttccaggagatcaaagtcttatcacgggaagcggacaacaataggtttggttgaccagcagaagtagccaaagatgtgacccaaccgttgtgaccttccaaggtacctctcaaaactaaaacttcgttagatgccatttttcactttatttactttagtgtgttataaggattttttggaaaaaaaaaagagagagagaacgagttaggaaaaccaaaggagcagtcttaaatataggaaaattttcaagttgtagaaaatccacaattaaaggaatagcccaatgccaaaaaaattggtcttacacatccaaaaaaaagttgcgtggatgaaatttttttcaacaaacgttctgagactttcgctggagaagcacgtcctcgctaagaaattttcagaacggagcgataacgaagacggcctaacatccgtacatagtcataaggctacagatggccaggtttgggggaatataagtatggtgatgagtattaccagtaacacaaacaaatattttgacaaaccagttacgttgtgacagtccagtatcttttaaacgtagaatggtgcatctagagtaaatattgtagttatatcacaccgagcaaaatacgtggttccaattcataatgctaataattatgctcagctcattgaatatgtatgccactgtagtattttattaatgatctcaattttcactttcctaatctttcccagatgtatttggtcttatagaaatcgctgaggttattgtccaagggtaaaatatcaatattcccatcattttttctgttaataaggacttgatcattttctaaatccaaaataactcctaaagatctgtatagcttcaattttagaatattttcgtttgcttccggggtgaccgcactttgttcttccagctcaggttcaattacttttgcttttattttggaaccgttcggtgtggatattatttcactatctttgaggtacaatttcatcttttcgtccaattcacttcgaagtgacacaatattacgttccaatccgtccaaatctttcagaagtttaactagttcgtctttactaccaaactcattgctctcttcgttagtatattctaagtctccctccaatttagcaacatttattctttccgcattcaatttcttgttcgactcagaaacctttgaatgctctttactaattcttgcttcgctttcctcttttataacatcaagatcgtgtcggattcttttcatggcatcaacatcttgctgaatatcaaaactttctctgacctcttttaaaaattcaaccggattgtcgagtaggttatccttttgtgacatggctcttgcgttccttccctttacacttgctcttccctcgttacttctttcatctatagcaaagtccctacgtaagttattttgaagacttcattgtttacatttacttttgacgcgcctgtcaaggtcgggtaacctcttctgctttcgcgggtccttctacgttgaatcaaatttattgaatataacattataaagagtatcataaaagctatgtagcaaaaaacactaagtacattccttacatttcatttactgagccagtaaatacgttcctaagacgagtgtgccggctaaaacgattgatccggtttttataaccccacggttggtcaattcgtagcccatatcccagatgagatgccttataccgttaccaaaatggaatgcaaacagatatgctgcagagcctttggccacccattgggaccacttaggcatcttttcgtgataccacttgtttagatcctgaaaagtcgtatccattcccattattgtcgtcacacccaaagtaattgtgaaagcatagaatccaagagccagtaaaacgccagatatacgatgtaaagaggaaagataccagctcatttcaggttcgtaaacagttaaatgaggagagatcggtctttttttcctttgagatactaagagctcctcttccttgttgcttgaccaaagatcagatttggatacgcggccattgtggaattctttggaaaaaaggtccattctgccattagagatataattatgcaaaataaatggtgtgctgattcttggcacgaatacagatgctcggggaactccaaatacagatgttactctttgaatggttgctttcattattcttacgcttctgaatatttctgagctccacttatcagctatcacagtcgcattgagtgtgattaatttttcggtatattgatactatttcatttttatttgccattatctaaaatcttcgtcaatttttttatgagcaacgtatccctaatcccttttttacaaaagtccaaaatagaaaaaaaactattacggatgcagtgatctctaattagggatacttttccttgtaatttggtttatcgtacggtaagaatgaccgaatgagtgatggttttgatccgaaccgtaaagaaatactggtagaagtgtttactctggttcctttcaacgacatggtatacaactatattgcatgagaactggatgcgatgcaagtacttctggtacaaacatgtaaatactattgattatattacagtaattttgtcaaaacacagtggcacaaagtcatttgataatgtgataggataacgaaacatataaagcggaaggacaaaaaaaaagtagtgatattatgtagaaataccgattccattatgaggactcttatatcttcgagaggaacttctattatattctgtatacacaacattatagcctttgatcaacaatggagttcacaattatcaaaatattcgcacaatattcacgtagaatagtggatgacagagtatataaacaaagaaagaagcactcaggattttctataaatagtgaagttttctatggacgccaaaaaatcttaagggtatcttgagtgtaatcatcattggaaggattattatctttcacgagtaaaatactattaataactagtaatttccgtgaagtcattaaaatgaacaaaacgataaaacggtttcttattgctaatgtgctgattttttgccaaaaggtaaaatctaaaaatatcaattgcataccttcacatttggtatattaccatataatagcaagatgacataaatcggtgaggagcagttaccaaattccatggaagatgaaaaacagggttgataatataataaactgttggaacgagagtaattaatagtgacatgagttgctatggtaacaatctaatgcttacatcgtatattaatgtacaactcgtatacgtttaagtgtgattgcgcctattgcagaaggaatgttaaacgagaagctcagacaatactgaagctgtgttaaagacctattagttgaacatgttatggtaggtacatatatgaggaatatgagtcgtcacatcaatgtatagtaactaccggaatcactattatattggtcataattaatatgaccaatcggcgtgtgttttatatacctctcttatttagtataagaagatcagtactcacttcttcattaatactaatttttaacctctaattatcaacataaacaatggaagaaaaataataatattaccaagcaaaattattgtccttgtggatttcgatattttcaacaggtaccttagtagagctgaagttttttcaaattaaacatttatgtggtagtcatatatatgtgtcatgcgagtctttacattaaatatatggtaaccaccagagaacttgttatattagtcacgattaataatgttggaataaaaatccactaccgtctatcaactagtagttatattatcaatatattatcatagacggtgttagatgatgatataaattatgagaagctgtcatcaaagttagaagaagctgaaatgcaaagattgataatatgataggataatgaaacatataaaatagaaagagggataatcgtaatattagtatgtaaaaatatacattccattttgaggattcctatgtcctcgtggagaacttttagtatattctgtttacctaatattataatcttttatcaacaatggaatcccaacaattatctcaaaattcacctatatctcaaataataaaccgatcggactgcgttcagtgaacctctcttatatagtataggaagatccaaatttattattcgctgatatgaccttttgacctttacatattaacgaggtgcttttaccaatgcatagacgagcagcttatcccataatgagtttaaattctattcaactcataacaacttatagttgctatagtcacaccttttcaacagataagtggttgtttggccgagcggtctaaggcgcctgattcaagaaatatcttgaccgcagttaactgtgggaatactcaggtatcgtaagatgcaagagttcgaatctcttagcaaccattatttttttctcgcgtattcctttgagggcgcccctttatgttgaaatattgagaagctacgaatcaaactttgaagtcagttgagtaagcaatatgaaaaacattggaaaatacaataaaacacaattacgaaaactatattgttttgaacagaaaaatagaaggaagtactaaaattactctttcaccacacaacaattttaactcaagaagataatcactgcttacttttatattttatagacaatttgcactttggggtatttttcttaattttatctgggtttttttcttctttttacaaagaaactatgctaagaatatgaactcttccacttcttcagaaaatgtgttcataaattcatttagctatttgaatcaaacatcacaagccgtaatctcaggtaactccactttcgcaaatgttatcaactttccttatagacttggattatcctttattggggctgtgaacttgcagtacgagcaaaccgttaaatctgaagaaattcccccaactctaaggtctgtttttgatacaatagggttttttttcagcccgtacgccatattttgctttgtaatcgccattgtcctgaaccggttcgttgtattttacgccgtccttaacaacggttccagacgtactttaccgttatggttgagtaatgttttccatgtatcagcagtagttgtattagcaatggtatccttaggtccgctgaccttgggtaaggatttcaaaatattaggcgaccctgcttttgcccaagaaaaatttttactgaatatattctacgctttcgcttactcttattgtgtcgaaaccatatttaccatcatgcggaattccagccctttggagggcactgactattcattgtttgaactttcgattcagttttatacaatgactaataataatactaaatttttagattctcctgattacattatagactgttctatggctattttgagcaggatattgatccatttggtggagattttcaggcttagaaattatcgtctactttttagtactattatgaacctctgtcatatttgttacttagggataagagttaagcagggcggctggaaaagccttccattttcggtgaaatttaggcactttccaaaactgttttcagtgtctattatttgcttatcattactgatttttaaattatcatgcttaattagatgggatccatttggaaaatcacgtaattcttgcgaacttttacagttttaccctctcagtagaaattggaaaaaatacttaaattacacgggagaagaagatttttctgctatggccactaaattcgcactattattatgctcaggaactgaactaatggaaaagggtatacgaagagaatttcctgctattaacatcccggataatgttaatgagaaattttttattagcggttatttaaatgaactttctaaaccgtataaagagaacacttccatcagcttcccaaagaaaaattcatcaatattaaagcaaagattttttttaatgtttccaaaatctataatatggatcatgaagaagcttgtaggccaagtattctttggcttcagagataacaaggacgaggacatccccgacaacgacccatcaaaaatgttaaagataactaaaacgaactctctcaataatagtgccggccacaaagaagatattgaacttgaactattgaacacatcagatgatgagtattctgaagattacgagccttctgaagttgagtcactgggggattctgatgaagaaaacttggaagaagattcactgattttcaacgaaactcgggatgccctactggatttattttcttccgaagataatgaagttcatactgattataattggatcatgtcaactagccgtatccttcaacaaaaattactgtcagataaaactttgacaagggcgtctatcttagatacaaagttaagtgaagtagatgagacttttggtacagaaagtgattttgatctatcttgcgcggtatgcaaagtcaatgaaagaaatacagtattatggccctgccgatgttttgccatttgcgaggattgcagaatttctttgggtttacgtgggttcagcacttgcgtatgttgtaggagtaaagttcatgggtactgtaaggttcatcctgtttcagatagtaaataatagtttaagaacttttgcatggtatctaaaagaggtttttcgtttgggagctctagcattaattactatagctagagctttctgtgttgcacatataaacatcataataataaatcaagttttttttctttgggaaatgttcgaattaaaattgtacttataacatatcgtatcattagtatatatataaaagtgtcagtggcgattatatcattagaggaggaaagaataaactatacatcgatttgccgtcatttctgtatttatggcatattgactctgaactcatgccatctaatggtggaacaaacggattgggttctctacgtaaaccaaatcgaatgaatcggcagctgaaaatacaaccttgtccatgacagaaccagatggagcggcaatgtatttgacaccggatttaactgctctgtaaacattgtctgggaatgggaaaaatgcatccgatgacaaagaaacgttggttaatttactcaaccattcctttctttcttctggagtaaatggttttggaatctcctcgaacttcgattggtattcagacaattctggttcttctgttggaatttggccggttacgaataaatcgatagcattagatttttctggtctcttgacgcctttagcccatttaatctccaaaactctagggtgttgtctgaaccaccaattatcagccttatcaccagctaatcttgtacaatggattctagattgttgacctgcacccaatccgacaaccataccatttctagcataacatacggaattagattgagtatatttaatagcaatggtggcaaccgttaaatcaattatggcttgttcagtgagatttttattttgagaaacaatttctttgaaagttgattgattgattatggcatcgtttctcttttgttccaaagtcacaccgtatacttgtcttctttcgacagcttctggaacatagtttggatcaatttgtaatatgcagtacttacctcccttcttcttggatagaatggccaacgcctcaggctcataacctggggcaataacaccatcagaaacttctctagatatgatcttagctgttggaacatcaactatgttggaaagagcaatccaatcaccaaaggaagacattctatcagcaccacgggccctagcataggcacatgccaggggagataagttttcaatgtcggcaacaaaataaacttgcttttcaacatcagacaatgggatacccacagcggcaccagctggtgatacatgcttgaacgatgctgctgctggtaaattcaacgaggcggataattccttaaccaggggccaggaatttagagcatccaacaaattaatgtaacctggtgaaccacataggactttgaaaggtaaactgtcttgttgactgacgtaagcttgagccggcttttggtgtggattggcaccataacgtagagtaatttgagcttgaccttcagagtattgtttcctgaagaaatctgaaattgcagcatcataatcggcagtgtgttcgaaagcctttaatgccaatctgtttctcaaatcttgagagatttcaccattactggataattcacttaaaaattcggagtagtcctttggatcagataaaatagtgactctagcatggttcttagcagctgctcttaatagagtaacaccaccaatatcaatttcttctactgcttctggaatagtcacacccaccttagcaacagtttctttgaatgggtataggttacaaacgacataatcgactttttcaatgtgctgttccttcaagtctttctcatcgctatcgatgtccctagcaaggataccaccatgaacggcaggatgtaaagttttcactctacctcccaacatttctggggcatgtgtgatagcagaaacgtcttcgattggaaaaccagcgtcacgaatcatacgagcagtaccaccggaggcgagaatacgaacgttcttctcgatgaggcctctggctaaatcaagtagacctgtcttgtcatagacggataggattgcggtttttgtgtaattggccatatttgatggtgatatgtgctttgatgtccaagctagcaaaactacttcaagggctattagttgctggtaagaaagattttaggtactacactaaaggttaaaacgagcgtacatttatatacatagatccgaacgtgatatgcacatccgaatattaacaagttatgagaggagtcaattcatttctgggcacatcagggtacacacattgtagggtaggatcttctttataaatgataagttgacttctgcaatgacttagttggcatgattaatattgttcgttccgctaaggaaaaaagagtcaaaaactgcaaattcaaattgcgtatgctgccaaagagcgaagaataataaaaaaaaaataagtcgaagaaaaggaacgatgaagtaatcaggttgaaaaaatgttcatagtgcattattattgatctatatacggttctaactatttcattttctatacctccataacgacagagtattttgtcttttccaggtctttcttctgccggccttggtgttgttgaatttgtgtcccttgttgatacccctggatttcttaccggtggcagtcaagcctctagcttcacgatgcttatggacgggattgcagatccagttgtaccgagcatctcttctgatagccttgtgttgaggatcaaccaatataacttcgaagtacttgtaagtagagtcttggttgacccagtaggagttcaagactctcaagttagcagcacgacggccaactctttcttcagcggtagctctcaaggatctttggtatttcaattcattgacaccttggttagttggcttaccgtaagtagcaccctttggaacaggtctctttctgttaccgcgtctaaccctgacacggtagataacgaaaccttgcttggctttgtagcctagtctcctagccttgtctggtctagttggtctagcggctctgtgaatgacatttttttgtctgtattcccagaccctgactctttgcaagaatctcaaaacatcagattgcttctttctttctaattcttctaaatatttgtaggctcccattgcttgtgtggtaggtaatttgtgactgtctttacggtagctttcgccgattactattgccgctaacttctcaagagtgaatgaaattatcaatggctccggttaattgaaaacgtggaaaagtatcgaaaggaacaagaaagatgttttccgggtaacgacatatggagcatcaagacagatacatctctactgactacatgtttgtatcatcatttgaagagattggagaagtattctagcaatcggtgcaaaaaataagagtaaagaaaaaagacgtttgtttccttaaaggagctggaggagcctgttttggatagcggcgtagtcgctttattaatttggttatactttaaacgcaaagatggcagtacgaaaccagcaatgcagtgattatatattccctactaaggaaagttgcgcatccaatgggaaacattttcctgatctgtacctttggcaacctgaatatgcggttggctggcaaataaggtagcgtggaggcggtgtttttgccacaaaccagtacgcccaatctatccctgcgagccaccgtaatgatgcaaattgcagtaaagcagcgcttagcctccagccgaaatttacttccgtcgaatgcacgttggccagaatgtctctcgtcccccttgtgctgcgcaaataacaacgcgttggtgcgttctggaacgcgaagattgcgaaacacgcctccgaactgacgtagcatagagtctttcacagtattgcctaatgcggaaatcacattgccatattggtgaaaaatacaatggctagtttgatctatttttgggttatggtgtctcgagcgtaaaaagtgaaaaaaaagtatataaacgatctgaatttaaggcagaattctgtttgccgctctcagaatgtactgttaattactgaggtctccatcaaacacaaaccccaacctaatcgcaaataacctgaataaaaatggccagcagtacttccacttccgcttccgcttcctcctccatcaaaactaacagtgccttagtttccaacaatgtcgttgccgcctcttccgtctctgctacttctactgctagttccagtgccgctaagaacactacttccagttcaaagaacgctgctccaggcatggttgcaaaccctgtttcctcgaagtacggtatcatcatggccgcatttgctgctgtttctttcgtcctaggcaccggtatttaagaagtttctaaaagcctttttttttccttctgcttattgtactatcaaagggaacgattgattaacagaaaaattacataaaaatcatatcataatggactcgcggttgacgcctagttaaaccaatgaagaggtgggcgaacttgtgggagttatatatatttaggccaattgggccattgcatgtttcctataatatattttaatataaaaatttatttattaatacagcaactcattagattaatcgagtggtggtaaggctttttttgctcgcaatgcgagcacgtgacagaaagtgagaatgaacgtctgacattgctagtgtcacgttcagaaaacgagaagacgggtaaaacaaaaatattgatgattgttggttagcaatatcaaattcattgaaggaggtcacaaccgcgagagaaagtaagatgtcatgtttttgaatatgaacctggagctcgcatataactctttccagtggcacctttagatttattttaactctgaaatgtaggtttttttttttttagacaagtcacgataagtagttgttgttagcgactttattcacagcatttttttatgtagcatttgtagaaataggggaattatatcggagtactcaagaaactaacgggcttctgagtaaaggggcttcccgatgtaatggcatccaaggtacttatctaactgatttttgattggaagaaacatttagaatgcaacctcaattgtgggcaattacgaccaatgacagccaaatccagtaaggtttcaaagggataatttactgagaaaacagatttactattctggaggcaggagtgatatattcttattcttcctatccatgggaataacgatgcacttttttatgggtaaggtgtgctcccagtttttcttaccaagaagtgtgcaattggtacggtaatatcgtatttgtttgcactgatgtacccacgctttagccatttaagttattacgaatctactctgtctattttttttttaccaactccctacccagagggaaaatgcgtatgcaatctaaaatactttatttcccattccgtgccttaggcaaacacaaatggattttggctgcataccgaggggtctaggtggtgatgaggtcgctacaacccaggatggttatctcgtttcttcgaatttccgcagcaaagaggacccttattgcagggatggaaccttttctgcacaaagcaaaatcctcaggatgtttctctcctctgtctttctttgccgagctccatcgtgctagcgcatcggacaggaagcagtgaaatacaagaaaagtatacaagcagtattcctgctcaagaacccagttttcagttatagtttccactcctttcaatagatgggaaactatatatccattaactaaaatggccagtcagactatctcttctcctcactagtgcctaatctctggtgtcgccactcctgctgctgctaattataagggcaaagtcagaccatcacttacattgaggtgaatattaaaaccagtgaaggttctgtttttctcgggagtatttccggcagtaacaccgttacttataccaaagagaatttttctgttggtatgattactgaccctgtctgctcgaagcacggtatcatcatttaccgttgtttctttcgtcctagatatcggtgtctcagaaactccaattgaagatgtacaggtgattaattacgtctttttatcaatctatttacctatatatttcaattttgatttttatttggcgagtgacatgtgaaaactttgcctatgaacctgaatagcgcattcatattttaagaacatggtagggtatagcagatgttctttaattttctttgactgcgtttacccggcgttttttgcttgactgaaaatcaaatgaagaaaaatagagatggtcttttctttttgtcatatccaagaacacgtccatctaattgattagtgccaaaaatcgcagggatataacttcgaaaatttctcaaaatggccaatttttttgttagactgtgggaaagtgtatttgaaccagggacctccccccagctgatcatcgccacacacgtatcttttgttgcactactactgaccctcatctggctcatctatgccacaaacgggaatatccacttctatgctcttttctgtatatcacttttactatggattaccgttatctggtttataaacgaattatcacacgtcaaattgaaggataatgatgagctggataaagatgccaataaaaaggacgacagtgccatcaaggaagacagcgaagacaagcaagaaagcgggaaatccactagtactgccagacggactcaagcacaatctaggtcaagaaaagcatagacagatacataattgactacataattatctctgttattagtatatcacagagcttccgggtaaatgtccgcaattgtaaatttttttgtccgcttcagggtctcccctgatattttttttttttcaaaaattccttttttttaaatcaaattttgggctcaattatggacaaatgaagcacatgcaaagagttaacgcgtgcgactgaatagaacaactctttcagcatcgcaaacccttcaaattgtgaataaataggcatttcaagtaactgtgtcagcagcacattgcataggaattctgattttttgttttagtgactgccctcctaatttttttttttttagtttacggctatagctaaatttggagctttctttcattaattttcaccgagctattaataaccctacaaaaagagcagagaggtacagcctgatccgataaagcagtgggataaaaagtactcaaagactatttataaaaagttcaaaatggatgcaggtttatcgaccatggcaacaagaaacggtcagtcttctgctagagttaaattgagaaataacctcttgaataatgatataggaaatattgacattagggatgaaacacctatttcaaggaacgggaatgacagcaatattaacatccagccttcttccgtgccgcagcagcagcagcagcagcagcaatactaccgtaatggcatgaatgaggctccaatacaagcgccacttcaacaacgtcaaattcccatgcagaattattcacaacagcaacgccagcaacaacagtataattttgagtattccaatccacatatgaatgagattcccctcatgcagcataacttcaccaaaccatcactaagcaataatcgcgataatgttaatggtaagaaagcttcctcatttacccagagctcattttccaattttttcaaacataagcatcaatttgggaagtcaaagaaaaacactaaggggacaggaggtggtggagatggtgatgatgacgatgaggttatcttggatgattctgcaaactccgacctaacattcaatgacattcagaccttcggtcacaagggcggtgacaaatatggatatggtggtgattccactcctatcattccaacattggtgactaaagaccgcggcaatatgagtaatactgagtataggaagtacattactaatcaaaggaaaaccgcaatgaatgccatggctaaacaaactaaaaatggtacattagcctcgttgcctccgagagcaatgtctttgcaaagtttcccgaatggtaatcctttaatgcaagcacccactcctcatcctagatttcaaccgaataaaatggtgagcgctaattattcgagatcaaattcgttgatgagtggacctcccggacaatttcgacagccgcagcaacaaagaatgctaccgatgaacaactacaacaatcacccaggtcaattccagaataccccaccagtaatgccctctggacaacagccacctcagcaaccacgtactctgtcattaactaatggcccaagatattcaccccaaaatcctcggccattcgcaggtcatcagcagatatcacaaagacaacaacaacaacaacaacaacttcaacttcatccaatgtctgaaggctatcggacaatgtctctacaaagtcagaacgttccccaagggtttaatccatggtcaccaaatgacaacgatcgtaaagctgtgtccatgaaacagccaatcagtcaatcgtcaatttcctcaaagaataattcagcttattcaataccgaacgtacaaaacaactccctgactacattctctccgtcatctcctactgatgctacagcaatgcctaactctacaaaacaaggatcttcaccactaaaaaaacaagtgaacattgatcaacctattgaaaacaagggaaaactgaatgttttgcaattatccactcctcaacaaaacgagttaaaggaaaaagaaaggaagctagctgaaatggaaaaatctttacgtgagagagaagcactagtagaagaaaaagaaaaggaaagagctgagaaaaatactgaagcaaatgaagaggaggaaatttcacatgaatcagacgatttaaatttaagacctgcgagtgcgctagagactggtttaaaagatcttaaattggaaagtgaaagtgcagtcgccaatagagcgtccttgtcgactttctcatccacatttagtgattctccctccaagcaaagaatcatcaataccagaacaggtatgtataagctagaaaactctactgatatcaatgaatacgtgaccgcacaagaattcccctctcccggaaagtataactcaaattcggataatggcgaaatgaatacaacgaacgaggtcgattttgatttcaatactagtaaaagggcttctttgttacaatccataccggaaagagatcccaaaagaaatgtctcagatgctaccattaagcgacgtgaatccgatggcaatggcaggagactaagtaatgtcaacatatccatgaaccaggaaaacatcaacaatgatacttttctatataaaaaaaataatcgcgatggtcatttatcagcagtttctcatatgtccagctcttcccgtagatcgttcatctccaatacgctgccgttgaatattgattccgcctcagaatctgataattttgtaccgcatatggatggttcaccctccaaaacaaaatcagccccagttagctacgataaggatggcatgaatgcttcagaagaagacttcagttttgataatactttagccaaaccgtatgaaccgttatatgctaggagaggagacataacttccgccggatcaactagtggagaagatagctctcagccaaagatgataacaatatctggtgagcaattgaatttgataacagaaaacaaagaattaatgaatgagttgacactggtgtctacagaattagcagaatcgataaaaagggaaactgaattagaagaaagaatacggctgtatgaaaccaataattcagcaccatcttttgacgattcttcgagtgtgtctttttctgactttgaaaaggaactgagaaaaaaatccagtaaaattgtgcaattgatccagcaattaaatgacgagagattaaagagattcattgcggaggagcagttattactccaagaaaatggcaccaaaccaagttctatggaactagtaggaagaattgaaaacttgaataaacttattgatgagagagattcagaaattgaaatgcttaaaggacgtttacagtagatgaatgatgtattttattgtatatatcgcttagtgcaccaaaatcatactacgtaagtataaaatcactttacacgtagaagatgctttttcagattgttcttgaaaaagttgaaaaaaatataattcacactcagcaacaggtgaaagtgtataatgggtaaaaaaggaaggacagaaggtatattgctaatcaaaacgactttggtatacgcgtttggggctacaattgcattttaaatatatttaagatgtttaatagaaaaagaagaggaggtatgttttaaaaccaatgttttccagaagtttcgttctagagtgtgtatatcaagaccaattaggatggtatttccattttttgtcagttagtacggtgtgacagaaaagtgtacttttgtggcacagagaagtggagaaacggtacacgtagaatacataacggcaagtaacctctcttattttactctccatctttactttgttttacattcctaggattattaggttagcttggttttacaaaaactcaattattcagtttcattcaaattactaacatacccaactttgactaccttgcatatgattttaccgttagacttcgatgaagatgaaaattaccgtgattttaggcctcgcatgcctaaaagacagagaatcccacctgttgtacaactgtgtaaagaaatgatgcccgatattcgcactattggtgaatctgttaaagcttttgaagatgatatcaaattcttgagtgaagctataatgaatgagtatggccatgaggactactttaataatgctttactgagcactttaaacgctgttgttgtggagcaaccacagaagcaagctgctatcgctctcttaaccatggttgttaattcgaaaaataatgttgccggaaagagtattatcaattacttcttcgaagaattacaaaaatggtgcaagcaaacatataatgatgaattcaagagtacgtcaaatgaaactgggccatggaacaagatcaagttaatcctgagatttttatccattctatcgcccatgtttttagttgatgaactaatcaatatctacaagagcttatttgaattgagtatcgaattaaacaatctggatccaggtaacagagttcctttatctgaagcaatttacaccaatacattattaaatatcccgtatttgttcttttttaataggaataatgacggtttgaggacaaaagtggaggagttacttgcatacgttgaacaaaactatctagttaaaacaacggatataaacctattaagagaatacaatggtgaacctccatatgaaatggtagaacttgtccgagtcgtattaccaaacgtcaagaaggcgctaatcaataacttggaacagctgaatgaattatttcctgattggaatcatttattaactccccaaaccggtgatgaagggttcaatgacgctttaacccttccatcagtagatgatctaaagtctttcgtgcgcttgaataaaaactttggttcagttgatagcatgtggaagacaccaaggtatgcttttcatgtttacttgccaaactccgctggtaatttcgaaacagttgtaccaatcagcacttatgctggtcaattattcaacgatatcattattgatctggtggaaagtttagaattcaatagaaaggaagtagctagacaagtgataactttggatctttttttcaaagcaggtatatttacagaacctggtgaatctattgcccaattaattgccacttatgaagagaacccattggctcctacatttaagatagaagatttggctattgaaaccattttgggacttatttttaaattacctagtgtttcccagccttttgcatacttttacactttattggtggatatttgtcaaaattctccaaaagcaattgctcctgtctttggtagagcctttaggtttttttatagtcatttggattcattagattttgaactaaaattaagatatttggactggttttcaattcaaatgagcaactttaatttttcttggaagtggaatgaatgggaagacgattcgatcaaatttggcaagtatttttataatccaaaggtaaattttgctaaaaatttgattcaaaaagaactacgattgacctctaacttttcagaagtagaggacagcctaccacaagaattcacgaaatatttggatacttcttacattccaagagatcaactgattaactactatcaatcattattcaccggttatacggtagaagaagattccgttagaaaaaatgatctatattttagacaagaaggtgtacctatggaaaacacagtccgtaaaattttagattatacccacaaagcaaacaattctagggaagttactgaattagaaagtattctaggtgagttaaagaatgagtatggttccataatttccgactttaacagatttgttatcatattgttagtccaggccgttacagactctggtagtagatctttatcacatgctaataaatatattaatgatttaaaagaagatctcaaaaccatatttgcgaagattgaattggatatcgagacaaaagagtatatcataattgaagccgtcctaacattttggaacgccaaccctcagacaggtttcttagtagcagatgcattcaaatatgcaggtttacttacttccagaaccatttttacatttatatttaacgaaactggtttgaagaataatggtttgattgaagctacagcaattgaagcggtctttagaaatttatctcaacaaatctcggaagagaacgaaagtggaaataattttgagttcgttttcgaaagattatgtaccatcgccaacagtactatagacttactagatgtcaatgctgatgaagatattgagatacctaaagtcaacggggaaatggacatcgacgatattgaagatgataaactggatttgaaatggaaatattttacagtgattgggtttattaaaagtatattaagaaggtattcccacgaatatcgtgagttagcagacaaattcattgccaacattgataacgctattccacacgaatccactaggagaacaatttcgaattggattcaagaaacaaaggaagtttaaaaagattcggaggatggactacattcgttatcactccgctttttaatttttaatcaatgttacatacctagcgtaattttcctatatataaaatatcagctttatataaatatattattgaaactgtacctataataataaatttaaaattaagtaaatacaaatgcttcaaaatttgttagtattgttttcttcaatcatctttacttaattgtcatcgcaataattaaattaatattttattgttgttgcgtatataatacaacctgaatggtatgctacactatgttacactatgctattgatcagagtttctaatgacgaattacacttctataactatccgctttggaaagtttgagacgaagggcgttacaatcagaatccgtatccaaaggatgttcttcagaattagtcagatctacacctgatgaaacatgccttgcgacagtacttatgctactttctctaaccaaatgtgtaggcggttcgggaaagtaatgcatatcatcctgcgcgtattcgttttcatcaaatgggtttattgaatattttgattcagttcttccaatgttatttgaactgccatttaatctaaaattatgtaaatttgcaaatgaagtgtctcttgttaatgacacttcaccgaaatagagacaaaacttaacaaactttatgaactggtctctagtaacgtccttccctgaaaatctaattgtttcatataaatcgataaactccttcgccttttctaactgaattttattggcgttgtgattaacaaattgtgagttcaccacgtcggcaaacgtatcttctagattcattctaacatctaaattgttcagaaacaatccatggtatttcagtctatctgttaaactttttatacaatcagcatagtttaggtattctggaaataacttttcatctaatgggtagtcacatctcctcgggggctcaagtccgtcgtgaataacagggtctttaggttttttgagaagaattgttaattctttagatctttccatgttctgcagtactgcttccctactagaacgatgcgggagatcagcaggtgtgatcggaatatatcttcttggtatatcttttaaacaactcttatgaaatagcattcttccaataataataaagatacaaaaaacgccaaagacaactaaagcgcctacaacaatgaacgtattaaaggcattgttttctgatttagaagcttgtgcaatggaatctatgggtaaaacaactgaaaacccaatcaaaagtatcaaagaaacgaaaagggaagctttgtataaccacgacttgagttttgcgaatccggacatctactgctaagtatggacactcgtgtctatagatagtatcaggccaaagttgtatagcggtatctttttttgaataaatttcaatgtgttttcctctgtttaacctcccactttctttgatgctcaagagcaataactttatcgcaaaataacaaaactttaatatgtgttgtaattttggctaaacccagttcaacatcaccacaaaagaaggtttcctttatgcccttaccctttctgccttcttattctagaatttgttttgatgctgtatttgtttggtccttgttcgtcatcgaaaaaccggcccaaaaacggctaataaaaacgtgaacctgttttaagtcttttgctataaaagatatttatactctaaaaaaagggaaacttttgcagcaaaacaaattttatgcattagttctctgttcttaacttggtcagacaaaattcgtccgtttgtagttgtctgtacaggaattcatcgagcgatattctatcctgaaatacatatgccattaagttacatcctgaatagattcctagtcatctatcagcaaatattcatcttttaatttgaaccaattccgttttgttccatgtagtttcaaccagctattcaatgactgcaagtaaatttggttattctccccaatacagttcaagtgcttcaaggtcaaaataacatcattgactctcattccagtcacgatggaaagatcctccagggtcactttatcataatgggcgaggtcaccttcaataaggtgccaacagagtatctgtgaccaatatttcaagtacccgattagtccaaaaggtgataacggtacttctggccctgatattacaccttctaattgggatagtttgtatgaaaactcgataagtaaaaggcctaatccacgtcgttgatatgggggaaatatcaagatgcacgctagattattttgctgatatgacactaaatctttcgaaaagaatcccatcggctttgttgatccagtttcataaactatgtaaaattcataatgatctactttgaaatacatggatttattgtccagatatagcttagtgaaaagacaaagacattggcaaaagagttgatacttggatccttttactcttcttattgtatattcaggactcttgtattttattttgcctggaacacgatattgaaatggacaacttgcaacatgtcctacaaaccgcgtctgatcatccgtgtatttgaagcagtattcacaaacgaaaagagtgtctagccagtattggctgttagaaacagaggaaagctgacccttggtctcggagcaccctagcctttttgtttcaggatcgaaataaacggcgctcccataccaagtagagaattttttattcagtccaaactgaatctgtcttatgttcctttcgttcagtattccatatagcatctctttttgagtttttttaatttttgctgagggcttattcttgccttttccaccattcttctttccttttagcttctgggtagtcgctgtgagtgattgacttaaagatcttgccattttttttgcgagtgaaaacaaaaagcaactagaaaataggagcctccaatatcaaaaaatcaaacttcaatttaacagattcttagagcgctacatactctatccagttcgatatggacaagacttaatgatttcatcatctcttctgattaacgattctgttattcttcatatttacgcgcctaacatatcatgatgattgggtgttccgaaaattttcattggcgatgagctgagtattgaaagctcattatagtattagtatattattgttaatagcaagtgctatatgctataaaaatgcaattacaacccaatactaataatagagtgtcttaagaaatataagtatgggtacttacagaaaaaggtttaatgaaaaagccagatccggccatatggccaaattaaaagaactgaaaagaattaggaataagcagttcactagacaggatgaaaacgatgaaagagtagaaaacccagattcagctcccgctgagagttctactacggagccaaatgccaatgcggaaattcttgaacctctcactgaagaagaaaagaaaatgaagaaaagaaaactacaggagttatttaccccaaaggaatcgaaagtttcgagattgaagaagaaaagactggataaatttattgaacatcaattaaaaagagaggaaagaaagacaattattggtaaacttcaagattataagatagatacaagtttgttgacaagctctaaaaggttaggagagggcaggcagactaaaaaggaagaattcaaagaagcactgagtttagaacgtcaaggaagaggaaatgaacaaacaaatgaaatattatacgaagaatatgaaccaaaagtttgggatgagtatggtgaaggagggagctctgaggatgatgacggcgaagatgatttcgaggcttcatttggtagtatgccgaaaccaacggacaatgaggagaagaaatcatcaggttttattgatcatagaccagcaaaatttggtggatctggtcttagctttgggtttagcaatataaaagtcataaacaaagaaagcaaaactccgaagaagaaatataattggagacaacgagtagaaatggaagaattgaagaagcatgggaaagaagatgaaatggatttcgacacgacatctgaagatgatgacgaagaggaggatcaggaagaagaagacaaaatgcatcctagtgaaaacccactcgaagaagttgaaagcgcagatagtgaaactggctcagaaaaatttgaccaaaatgatgttgctaacgaattcaaggattgggccaatcaagaaataaaaaaattggaaggtagagatcaagagctagttactcccactttgaacatcgattataaaccgataattagaaaggaagatttagatgatggtctccaagaagcttatgttccaataaacgagaattccacccgtaaagccttctatgttgaagttagcagatcagatgaaattcagaaagcaagaattcaactaccagtatttggtgaagaacacaaaattatggaggctattcaccataatgatgtagtgattatttgtggtgaaacggggtcaggtaagactacacaagtcccacaatttttatatgaggctgggtttggtgccgaagattctccagattacccaggaatggtgggtatcactcaaccaagaagagtggccgctgtgtccatggctgaacgtgtagctaatgaattgggggaccatggtcataaagtaggataccaaattaggtttgactctaccgcaaaggaggacacaaaggtcaagtttatgacagatggtgtcttgctacgagaaatgatgcacgatttcaagttgactaaatattcctccattatcatagatgaagcacatgaaagaaacattaacactgatattttgatcggtatgcttagccgttgtgttcggttaagagctaaactacataaggagaacccgatcgagcacaagaagctaaaactcatcatcatgtcagctacattaagggtatcagatttcagcgaaaacaaaacattgttccccatagcgccccctgtcttacaggttgatgcaaggcagtttccagtctctattcactttaatcgtagaactgcattcaactatacagacgaggctttcagaaagacttgcaaaattcaccagaaacttcctcctggcgctatattggtgtttttaaccggtcagcaggaaattacacacatggtaaaaaggctaagaaaggaatttccttttaagaaaaactccaagtacaacaaagatttagaaacacccgtttctaaaatgggtatcaattcaaaaacaacagatttggaggctgaggatatagacttcagtgtacaagttatcgatcaagataagttcaagagcgcgataagatacgaagaagatgaaggtaacagtggaaacggtgaagatgaggaagacgaagaggaagaagggtttgaagaagtcctaactgaagggcaaacagctaacgatcctttatatgtccttccactgtattctctattaccaaccaaggaacaaatgagagtctttcaaaaacctcctcaaggttctaggctttgtattgttgcaacaaatgttgcagaaacatcgttaactatacctggagttagatatgttgttgattccgggaggtctaaagagcgtaaatataatgaatcaaatggcgtacagagttttgaagtgggctgggtaagtaaagctagtgccaatcaaagaagcggtagagcaggtcgtactggaccaggccattgttaccgtttatattcgtctgctgtttttgaacatgatttcgaacagttctctaaacctgaaatcttaagaatgccagtggagagcatcgtgttacaaatgaagagcatggccattcataatatcattaattttccatttccaactcctccagatagagttgccctttccaaggcaatacaattactgcaatatttaggtgctcttgataataaggagatgattactgaagatggtaaaaaaatgagcctgttcccactttcacccagattttccaaaatgttacttgtttctgacgaaaaagcctgccttccttatattgtagcaattgttagtgccctttcggtgggagatccttttatcaatgaatttgagttgggaataaacgaaatttctagaaaaccaaatccagatgaaaatctagatgataagattagagagcacgatgaatcaacaccaggtatggatcctgaactgaaaaaggaattgcgcagtaaattctataaaagcaggagtcagtttagtaaattagacaaatttagtgacgtattccgtttattaagtgttgtaagtgcaatggactacgttccaaaggaacaaaaagaaatattcatgaagaaaaattttttaagaggcaaactaatggaagaaatagtaaaattgaggaagcagttaatgtatatcatcaagtccaacacttcaaaagaaaatattgccgtagtaattaggaatgaagacttgaaaagtgatattccaagcgtcatacaaataaaacttttaaaacaaatgatttgcgctggttttgtcgaccatgttgccgtaagagcagatgttttatttccagatgatgctaagataaccaacagaacttccataatcaacattccttatattcctgttttggccacgagaacaccaaatatcgaggactgctttgtctatatccatccgacttcaattttaaataatttgggggaaatgccacccaaatacatgctctattattccttgcaccttggtggaaataataaaacaaggatgaatactttatgtgacatcgcaagcacccccttagcgaacatagcaagaaagggacttcttttgacatacagtaaacctctgactggtcaaggcttgaagaccgttaatttatcacctacggaacggtattgttatgtggttcctagatttggatccacagttgacaacgatctcaagattggttgggatttaaatcctatagcagtgcatcagaagaagcaaaaaggccagtggacagtcattaagtttatcaccagaaagggcttccagaccatcacaggtgaagagaaagaaaaaaaataatgcgctggtattatagaaatagagtttcattatataagaacatataggaagaatacattattcctatctagggcatcaaataattgcaaccacttaatgttaacttccttcataattcaaaacattatgttctatagcactatgtattttatgtcattatatacgtagtcaataactttatacgttttttttattgaacaaaagtaagaattgcttaagacataataagaggaaactcatcgaaccaattcaaaacggattatagatttatcataccagatacgtttatcaggaggcttgtataatggagcacagatataacgtgtttaatgatactccacgagggaaccattggatgggcagttctgtgtcaggatcaccacgtccatcttatagcagtcgtcctaatgtaaacacaacacgacgcttccaatatagtgacgatgagcccgctgagaaaatccgacctttacgctcgaggagctttaaaagtactgaaagtaacataagcgatgaaaaatcaaggatatctgaacgtgacagcaaagaccgctacattaatggtgataaaaaggtagacatttattcactgcctctaatatcaaccgatgttttagaaatttccaaacaaaggacatttgcggtgatattgtttttaataattcaatgttataaaatatatgacctggtaatacttaaatcggggttaccgctttcgggtttactgtttaagaactatcgatttaatttcatatccaagtatttcattatagattccttcttcctgtatgttttaccatcctttaacattcctaggttgacttttaagccatgggttgtttatctccagattttagctatgctactattgaacattttcatatcaagcgatcacgagttcgttttgatttcattaattatgaccacatggagaaaactttatacgaaagaattaagtgtaacaggttcagccattaaccatcatcgtatttttgattcttccgctcattttaagggtgctctaacaatcaagatcctacctgaaaacacagctatgtttaatcctcttcatgaatcatattgtttgcccatggataccaatctttttaaaattaactcaattgacgtacccatcagaataaactcaactgaagagattgaatatatcgagttggaatatagagatctttacacaaattcggtagagttacggtctttgagtaagaaagacttcaaaatcatcgataaccccaaatcctttttaaaaaaagatcagtcagttctaaagtcacattcaaacgattttgaagaaggcagtacaattcgttatttggctgtaactcttcaagatattggcttttatcaaatcaaaaaaattgttgattcaaaaaaactgaatttaaagatccatcagtcacacttggttgtaccctactgtccaattgcatctattactggaactggaagcaatgatagatgtattggcgattcagataatgtttcttttgaaattcaaggtgtgcccccaatgaaattagcatactctaagatcgttaatggtcaaactttttcatatgtagactccagcttgcaaccagaatattttgagtctcctttgcagtcaagcaaatccaaacaaagttttactcaaggagaactaaacgatttgaaatggggaagaaaccaacctgttaatattaatttagactcttccattacccaggacggcaaatttgcatataaaattgataaaataactgatggtctgggaaatgtcgtggattttacatctctccctgaagaattaaaaaagcgctatgatctatcttataatttcaatgttcatgaggttccacgtgcagcgctagaagaaagatttgatccaaagtcacccacaaaaaggtctattgccatcgtgtttgaagaaatcaaaaactggatttcagacattccatatgttattagcctatcctatactgatgcacaagacaagtcgaaaaagataatgaatgttactacagattctttgaccaaagtgttgcaagcggatcttccggggtcatataacttagaatatattgaatctaagttttgtccaggtgaaattgtgggtaaatcaaacgttcttgtaactatgccagttgcacctactatggaagttaaatcatttccaatattggaccagtgtgtgggacaggttggtctaaactttgaactatcttttactggggctccaccatactattataacactaaaatctataagcttgaaaacggtgaaagaaagttatatgatgcaaagagatacacctctgaaggtacgagaaatcgcttcagctatagtccacctaaagaaggtaactatgaaatcgtgtttgatactgtttctaataaattattcactgaaccaatcaaattggaacctgtaaaagaatatactttcaagacatcaatgagggtgaaaccaagcgcatcactaaaattacaccatgatttgaaactctgtttgggtgaccacagcagtgtcccagtagcactaaaaggccaaggcccttttacgttaacatatgatatcattgaaactttttctagcaagaggaaaacttttgaaattaaagaaataaaaaccaacgaatatgtcattaaaacaccagtctttactactggtggtgattatattctatctttggtttctatcaaggattctaccggctgtgtagttggactcagccaaccagatgctaaaatacaggtgaggagagatattccatctgctgcattcaatttttttgaacctatcaaagaagctaaaattaagcacggttctgtcactgaaattccgctcaaattaagtggagaggggccattcaccgttaagtttaaacacatggattacgatggaaacattgtgaaagaatttgaaaacaaatttcagaatagttataagcccgctttgaaagtaagtaaagaagggctttaccaattggtcgatattcgtgactcaagttgccaaggtaatgtgatttaccggaacagtctgtataaggtatctttcttggagaagccaaaatttgcaattcaagacaatcatcacattacaaaagtaacggaaaatttattctctaaagaagaagtctgtcaagggatggaaggtacggttgatttggctctatttggttctccaccattcatattagaatatgatttgatggcacccaacggtcatatttctacaaaaaaaattcaggtggcaaccaaatacgcttcactgaaactgcctaatcaaattcctggagagtacataactactattaaggccatcttcgatggcaattatggtgaaagcgacatacattttagagaacatcagtcggagctcataatcaaacagacagtgcaccccattccagacgtcgcctttgctgatggtggtaaaaccttgcgtgcatgtgctgctaatgtagatcaaatctcatttttggaaccaataaatttgaaatttttacaaggcgaaagcccattttcaatcacctttagcgtttatcacgagagtaccagtaggacagatcagtataccattgacaacattgactcagagaacttttcatttgaaaagttatatgaagggatgaagttaggtaaccatgccattactattgattctgttgttgacgcaaatggttgtgttaacagcctcatatctggaccgcgtaatcaaattcttgtgtcaattactgatgcaccaaagatacatatattagatccttctaccgagtattgtgttggggactatgttgcatatcaattaaacggtgtggcacctttcatgattaagtatgaattcaacggtattccactaaaatctaaggaacgcagctcccaatttgttagattagcatctgaaccgggcattatatctatcacttctttacaggattcatcatcacaatgcattgtcgactttacgaaccctaaattaaagagtgaatttgatgacttatctttaaacatacatcctattccttccgtaactgtttctcaaggaaattacgttactgaggatatccgcgaaggtgaccaggctgaagtaatcttttcgtttgaaggtaccccaccattctcactaacttatgtaaggacagaagagactgatggaaaacacggcaaaaggaggtcgcaggttgttgagacgcataaagtcactgatatatattctcatgaatacaaggtaattacaagcttgcaaggtacctacgaggcgattgaaattacagatgcttattgttttgccaaaaatgatctttttttcaataactaaatattacaagaaagtctgatgaaatttttctttcccgcaatatttttgtacaattgtaatgtataatatatctctgtacatcagtattaaaatacttaagaaagcgaaaaagacgcctgtattgtttgttgttctttttcttcaaaattatcaagacgctcgattcaattatcttcgctcatagtaactcgaaagagtgtaggtgaatgaatagaaaaagagagcgctgagacctttgtcctttacggtctatagaggtgtgttaaaagcagacttttgaacatccacagaaattggctcaatgacctatccgaaaagaatacctataaatgcgtggtctgaagttcatagggtggcaaggccactaattattactttcgacgcatataatacactatacgccacaaaacttcccgtcatggaacaatactgcattgttgggcgtaaatatggtatcaaggcgaatccttcgactttaacaaacaattttccacacgtttttaaaaaactgaaggaagactatccccaatacggaaaatattctggtatcaagcccgaacaatggtggtccatcttgattaggaacgtcttcgcaccaaacgaaattcccgatgagatgataaatgaaatattaatgcggtttgagggcttcgattcgtattttgtttatccagatttgatcaaatttttaaaggatttgaagtcaagacatcctgatgttatcttaggaatagtaagcaatactgatccaattttttacaaattattaaagaatatcggattatttgagacattttccggtcacatttatttatcatatgagcttaatctcgccaaacctgatagagcaatatttcaatatgcgcttgacgatattatatctaaacaacctcatttactcgaaaagtacaccagggaggaaattctacagcattgctttcacatcggagatgaattaaagaacgatctcgaaggggcagaagctgccggttggactggtatactgttagatagaaatgataaatacgggtttctttcaaactcgattagtaaaccaatgcgggacgaatacaagctgtcaattgataaaatagataataattcaataaacacttgggaagccaatactaagcaaactgacacgttacagttgagtgaaagaaagtacgttgtttcgaatcttgaggttttagaggaactctttccctgagcgcctaacgttacagtaacaaatatgtatgatagatattattcatatccgccagtaatatttactatatctttgaatgggtttgtttattaataatctactatgtgtaaatatatgatccaagtattatacagtttagacactgattgttttccagacgttcaaaccgtcagtaccggtacttactaaacaacctgggatttgcttatgccatttgacatctttaacttccttttgccagtgaacaaacaataattgtggtggaatttcttgtagctcttttgtttcggcggcctgttgtttaatttcctcatcgtcagcttctacagacaaatcccacaaagtcacagtattatcttctgagcctaccgcaacgatagactcatctaatgggttgaatgcaatggaagtaatggctcccttatggaagtcatattgagcaaccggttggacggcgtcagcattacttggcgtaaactgtcttaaatcccatactccccatgtaccgttatcgtcaccgcttgctagcaagtaaccaattttatcactccaacttatgacatttacgtcagtattagaagctttaacagagatagcaggtttatgtttttttgatcttgtgtcccaaatccttatatatccatcacatcctgcggttgcaaaaacggtggattcagtgcgagaccactggatatcttctatggatttattgtttgaaacagtaaatggttgtttatcagtcacccatctcgatgtgtgcctttgggtaaaatatatttgtcctgagcaatcacctgatagtaacgcaccagtcttgatcaatggtgaccaatccaacccgtagccttcaacattcccatgattttttacagtgtgaataggacgcttagcagacttcggaatctgataacctggtgtggaaaaagctttgctttgtggagctagattgtatatataaacatcaccattttcgctcattgtagcggttaacacctcttgattagaaatggcaaaaggagaaacctttaatctattggttgtatctctcaatggtatattttcattctcaatgactggatccacatcatcttcatcatcctcttcatcatcttcaccttcattatcgtctttcaaaagtgttttcgctaaattagaaagtgctagaaccattagttcattctcctttttcctggaagattgagtagccgtggtcaacaaaatagactgtggatagtttctacgttcagaacctagtgtatctggaatgacatctaatgtcaagcatggccatggcatattgacattatgtagcatttcataaacagtgggatcagcctcaaggacttcatctggccctaatggacgagacatatggggtaagtaaagctcctggatcttttctttgttgccttcggattggtccttttgtactaaagtttcagcttcttcttgctttttcctaaggtcatcttcgtcattaatctcatcatcgccatcaatttcaataatttcaccatcactatcaaattcatcactcaattgttcttctaggtcattcttgggagcatcttgctcttcagaggcgggaatagcaggaacagagtgagattctgttttagcagagaccactctatcttgttcctcgttgacctcgatagaccttttcgacattatggtgctatttccgtgtatatgaaaacggagagtaggtgatataactatttacctacaaattcaaacaactacaatccctataagaaatgatcatctcatcgctaaattcagttggattttattttctgtatttttcgctgaaaggaaaaaaattttcacggctcgaacgaaaaaagaaacgtgatcacgatgtaagtacaaatggtactctattttgaagcgtctacgttatgtagatgatatcatacttccagttgcatatcgtcagtaacctcatctttagactgtttgttcttcttcttttggttttttttcgctactttccttagcttttcttcttcaataagatttgatctattcgactcaatatagtttacaaaaaaatcaccatttttggtcttctttgcttcgttaagtgtagcttccacattattaaatagttctacccttgtcttggccagtctgtttagtattttgttatctcgtgctccgcattccatttttctacattgtcttagagacttaaatgatacttcaccgggattcatatacctgttttttctcaagttatgccatggtgttatcaagatggtgcattgtggcattttgtttccttgaatggattctgatttacatagctgcagacagtcacatatcacttcttgcggtatgtcatcgattgttttttcatttgggcgtaactttaaataaacatgaccacttgagtacttatccgcgtgaaaccaaacatagtttaactccctatagctccatttgataagtagatcgttttcaaacttatctttgcccatcacaatttggtaaggtgttgaatactcagttggttttgattcatagaaatacaccattgttattgaaaagttgaatttcaattgagccttataattctattcgcttactttctaaattttaagtataaggcagtcctctggtctacagagttgttttgtttttttatccaagttctttgtttcaatcttattgtagtttttttccattaaaatattaaagcctaggataatctatatcctaaactaaatataaattaagagtataaaagatgaaagtaaatagcatctagcattcagaaaaaataagaagtctcttttcaaatgattgatcgagcacaacgaatgttttcaaaccactgttaatttttttatagatgtaatgactacttatatgttctacgatgtgattttgtaggaataaaataaaattcagtttaccgtctgcatattcataaacacttaaatgactgttaaagtattcagtattttaaataataataacataaattattaatacatacttaaatacgaagcccattttggtgggttcctgaaagaatatcaacttttttttactaatagagaatttcgttacaaggtgggcggctaacttataaaaagcaaaggagaaggttttaacatatcgtcaagttaagtttgaaagagagaactaaaataaaaaaaaagagaaaaatgtacgagtactgctcagttgtaataaagaaatactccaagtatacaattccctccttcgctccaaatggttttcaatcaatgcttgagcctcctcagatagacaagtggcaacacctttccgctaactgcactctccaatttcgggttcttctaatggactctagacaaattctgatcaatgtggttctcaataattcaacacttctcgaaaatattcgcctgccgctgggggataatcaagatttaatacaattttcatgtaaaagccccataatctcttgtaaatatatctccgaagaattcggacccagaatgttaaggaggtttcagatgaatttgccaaatgacgttgagttcaacaggactgtagtttctttaaagaaccttaattttgttttaaggacagctaggacatcaatagcccagagtacaataacaagccaggtgcaaggcaataataacggtacaaaggtctgtttcacagaaggtccaaaagttagtagctacacaaatccgaacacgcaatttcaaactcaaaacatgattatggatttcagtcaacgttatcaggaagaatctgaaagagagtcaaataatcgttcaaatataactttaccacacgacagcattcaaatagctcaacaaatatggccaaacacggatttaaatgtagtacaatcttcacaagacctcaacactccaatggctacgcaaactgttttgggtcgtcctgagtcgctaattgtacagccattggaggtttctcaatctccaccaaacactaccaactgccttcctaatgcagaaaacaaaaagaaaaaagtcgacaccacttctgattttacttcaagaaaggagattgctctgtgtaaaactggtttattagaaactattcatataccaaaggaaagggaaagtcagatgcaaagcgtcactggtttagatgcaacaccaacgattatatggagccccgggaaagacaacacggcgaagaaaaataccagtaataagaaaaatattgatgataaactaacaaacccccaaaaatctggaaatacacatacccctgatagaaataaagaagtgctacctaacggcacacttaatgaaacgaggaaagaagcatcgccaagcgaaggattaacgataagagttaaaaacgttaatcggaatgcgtcaagaaaaatatctaagcggctaatcaaggaaaagttgaaagacgaagaattcatgaaatgggtatgtatgcatttgcaagaaactgagctgtttccccctcttatccactcattttctctgacttgacaaagaaatactaactaacaacttttgccactacaaatatgaatgaaaaggttaataaggttgaaacggttctcaataaaatgttcgaaaagtgaaccctttttttgcaattcctttttacactagccacgaagtaaaatggaaaagtaaacccgagtttcggcaatatcgctaagcaagaagagcaagctcgtttaagtaagcctttatgaaaaaaaaacaaaatataaagcattataaaaattgaatcacatcgcaaatctgcaatatacttggaagtgtttatagcaaagtgtggtatagaaaaagaaccaaaggccggtatgtcgttaaaggataggtatctaaatctcgaattaaaattaataaataaactacaggagttgccatatgttcatcaatttatccatgatcgaataagtggtaggataactctctttttgatagtggttggtacgcttgcattttttaacgaactgtatataacgatcgaaatgagtcttctacaaaagaacacatcagaagaactagagcgtggaagaatcgatgaaagtctgaagcttcatcggatgttggtgagtgatgaatatcacggtaaagaatacaaagacgagaaaagcggtattgttattgaagagttcgaagatcgcgataagttttttgcaaaacctgtgtttgtatcagaattggatgtcgaatgtaatgttattgtagatgggaaagaacttctgtccaccccattaaaatttcatgttgaattttctccagaggattatgaaaatgaaaaaagacctgagtttggtactaccttgcgtgtattgaggctgagactttaccactactttaaagattgcgaaatatatcgcgatataattaagaatgagggcggtgaaggggcaagaaagtttacgatttccaacggtgtcaaaatttacaatcataaagatgaactactgccattgaatatcgatgatgttcaattatgtttcctgaagattgatacgggaaacacgataaaatgcgaattcatactatgaaagcttccaaaaaaaaaaaagaaaaatcaattgctaaatgcatacatgcaggtaggcacacacacacacacacacacacactcactcacacatgcacacgcacacacacatatataaatatatacgtactatgtatgtcagttttcgaccctaggaacccctatttggttgtgatgaagctgattttcgcaccaacaccacagtttcattatctgcgtcaatcttggttcatagggaaattcggaagagtagtaattattgaattctaaacctttttcctttccatttgaagaggaaagcaattcagaagtttgattccagtaatttttattttctaagttatgaaaagttgtcgccgctgaacctgtgccaacatttccatccctttgatttagccaaactgaattagcagcagccgtgacctcgttgcttgacatcttttcgttgataggttggtcagacgaaatgtgagttatttttgtaccatttgaaccattgacgagattgttgttatacaccgtgaagttctgcgtaattattttcttgtcggaatttaacaaatctggaaatttggaattattattgctgatctcaaattgaatccttggatgaataaacttcagcagcttctcattaaccagatctgctatcttagatcttagagatatcgagtacagattttgtaacgatttgggcagcttaatgctgccgctgtccgccgaatctgacaaggggaaaagcagcagagtcattgctaattctaactcttgcatctttttgacacttgacgaagcctttattgcaagtttattttgagaatactgaattagattgagtataaagtcgttggaatccttggtgatgttctcctgttgatggtgacttcttatcatctcgatcaaattcagtaacagcagtttgaagtgtaaatctccatctatgtcaaactgctgctgctgctgctgctgctgcctgtcagttctacccgtataacttcccgtagcattgaaagtctcttccagcacctccagcccgaagatagagtttatctcctccatcgcctcattgatacgccccagcttaataagatgtttgatatggaaacgctccttgatcttgtacaaatcattgaaaaccgcaatgtctttgttgttccgtataaatcccagctccttggccatcctaatgctcgagtcttcatatgccatagaaacaaagtagttcaacagaagccgtggcagtgtgggctctatgggtgtggtctgtatggtagcaaatccctcgtcctgcgagccgccactgctgttgggctgaattttcagcggataatgtattgtcttatttgcatatagctcgcccatggcagaatacttggccacctgctccttccattcttccttcgtgaagcacttctttccatacgtaaagtctttcccaccattcttgccttggccgctgcaagatccgctcttcgtggtctcgttactaagagtagatatagtcatttctatttgttaccacacacaaatatatcttcatccggctgatatttgtctctactgcccctttgcttgcaatttaatgaccaaattacacatgttagcttcaagaaaaatgatgtaccatcaaaatgtctcctgcaacgaaccggggcaccgcgccggcagagtcaggaaagcgagatcgacactgatagtgataaacagcaacacaatggagcgattaccattcactcggaacggatccggacaacagtcaaataaactccgggatcccaaaaagggccgtacacacaaacccaagccgagcgaaaaacacaaaaaaaataaaacagggaaaaaaggagcgcaagagaaaacgcacaggagtaggagcagcagaaaggggaactaatatggtttttccgtttgcttatttttatttttttgttgagtcatgggcacgtcaccgcacaacagccgccgcaggcctgtaccgctacgcgtctatcactgcgaaacatcgctacttctgtcgccgcgtcgacgctggtccagaccacaaaaggatgcacgatcagaagcactgtaccctgcagagttggagatagtgtaaccgtgacttcatttttcaagcgtggtttcacattctttttgcaccgcccttatctcagatatagtttcgttcggttgctttgctttccccaactgaaggtgctggatggcggtttttccggctgctgcgattttccctgcgcggggcccggcgcggaattgtgcaaaagctaaaactcaacggttattttgaaatataaggttataagcaaatttcctaaatttgcttaattgttaatgcagttgttattgcattaagacattcggctatcgtttcctttcttcgtgtcggcaatcttgtataaaagttattttttgagtttcagtttcttgtatatcttggtatatattgaaggaggattttttctttcctggtccttttacttccttgcgtcccctcatatttcttctatttccgttcacggcgtttttttattttctccatctacttttagtgatttcctttgctctaatattgttttcgttcatagtgaattgtttgttttcactttaataaagggcttttacgacttgtctcaaaaaatttcatcgagatgcaagcccccaatatctaccccttctctcaaacacagccacaagcactgcccgggttcacatacggtcctccacaacttgtttttgaccattctgctccgagagtagatcctttgcattctactgtaactataaattctccattacccttgcagcattataatggaccgaatgcccatataaacagcgcaaacaacaactacgcatactactatcatcatcccaacaataatgataacaacaaccatagtaacaacactataaaaaataacaacattaattctgttcttcccgccgttaatattcaaatatccaacaactcacattatagaaatacacaccaaattccttctgctcctcagcggctggtcagcatcataccggatccccacatgccgcccaatatttctcactttcagctaaataatattcaccctcaaatgcatgctcctgttgctactgatattcatttccaacaagtaccagtttacaataaaaccaataatggcattggtactgataacattaataacgataaacccgtaaactcgaatcagaatgaagtgctggacaatattgatgaacgttcctgtcatgaaattaacagggtagtttcattttctaaacattttgaaaacaacgaacttaccactacagcaaatgatctaaacattcaatctactatggatgaattagctaaactgaaatctttatcaaattctacccatttcaggcagagtattgctactcagaatttccattctttacaaaatcatatcacaaccatcgaaaaccgtctggcttctttacttactgacagacaacaagagcagcaacagttgaagcagcaagagtctgaaaaggagagctcttcaccgttttccaataagataaagttaccttccttacaggaattaactgactccatctccacccaacatcttccaacattctatgacaataaaaggcatgcttcggataccgatttaaagagtagcaccttacatggtccattatatcaccgtcacgcttttctttcaacctcttcttcctcaccctcccccacggccggttccgcgcctcttcaaaagttacaggttccaagacaagacgatccaaacgataagaaaatgaatatttcatcatctcccttcaattcaataacctacattccaaacactacgttatctccaatggtgcaaacgcagttaaagaacttaaccacttctaacctcaacacgaaaaagaagaataacagaggcagaccaagagctattcagagacaacccacgctgaccacttccagccatttcatcaataattccaatcctggtgctgctgcagtttcaacgacaactcccgccgctaatagcgatgaaaagaatcctaatgcaaaaaaaatcatcgagttttgtttccattgcggggagaccgagactccagaatggagaaagggaccatatggcacaagaactttgtgtaatgcctgtgggttattttataggaaagtcaccaagaaatttggctcaaaaagcagtaatttgttgttaagatatagaagatctattgatttagccaacgatcgtagaattcctgattttatcactattccaaacaggtttattcatgatatggataatgatcaaacgttggactctgagtataatacgatattgcaataatataaaatcatacattcatataatatccattacgtacgtacatcttacataacacatttttacccccttttcttttttttgttttccttttttgttttatttagccgcccgcgttttcctaacgttttcccaacattgaaaccaattcgtcatatacctcactttccataaattgtttagattcacagtgggaatgacttcagaacacttcaatttacaaccaaatttcactaaatcgttaaaactactgtgttcagaatatggtacgttaaaaacttgaaatttgttgtactttttgtattgcctcaatatactcgagatttcaaacccattctcatcatcattatctcgatcattcttcattagttctaagcaatattctgtattgccactcatttcattctcatcatcatcgtttttcttttgatattttaaaccaaaattgtgactccacccggtaggtataaacccgacaacatcttcaatgtctttcacatagtctgtttccaattcttttaaacttttcaagtaagcttctatggtttcttgacttttcaacactcttataggtaccaaatgtacggatgattcatgtaaattgctggtgagtaagctttcgtcccacatgtcattttgattttcgttgttttgtaaaactgttagcatcattgaaaatttaacggaattcggcataacaaataattttgttttcaaaaattcacatatcttgatggctagcttctcttttccaatagtatatgttcccacaagaaataggaccctgtaacgatgagttgtcaatgttttctttctctgaaagtgaaaaaggttcctttgtgaatctccaaatgttttgtttttaccatgttttataagccgtaatgtaaaatcagccacagtctcgcacacagaatgttgtgaaggaaagttgtatcccatagtcatatatgttgtatctaaataaacttggtcaatagtttcattcgctgtctcggccaaccacttctgaattgtctcaatcattttggcgttgcttcgaaaatcccccgtgtgaagaatttgtcttataggcttatcatacgaatttgccagaaactcctggaaaagcattattattgcaccgggacaatggttagcgtccaacgtaactactgaaatggtatctgttatccaaaagcgtttattcatgggtaaaatttggatttcatccattggaattttgaattttaaatttactaatattgcagtgatcttagaacagtaaagtgttttcttgatcggattctcatcaggattgttccaagattttttgagtccaatatagtgatcagaatgaaaatgagaaagaaagtactgagagatagtctcgctggccttataattgaaaccatccacaactatttcgtggccattattgaacttaattatcttgaaacttggtaaaacaagttttactcttgttggtttttttgacgtagctatatccctcttcgtttttgcaggagatgatggattagaaataaagctcctgatattctttttaggtgttcccatattgctcgggtcactgcctatgcaagtatcacagtgtgtctctctttcgtacaattctaaatgagaaaggttttctagacaaataggacattgaataacttctgtagagactttaacatttacttgctcctccaattccgttactattcgatcttcggtcctattttctattgcgctgacttcgttatcatgcaagctaactagttcttcctcgtctgtgtctatggtgatttcgacctttgcagtgtcttcaaggcaaatgctattgtgatcgtcatcgttaataattactggctctgtattcttattggatgttgaacaactgaaccttgagaatgaatatgaactggaacggacaggtaagttcgatgaagttgggatgttgaattctgtcaaagttctctgccttttagaggatgtatgtgtgttcttatgaagagttttcccctcacttgtactgctagcggtgctacttcgtttccgctttacttcagatcttcttatttgcactatagatttccttgacataatcaaccgaccacccaaattagtcactagtgcgtatgctgcttaacatgagttttgacgcaggtatttgattatgtttatattgctattttactagtactttttcagtccgtttccatgacaaaatctaaaaagccatcgcactaatttataaagataataagagggaagcttaaggtgtagaagaatacatgggactactaagtattatcaggaaacagaagctcagggacaaagaaattcgctgtctgattctaggactagacaattcggggaagtcaacgatagtaaacaaactattgcccaaggatgagcaaaataacgatggtataatgcctactgtgggttttcaaatacatagtctgatgataaaagatgtgacaatatctctatgggacattggggggcaacgcacattaaggccattttgggataactattttgataagacacaagcgatgatatggtgtatagatgtgagcctttcaatgcggtttgacgaaaccttgcaagaactaaaagaattaatcaatagagacgaaaatcgaataggatacgagtgtgctgttatcgttgtgttgaacaagattgatttagtggaggacaagtccgagcttcatcgaaggtgtttactggtagagagcgagttgaagtgtctgttcaagccggacatccgaatagagctcgtcaaatgtagtggcgttaccggagaaggtattgataacctgcgtgaccgtctggtggaatcctgccattttacccaataatcgtctaagatgtgagcaccatataaaaactttaaataatgtcagtatttatagcgtgatagttcattacccgccgactgtgcgcattcgtggcttctgctcactccggataataatactaccaaggggttctgtaaggcttgcgggttacaaagcacgggtccattgaagatcttacacaagaaggagtggtaggaagaccagcagattatttccaatcggtcgttgccattgtcttatttccttttctttctggcgcattgcattttaacacctttttttccagaatagccaaccaccgacgtctgattcacacattactgggcaagatcttgacatagcattacattacaacacggcaacactaatcacgcaacgctagaactcgcgcaggatgaatattcaaagcaataattctccgaatctcagtaataacatagtgtcaaaacaggtttactacgcccatcctccacctacgatagacccgaatgatccggtgcagatatctttccctaccaccgaagtagttgggcatggttcgtttggtgtggtatttgccactgttattcaagaaactaatgaaaaagttgctattaagaaagtcctgcaagataaacgattcaagaacagagagctggaaataatgaaaatgctgagtcacataaatataatagatctgaagtactttttctatgaaagggactcccaagatgagatttatttaaatttgatactagaatacatgccacaatctttgtaccagaggttacgtcatttcgtccatcaacgtacgccgatgtcaagattggaaataaagtactacatgtttcaattgttcaagtcattgaattacctccatcatttcgcgaacgtctgtcatagagacattaagcctcaaaatttattagtagatcctgagacctggtccttaaaactgtgcgatttcggcagtgcaaagcaattgaaacctactgaacctaacgtttcctatatttgttcacggtactatagagcaccagagctaatcttcggcgcaacaaattataccaaccaaatcgacatatggtcctctggctgcgtaatggcggaactgctattgggccaaccaatgttccctggagaaagtggtattgatcaactagtggaaatcattaaaatcttaggtactccatcaaagcaagaaatttgctctatgaatcccaattatatggagcataagttcccgcaaattaaaccaataccattgtcacgtgttttcaagaaagaagatgatcaaactgtggaatttctagctgacgttttgaaatatgatccactagaaagatttaatgctctacaatgcctgtgtagtccatattttgatgaactaaaacttgatgacggtaaaataaatcaaataacaactgatttaaaattgctagagttcgatgaaaatgtcgaattgggccatctatctcccgatgaactatcatctgtaaaaaaaaagctatatccgaagtctaagtaatgatagcaccggagggagcccaggcaagaataatgggagaaggaaggaacatatatacgtatgtctttttttagtactattattactgttattattatgagtattgtttttgtattaccatcatattcttatcattattagtagtaacagtattatgttatcattactgttataatgaatacaaattatgaaaaaaataaggtaaagccaaaataaattgtaacttttttatgccatttcacttcgaattatgtataaaagccgtattctttgccagtacgaaactattttaatgacacctttactttaaccgggtaacaacttccttaaatgggtcgacaaggtttttagagtataaaggggcaagtgaaggttcatcatcgagctgatgtagtgggtgttttagtaaacgaagaagcaccttagaaccaaataatctagctagtataaaccgaacccagagtagcaaacaaaccatgggtaatgttccagggaaaatagaccaggaagatagttttaatgatgtcaggccagattcctcatataatactacatcatcgaattctgtcatcaaacaatatgatgaagaagcctcttcaagggtgagaacgagacgcacgacgtctttggtcaataatattttaaatgggaataatgctcgtacaaaaactggttctcatctatccagcactagtagaagaaagacgtcacgggaaaaagagcttgctaaagaggcacatgctaaacaattggttgtgaggtgtagcgaaactgtagatggggggtttttggccccatttggctgttattcttttgaaaagttggactatgatgctactgtcgttaaaaatttaataatcaaaagaaagttagcgccgttttacactcctttgcaggattttgatgaaagttggactagagatgagttgataaaaattgttgacggattgcccttgcatgacacgttcgatgaaaatttggaagaattcgaagacgtaccgataggcaatttaaggaagtcaacatttaatgaattaatagacaaatctttatccaagaaggaacagagaagaatgcacgcaaagatttttagagcaagattgtataagaaaagaattttatggcaagaaaatgaaaatgagacgtttttggagaggaaattggaaatgaaaagaattggcagcaagtccagcaatgttgaagataataccagtagccagccaaggaaaaattaccatttaccaagtgacgatttgaagtatactctttacaaaaatgggtcggaatgccctatttgttttttatactttccagggcctttcaactattccaaatgttgtcaacagcctatttgtaccgagtgttttgtacagattaagagagctgatcctcacttccctcatgacgaagtagacccaactgaaccacaaactaatgacagtgaaaaggacccaaatcttcttacctctgagccagcaaattgcccctactgtgcaactgctagttttagcatcacttatcaaccacccacaaatcgtgaaactggtatagggggtatgccagccgactcatacgtgtataaggacgccgccatatcaagagctgatggcggtcagccaaacatatcagccattacttcggataccattcgtcctgattgggagattaaattgaacaaagaaagggcaaggttgatgaggagatccgcgaatgccaccgctatacatataagtaataggttgatcgatccaagccatagcagaaggagaaatacaagtcacagtataacccctattcatgatgaaagtacgtcagcttcaagatctcctgaaccgacaataaacgaacttgaagatcaaatggttagagaggctattaggttaagccttgaagatcaggacaaccgaaaaaaatcaaagaatagaaacacctctttgagaccatagcatcacagtttgacattttttacaatattaaaaaaatcctttttcaaacgttccagaagtgcactatttttcttttgttccatctatatctaacggagcgtcaccaacctgaccttccttttggctttaaacaaaatgatccggaaatatcgtcacatttattgtgaagagagagaagttttacagttaattgtattgcaagctcttcccgctctagaaagtttttgttttgttcgtcctcaagaattgagagttcaagtatttcacctcaaatttgcatttgaattttagtagtaactaatataagattcccatcccgcatccgccactgagcaatgtcattctctcttttctcgcctttttatggatagaagcacatagacgatggatatcagagaagcgttcacataattaagcagttagttccaaatatgcgtacagtctttatagatgagagactgttaaaaacgaccttccgttcgaccactcaaactgtagtaggagttcttttctctatttatatgcttgcaatgttcgcagaaaaagcaccatctacctcacctccagcttagccaatttttggttggtaaaccgttccagaaatttttcagttttgggcgataccatcaatgtgtcattacagaatattcttgttggcattttttcaggtctaaagaaatttcgatttgaggtaattgctagtgctgaaaggaagaaacacagaaatctgactgaacaatgactttttggcgtgttcgaagaaatcaaatgcattatatataaacgtacgcataggtatatattcaaactcacatatataaaatcttcttttctcttctcacttgtgtcagtgcgtgacatcagtatgcgctttggatgtttatcttatctgagcgtcacaattcagtgataacagaatattttgttatgagtgatggcttcccattatacagtgtacataaaattataccagatataaagacattaaaaaagatgaaacatatttatcagattcatttaatttatttcttcttttcagcttcagcttcagccttctctctagccctcttttctctgatacctctgaatttcttttcggatctggctaatctcaaggttctgaaagcagattcaccattgtcttgaacagctctagcttcaacatcggtagctggttgagcaattgggaaagtggcagcagcagacaaaacttgttcagcttctggagccttaccgtctcttgggaaaacgataatcttggattggtactccttcaatctttgaacgttagcgtcaaagatttcttggtttctgttttgacgtctgtggtcaacagcaataccaatggttctggcgtaagcagcagtcaaaccagcggccttaacttcagccaaggtgaaacctctaccagctctaacctttctgttgtacttaacagttggagctctgacaacaggtctcaacaaatccaatggtcttggagcaatcttggcggctctggcagctctagcattacgtctagaaacctttttaccagcttggtcaaagtgaaccttgacacgttcttgccagtgctttctgaagtggttcttcaaaattggtaaattcttggagatagctataatcataaaaaaatcagttagtaaatttgcttcctttgagtaaacctttatttctagtttctgataaacgaatctcagggtaataatcatttaacctcattattaatgcacaatttacattgcctcgccatgctgattcctctaaatatctcaaggcatccttttagtgcaacccgcctatttataaactggtcaaagtgccaattatctcaaagaatgattcttttgatcttgatttttgcaacgtttcaaagacagcgggatctaattattccacggttcctactgttaatttacagtgttatccaatgcttgtttctacacagctagtttaggcattagttcagtcgttccgtgttcgtttcaatcatagctcttattgcttcagttcaacatacccattgttacttgattcctgctttacttttccgaaattatttcctattaatgttacattatgttctaacttcaagtacctctaattacatagtatgtaagaaagtaacttcccaatggaggatggtgagcaccggctccgagtaggttagtaatgtgtccttgcaatgccgcgtcagcctgaggagagcgtaccaagaagtcgaatgaccccactagagattcctctagcgaggccagtggatgagatggaagcctacgcaaggcaaaagattacactcgcgaacgtgcgtccgggatgatacagtatttttttaaaaactataaatgtatgggtgcgtaatgtacagattttatggcactgaaaatctttttcaagataatctcaccgtattacttaaacatcagtacatattggcacccatacattataaaatcatctcggaaatggaaaatgctaaggccgtatataaaaattgttggcggcctggtaagaaaagtaattgacgcttgattttccttgactcccgtccagtttagcacagcggacgattggcagtttgctggaattccaagagttaccgcttagcgcaaactatcgtgaactcgctgcaacaactgagagggcaaggatatacataaaaatagcctacaaattctgaactctgtaaaggaagcctcataaataaaggtagatagtaaagtatacaagagaagaatcccaagatgtcagctgtcccaagtgttcaagtatgttttcagttctgcagaatgatgtttgatagtatcgataatggagtgagatcaagagaaaaaaaatgaatatgtcagccaaccaagttctgagtaggcagtaaatgagtacgcatagtgtatttatccaaaggaaagaattgttatttttacaagccgaattgagatccaattaggcaatgttttggggagagtattttgacaagattggttaaactactacggtcagttccgtaaccagtacgattgtacacataaggaaacaactgtaaagataaacaataagggcttccaatgccattgtaagatatcatattcctaaacaaaaatgtacagcgaatataaagccagcgtcagtgtcttcctggaaggttgcgcaactaaagaagttgaaattaaaatggcaagcgctacattttcatccattttcactcatcagatgtccaagattttcgaaaaataaatattctcatttttctctcaatgaaataattgttactaacattgaatttcctcgtaactaattgcattacttctttagacttttggtaagaagaaatcagctactgctgttgcccatgtcaaggccggtaagggtttgatcaaggttaatggttctccaatcactttggttgaaccagaaatcttaagattcaaggtttacgaaccattattgttagttggtttggacaaattctccaacatcgatattagagttagagttactggtggtggtcatgtttcccaagtttacgccatcagacaagctattgctaaaggtttagttgcttaccatcaaaaatatgtcgatgaacaatccaagaacgaattgaagaaggctttcacttcttacgacagaaccttgttgattgctgattctagaagaccagaaccaaagaaattcggtggtaagggtgctcgttccagattccaaaaatcttaccgttaagaaattgtggggattatttttcgctcttttcattttcttataattgtataccatcaataaacacaacagcctttaatttacgtaaaattatatcatggtttctatataaattacgctattacgcaattaatacgattgcctagcggtggaatgcgggccgttattcatgagacccatacatctcatagaaagcttgacacacgtcaaaattggccataaacgggtaaatgtcaacaaactaaatttcttgacgcgaaatcgagttgtttatgatgctaataatatgtagacaataatatcgtgtactgtgtttaaataaaatttatagggaagaaggagttcaaaacggtatccggggctagttgtggtattttcaagtgtgctaacgctattaaaagattgtttggactgcccgtatttgctttatttttaaggacaaatttaaaagtcatacagcaatggaagaaaataaacttagtggaaataaaccgattcaacttgctacctggtcgaaccagatggggtcaccagaaaacaatggaaataatgcaaataatggtagtgatgtacagaatgttattcagaaagctttaggcttgattcgacagttgaacaataatgggctaatgagtccgatggaagaagagcattcgcaaccttcatcttcacaagagacacttagtgtcgatagagagattaatgaacagggccgtttgcgtcttcttatgcaagcaaaagatgataatacgcggaaggaagtaggcacatattctagtccgatggattctgcgtacgccagggaaaatatgttaaacgttttgcaatcattagttacgcatctgaaccaagctgtcagccaaatacaacaattaaaattcaagaacatgattcttacttcaaatgaaaataatattcagtcgaggcatgaagtggaagataatctccagaaacagcaatttgaaaggatgaagtgtcagtttctattggaacgtcaaagtttgaaggatcaattgcgaaagcgagagaataaaattgttaaatataagcagaaaattattgaaaagaacaagaaattaaacaatctagcaaaagtacttaatcaacatgcaatatctgatacctctcaaatagatagtttcagtagctcggtaaagaaaacgccttcgtcgactacaacgccccaagaaatgaagtcggacatgttgaacaccttgggaatattggccacacatgtcttgaaagatgaaattgacgatgattctggaaatcaaacgattctgcaactggctgcagggagtataagcaacgattgtaacactacggagttggaaattacgtgcagtcctgaaatgggaaggactattacacacaatcgaccaaatactaaagatgagtcaattcaggattcacatgggaataggaccctccaattgcccaaaatgaaaagtttcagtaccatagacggaagcattaaggatattaagtgatcaaagatactagataatgtttgttcttgatggcaagaaatacacaatgtcaacacccgcgctttctcttcgattcattagttgatatcattaacattatattatacatactttatttctcttggaaattaaatatttgatgatggtttatctaaatattgtctcactcattttcccttttttttaagatagaatatcagtttgaggcaacaaatgataaattatgattatgtatataaaacaattttaattttattagcataaaaaagggacaaggcctctgctaaaatatcgataaaaaaagaaataatatgaaagacaaaacaaactaactggaaaaaataaaataaaaaacaaaactgatcatcatttaaaaatgttattctcttgtatctatttctactagatagatgaatctctacccaagaaataaactttagcccaatccatagcgacaagaactctgtttctaaaggatagacacattgccaaataagcagatttccagaataggaaggtgaatgagccggctaacctatatttggcttcaccaacggcaagatcagcaatggctttatctgaaccaatataagccagagcacccttatggttgtacttgaagtcttcaatttgcgattgcgttttgactatttggttctttaatctagcgacttctgaatcgtctttagcatgggtcattttccagttcaattgatcgattttataagctttcttgaaatactgagccaagtattcaccttcttggtgggcaacttgagcggtagggaacaagccagggtggaaggtacaatcgccgatagcaaaaatagatcccttagcacccaaaagttgaagtttgttatctatcaacaaaccacgtcttgagtcctgttcctctaatttagtcattaggttcttagacacttctcttggcgcattacctgtagcccaaactaatacaccatacggtatattttcaatgtcaccatcgccagttttggcagttatagtggtagcgtcaactttcttaaccattgttttcaatcttaaatcgattttttcctctttgaataaatcttgagcatagtcaacgagatacttgtcaaacatgttcaaaatgtttggcaaagcctccaccaaagtgactttaatttctttactcaattcgggcatccattttctcaagtcctggtcaacataatctctcaattcagcggcaaattcgacaccggtgggaccaccaccaacgacaacaaagctcaacaatcttgctctctcaggatcttttggagatagggaggcagctttctcaatactggacataatttttaatctgatctcttgagcgtcggatatttccttcaagaaagaagaatattcataaactcccggagtaccaaaagtgtttggttgagcacccacaccgacaaccagatagtcgtatttcaagtccaagtcgtagtcgttattcttagcggaagatttgaccttaattgttttgttttcaggatcaacgtcgtacgcttcagcttcatagtaatggacttcaccgtgcgatcttctagcaatagtcctgacaggttcaacaatagatttcaattcgatggtaccaactggggtagatggcaatagcggagtaaaaagaaaataatttcttggagaaacaacaacaacattatacaacgtggtgtccaaatttttcaaaagcgacacagaaccccaaccggagcccagaattaccaaagtcttcctctttgaaccgtttggaaaagtgtccgattgaggaacttgggtagaagggttagcttctcggtaaagtgagtatgaaacgtaagccgtacccgcgagggcagaatacaataaagccttcaaagtaaatttcccagttctcttgaaaaaggactgcttcgcaacaacgccagtagtgggcgccactttttgcaaaatgactttcttgtcctctagcaaatttcttgctgcatggaacgatctatttttggcatatttcacaagccccgacttgctctgtaggctaaacctggaggagttagcccacactgttttcattaatgattgtctaatcattattattggttaattttttatttgctctaataagtcaatattatgatgctatatgaagaatattagtgtgaaaatttttttcctttttctctctttaattggtttaccagaatatataataaaagatagtagctgcgtataaatttagtctaaatactaaacatgcaaaagaaataatgaagataaaaacaatcgacacacttatagttctagccccaacagcacaaaagcggaaaaaatcaaaatcaagaacaggccaatgagcgttgtcttatataacacaacctcttttatatatacacccaagaaggagaatgaaaatagaaacaccacacgcttcgagacaacggaaagaaagcataaggagtggcccatgtgtgccaaaactcttctcattgccgagccatgtattaccatcccgatggtgatggttgtgaatgcaaataccgctgaggccagagtaatgccatagcgaggaccagggcatctcgagcatcgtggagaagatccctgtcgctttctttttttacctcaaaaccaaatgcgatcgacgggatcgcggcaactttttatcggtcggaatggttgagctagggcgttttcgtaaggggcggggtagagttagaattgtagttttttttccgtagtgccgtgcccccattaccgaatctcggcattgggtaccagagggttagtgcgatagttctttagcaagatgttaaacccgcctatgcccgggaactgcatacagggaagatctcaccggaagattacctcgaaggggaggggtatgtgttttttcccctcgtggttaaagtgactctctattaacgtaatgaaaagtctaaatattataatgacttgcacttcgtatcaagatatgcgagagatcataataaacgaaataatatccacagtttgggtttcatattcttatatatatatacgtgcgtatatgcatatatgtatgtttactatacatcaacatcagcatcaaaattaacattaattagcttcttgcatgtgctctttagcttcggcggccttctccacgtcgtatttgaaatcaaagtaagatttttcgaaatggtgtagacgtatgaacccatcttcaccaccggaggcataacttgtgccctgtgggctaatggcaactgtgttcaagggaccaaaatggccttgtactctgccgatttcttcttcgaagatcttgtggtagaacctagcttcaaacttaccttcgttggcactggtggtggtgacatccttggcctcttgaccaccaccaagaataatgaattccttcaatggggtgattacggcggtgtttagaggacagtctgtttcgtatttcttaagaacttgtagagtcgatacatcgaccaagaacgagttagtatctctggatgatgtaataaagtatgttaaatcaggagaaaattgcatgtcactgatggacttttcgtgcaaatcgatggaatccacgtattcgtagttgttggacacatcgtatttgctgatcttaccgtctttatggcctgcaatgatgtatttgcccttagtcgaccatccagccacggtggcagcgtctaaaccttcatgagtgataattttatggattggctcttcggagacctttgttaattcgtgagtggcggaatctctttcaatttcgtatatgttaatggaacctggatttttcatgacgttgtccaagatagctagaaagtagttaccgcatggggaaaattcaactcttttaacggggacaggcgatttccatgtagcaacacattgcccgtttgacacatcccataatttgatactgtaatcagcacttcctgtaacacagtacttggtgaaacagtcgacgtcgatagaccaaatggtaccggtgtgaccatccaaagtacctaatctttcaccgttcaacgaataccaaacactggccgagctatctttcgaacatgaaaatagtaaatcaccttctttgttgtacttcacttgagttaatggacgttcatgacctgttaatttgatagccttcatattccttgtctgtgctatttctttttgtcttctctcctggccagttatctaacgaccttaagatatacctcgcctcttgttcatcagtaactcttctgcaaatttttctgttcagttacgactattcgaaatttttcagaggccggaaaaaatttcacaaaaaaaaaaaaatatgcgaaactgaaggtggcacgcggggtaactgatatatttcatacgaacagcggctatacagaaaccccactatatttacaaagaaatatgctctggaatctacctacaagtgcgtgttaatgagcttgagtctataaccatagttgtgatgaaaaagtacttcttgcgcgaaaattcagaggataagacaacacaacagagacccgctgaataaggtttctcatctcaatcaattacaccgtagtgtagggttttatcagctcaagcgagtttttcaacccttccacaatcttctctttattaataaatatgttggagatatctcctgtatgggtaatatgtatatatgtaaaaaaaaaaaaagaaaaacaaaagaaccaagatcgggctacgatggataaaaaaaaaagaaaatctgactactcacaaaactggtattcatctgtactttcaagacgattaaaataaaaagtgacatctgaaaaacatccaatactccgatggcagccaggaatcgtagaaagaataacaagaaaaagtcccttttggtaacgagtgccgctcaagaaaagaatgcgacgtatgtgctcgttgcagaggaattacataaaaaaacaatcgatctaaacatgggtactgaaacacctttaacggaaaaccacgagaatcctataccagcgaaagaattcaagcaccagcaaaaattagagccaatagacgaacatgatgatggcgaagacgaattatcgataaaatttaagtccatgacaaaaagctcggggcctattactgaggctgaagttcaaaagctgctcctaagctatgccttcacaagtgctgcaatacaggaggacgaaaacgagaaagaatcgcgtcactatcctattaaaccgccttcgccatcagcttcttctttgtccgcctattttcaatccttcgttgaaaaatgcaaacaggttttctacaacttcagtctgcaaacagtagaaaaattaaatgctctacaaaatagcttgtacgaagtattttggattatttttatttatttaaactactggttccccaatgtgggtgactatgtgaggtatgtctgtcgtagcttctcgcgccataacgaaattgcccaattactaacacgtatttttacttacaatatcaaccacctccactaatgaacaggcacagtatagaaaaaaaatcagatctgcatttaaaaggctgtcttttccaatgatcctcgaccttagcgcggctaatcaattctactcacttttttgttcgcttttttttttttgacccgttgaaccaagcgggttaattattttttaaggataaaggctaccacaatcatgagagagacaccatgtacttgcaggattctgatattttttctatgcttgtttgctgacatgcagattcggagctggttttgatatttcataatcacctatttttgaagcaatacttttggacaacaagatagcattattattaggatttccctatcaaagagtcatttccgtgcacttcgtgaaaaatccagtcagaaagttcagcaagcagtcaagaatatctacttttgtttccaagaaaagccttacctgacagcgttcaaagtctcctttgccattggacttgttattccgtgttccctactttttttgataatggtttctaccgctacatttttcttttttgtttacttaacccttttcgtagtgataggtttcttctcctcattattcataatacccttattgggcatttcctttgtgtttgccattggcgtggtatcatttggcttctgcagcaacatgagtttcaaaatggcccaactcatttatgtccgagctgacgccttcttgaaaaaagtcctcgacaaaatggccctacaaacacagccggcacaactacaggaaccacaggagccactttccacattaaggccagtatctaatccaactattccaagcccattaagacaaacggcgcgcccttctaaattcgtcaccgaagaagatgttattttcgaacctgttagtgctcaaagcgccattgcccgttcattagagactactgctaataaagcgggtaataagttccagctctcttaacctcggcaataaaaaaacatttttcgcaagtttagcaggtcaataataataatatccttataaattacactcagttttttattacatatgggcctttagtatatacatacgcatatatcttagctttaccgatcttctaatattgcggcctataacgcatagaccataaaagaaacggagcagatgcaattcttcaaaacacttgcggccttggtgtcgtgcatatcgttcgtcctcgcttacgtggcacaagatgttcatgtatcattcccctccaccgcaggaaagtctagggtaatgatcggtaaagttgaacccagaataggaatcgatgaaactgttccgactacaatcacagttgaagaccctaacgaggtgattcaagtaaatttcgccattgagtctaccaacaaacccttccagaacaccttattgataggcttacctaataagaacctagaaatggcttttgaacccgaaattaaggacaatggcaagttgtccatgtataaatacaggatagatttagccaagctggatgctgctttgttgcaagaggcttccagatcaccggaaccaataaaggccactttgattctagcgtcatctaccgccaaaccaaaggaaaacttgttcagggaaattctgcaactcaacctgaacttcgatgtagatcactcagattcatctttagttgacaaattcggcattaagccagaaatccatcatatatttcatgccgagccaaagagagttgccaaaccaattgctgtgatttttgttttaattatcttcattaccattttatctttaatagtcacctggttgaattcttgtgccgccgcattcaataacatcccgaccggtgtcactgctgtatatttcctaggattcatcgccacgattgttgggtttgaagttatcttcgctaggtactacttgggtacaagtatttttgaaactctattttcctctttgtacttgggcgctccaggcttactgacatctaccaagttcctgagatcttttggtcaaacaatctagattgttctgaagatcaaaataatatatatatatatatatatatatatatatatgtttatacacttaacttacgtacaaaaatatagatttcgaaacgaatcagttgctcttagcctgcacatctagaaatgtattattgatccatttgaaaccccaaatattgcgtatcgaaccgtcccagaagggcttgtcaaaattgttagcagctacaatcttgcccatgatcagccccatgggtaatgcattgtatgttcttgaatctaatgaatgtgacaaattatctccggttacccaaacatgaccttcagggactttaatataggtaccaaacctctcctcatcaacaagcacatcgccgacataattaactatcgtactgggatccacgagcacgagatcaccaggcatacccgtaacccttttgcaaatcctatgattagggtcagtaggtttcagtgctactatgcagtcacccatttttatgcctctaccattttggaaatttttcaagacatgcacataatcattggtcgctgacagtgttggcaacattgattctcccctcgtctcagtaaattcgtatgcatacatatgtattatatgcaagaagcataatgacctaattgcataagaaaaggtttttgaccagatgggaagtgtaccaaccgtcatccctggtattgtacactgttggatgattcactgtcttattggtccgtttttgtttgcaataatatactggagcatttttattgaaggaatgttttttccccagaaatacttagattgtcagagtgttataaatttgctgtgcggttcaaaccaacagaagagaatattcaaagaaaagctcagaatatatcaagtccatattcaagagaagataggttgcagtaaatttaacaccctactcttaatttatcaactgggctcacgacataagatcaacagacaaataaacgacctactgtgtaatttatgcagtaaaaattacatgattatgctattatatgcagaaatcattatttactcttctttttcctgtgtactgtcggcgacgattttcttaagaggattcctgctgtaaaatcctttcagtgccctctaaagttgaggggggcaaaaatactgtcctccttttaatacataaaaaaatgactggcctttatttgaatggagtaaaactaaaatatttcggcgtttctattatcgaacaacaaaaggtaatactttaaaactatgtcagacgagattgtaaccaacaaatctgttacttatgttaacaatactactccagtcacaattacatcatcggagctggacttgagatcatgttatcaagatgacgaagttgttatagaagtccatgctgctgctttgaatccaattgattttattactcaccagctttgtaactcctacatatttggcaagtatccaaagacttattctagagattacagtggtgtcatcattaaagcgggaaaggatgtcgacaatcgctggaaggttggcgacaaagtgaatggtatgtacagtcatatttatggtgaacgtggtactttaacacactacttgatactcaaccctgccaaagatgtacccatcacacatatggtggaggttccaaaggacgaaaatgacccatatgacgactttgtatatgctgctgcctggcccctaacatttggtacagccttttctacattatacgatttcaagaaagattggacttctgattcgaaagttctggttattggcgcttcaacctctgtgtcatatgcttttgtccatattgcaaaaaactacttcaacatcggcactgttgttggcatttgtagcaagaattccattgaacgcaataagaaattaggatatgactacttggttccctatgacgaaggatccatcgttgagaatgttaagaaattaaagcaaagcgtgttggaaaacgacaaatttgacatgatttttgattcagtgggtaaccatgatttcttccctgtcattgatcaatttctaaaacctaaggcgaaaaattccttttacgttacaattgcaggaaataacaaggccgattataagaatatcagttggagagatttcgtatcattgagttctattttaaaggctataaacccattcaaaaaatacaactggcgctttggacacccttatccccccaacaacttcattgaagttggcaacgaaatgatcaagaagggcacttataagccacctattgattccgtctacgagtttgatcaatataaagaagctattgacagactgatgtccaacagagctaagggtaaagtggttgttaagatgaaatgagggcaatattttccacataaacttgttagtatatttagttaaactctataattataattgttattagtttttgtattatttgatgggcattacccgaccgacttgtcatgaagtgaaagaaaagctcatcacaatatttttaaacagaatttaagatgcattagctggcaaactacgtttcaaatatacagctcagctagcccaaattctctctgcactctcaataacatagctttttaaaatggcagaccttcaaaaacaagagaatagtagcaggttcaccaatgtttctgttatcgcgcccgaatcacagggacaacatgaacaacaaaaacagcaggagcagctggagcagcaaaagcagccaacgggactgttaaaaggtttaaacgggtttccgagtgcaccacaaccgctgttcatggaagatccgccttctactgtctcgggagaactgaatgataatccagcgtggttcaataatccaaggaaaagagccattccaaattcaataataaagagatcaaatggccaatctttaagccccgtacgttctgatagtgcagatgtacctgcgttttccaattccaatggattcaacaatgtcacttttggctctaaaaaagatccacgcatccttaaaaacgtatctccaaatgataataacagtgccaacaacaatgctcatagttcagatttaggtacggtagtttttgattctaatgaggcaccgcccaagacctccttggcagattggcaaaaagaagatggtatattttcaagtaagactgacaatattgaagatcctaatttgtcttccaacataacctttgatggaaagcctacagccacaccttcgcctttccgtccactagaaaagacctccagaatacttaatttcttcgacaaaaacacgaaaacaacgccgaatactgcgtcaagtgaagctagtgcagggagtaaggaaggggcctcgacgaattgggatgatcatgccattattatctttggatatccagaaacgattgcgaattctattatactccattttgctaatttcggtgaaattttagaggattttagagtgataaaagattttaaaaagttgaattcgaaaaacatgtcaaaaagtccgtcattgactgctcaaaaatatcccatatatacaggagatggatgggtcaagttgacttacaaatccgaactttccaaatctcgtgctttacaagaaaatgggattataatgaatggaacattaattggctgtgtttcgtatagtccggctgctctcaaacaattagcttccttgaagaaatcggaggaaattataaacaataaaacaagttcacaaactagtttaagctcaaaagacctcagcaattatagaaaaacagaaggaatttttgagaaagctaaggcaaaagcagttacttcaaaagtgcgcaatgcagaattcaaggtttccaagaattctacttccttcaaaaatccacgcaggcttgaaataaaggatggtcgttcattatttttgagaaacagagggaagatccacagtggtgtcctgagctcgatcgagtctgacttgaagaaaagggaacaagcgagcaagagtaagaaaagttggttaaatagattgaataattggttatttggatggaatgatttgtaatgaaaaaccttacccccaaatgtagtgctttggtgcgattccagcatcctgtgatgttcacctacttcaaggttatataattttgtgtgtagaattgtaaaaaggatggatagacagttcttgagataaagcacagttattttggtatcacatcatcggagtatttttcaattctgattttttgactggacccaacaaacaactccaattcatccaattgtccttccgtaggtaaacaactggaaataggtacacttctttctatcatcaatacaacaatgttagtacgagagacttccagatcaggtataacgatgcccccagatggacatgtcctatactcttgacattcataaacacagagagctgattcaggctcgaaaatattacatcgcatccttaatcgtgctgatgattccacgggtactacacgtataaaaagtttgttcgtagaatactttttggttggcaaagtcatctgaattttaagtttgtctgaagtttccttccaatggaacctgttgcgacaatgatatggataagtaccgtatatcaagttaacactccgtaaagttattccagatattaacctccatgaagaggataaccgtatcgaggcaagtaattcaaattccgttgaggctggagggccgtaagttgagcatacaatcatatatttgacattagttaagatgggcacgtcttgtttaaggccctgcccgggctgatagtggttatcaaacattattggctttatcaattcatagtcattaaagtaatatacttggatgttaattaaatcatgtgagctagttgagatacatgcggcgtccataagtacttgataatcttgttcagagtgaacttccaactcaaaagtcggattttgaaaaaaattacaagtatcaaatgaggcttttccctctatttcataaggaaaagagaaaaggactttggcaaaaagactttttgtatctttcaatctttgaaaacatatttccttcacaactgagaaagagtgaatactgaaattgttgtttgttgttgaataacaatacaataacctctcagtctcagcatctaatctcaactttaccagctgaagtccaatgtgattgccaccgcattctactggaggttcaattggacaaattatgcattcgggagcctcattcaaaaaggaaactgaccgattttcttggctgccttcatcttgcaaatgggattctagcaataaccataccgtctctgtcactttagaattgtttaccaggtgaaataaaggtttatctgcaacgatagaaaatttattgtagcgtgaagtatcgtaccgaaaatgaagtacctgagaacgtttgaataatttttcttggttccaattaagataaagttgtttgaaattttttaaatactgttcatagctgatttcaacatttagtgccgagttcctcggatctcgcaattttactagcctagaatcatatgtgatatcaattatagagtaatcatggttctcaactaggggctttatcatgtcattggaacgattcccggtgccagcgcccatcagacataaattagatttgtgaaacttccataatttttcgaaaggatagctgtttacttgtgttatctctggtaagaagccacttaagcggtaagtatctatactaatatttgagccatccgtggaatatgttcctttagaaacaagcagtaatgcaagctctccaattttgtccgaaatatcgttactctttaaagaaagttgtttgccatccactgaggttgggatctgcgaaatatctactgtcactagccttttgttgcttccgttaaaacttaaattgacgtgatatttagttgatgatatttgtttaattagagggagattcaagttcttagacctaagattaattagagaagcaactaatgagcaatctggcacatctcggcattgttctattccgcctgaatagtcttcttcattctgtaacttggctctccctggataacgcctttgtagttcttcagtaccaggtgcgcaatattcggttttattccaagaaaccggtgaggcttctgagataggtatagggggataaaaccttgaattaatagttgaagtaagccataaaaatcttaattgtttatctactttcgacacattttctttcaaaactaaaacggcctcaataaaagtggaatcttcgcttttcattgccaagccaaccaatctattaattatactgcttgagtcaccttctgcattacaatatattgactttatcgcggcattgaactcatgccaatcattcatttttgataccacaaggttcttgtcttcgactgaaatggtcgagtaaccgtttaataagttgtctagagttgattattgtggtccgtttatgccgactaaaagaacatttaactgtagtatcataaaatcaaaaagggataaatatccgcaagaatacaagaaagaagaagtatatatgttttctttaaaatttcagagcataacttgagccatgaaaaaccacttctcctcaagtttatgttgttcctctatttcctacagaaatatatttacatttggtcgatatcgaagatctggagataaggtaaataaatcctgcgcggttcaaagatactcgataaacagcaaccaatgtttcacagagtgccatggtaaagaaacaccaaaatagtaaaatgggtaatacaaatcactttggacatctcaaaagttttgtgggaggtaacgtggttgcccttggtgctggaacaccttatcttttctcattttatgctcctcagctactgagcaagtgccacatacctgtttctgcctcaagtaagctatccttctctttaacaataggaagctcactgatgggaattttagcaggaatagttgtcgatcgaagtcctaaactgtcctgtctaattggttcaatgtgtgttttcatcgcgtatttgattttgaatttatgctataagcacgaatggtctagtacttttctcatatcgttaagtttggtactcattggatatggttctgtctcaggtttttacgcttctgtgaaatgtgcaaatacaaattttcctcaacacaggggtacagctggggcatttcctgtgtccctatacggtttatcgggcatggtgttctcatatctttgctcaaagctttttggtgagaacatcgagcatgtcttcattttcttgatggttgcgtgtggttgcatgattttagtaggctatttctcattagatatattctctaatgcagaaggagatgatgctagcattaaggaatgggagcttcaaaaaagcagggaaacagacgataatatagtaccgttatatgagaacagtaatgactatataggttcacctgtgcgttcatcatcccctgctacctatgaaacttatgcattgtcagacaattttcaggaaacgtcagaattttttgcacttgaggatagacagttatcaaatcgaccattgttatcaccttcttccccacacacaaagtatgatttcgaggatgagaataccagcaaaaatacagtgggcgagaatagcgcacagaaaagtatgagattacatgtattccaaagcttaaaatcttcaacatttattggttactacatagtattgggtatactacaaggcgtgggtttaatgtacatatattctgtggggtttatggtacaagcccaggtttctactccacccttaaatcaattaccaattaatgcagaaaaaattcaatcattacaagtaactctcctgtctcttctttcattttgcggcagattatcatctgggcctatatcagattttttggtcaagaaattcaaagctcaaagactatggaatattgtcatagcatcgcttttggtatttcttgcatcgaataaaatatcccatgacttcagcagcattgaagatccttctttaagagcctccaaatcattcaagaatatttcggtatgctcagcgatcttcggttattcttttggcgttctatttggtactttcccctccatagtagcagatagatttggcacaaatgggtatagtacgctgtggggtgttttaacgactggtggtgtattttcagtgagtgtttttaccgatatattaggtagagatttcaaggcaaatacaggagatgatgatgggaactgtaaaaagggagtgctttgctacagctatacttttatggttacgaaatattgtgccgcttttaatcttttgttcgttttggggataattggatatacgtactatcgaagaagagcaactgcaaattccctgtagacggtgtcatcctgacattgctttcatattctttttcaccatcacaaatgaacattttaagaaatattactatatactggtatatattcaacattttacaacggactacccgtgaaatatttcctcagggtacttgaattcaacgtgcaagttttcagcaaactttatgtcagaatcactgaagtcctttttcctcccagcagcgtcaccgcaataatatatccaattcaacttgatgggagaaatttgttctgaaaccctgtatgcactttccaggtcccttttaaaaaactctaccattcctgtcattggttttcgaactttttcgaatatgttaggatcattgttataactttcacctaagcttgcgaatgtgatcttactatgatttgctgcaaaagttttcggccttttaggtgctgcatatagccataacctgtgtgataacgtttctcctctctcatcgtttttgattgcctttaaaaatagcaaaattttattagtgtacttggtgcaacttttagaagttcttgggacggtgatgacaccaccttggttagaaaatatgactatgacggccgtgggatcattatcaatgatattacacaggtaatccagggtggatttcttggagttaaaattaataaactgccaatcacttgcgcttctactaaaacttatattgggggactttggtttgataattgtatggtccagatcaaaggcataaacgtttagaccatgctcgtcgtgatcaatggattgtggaaacttgggcgtgaacttaatcagaaatggcaggattgttaatttgtgggacatgggctttccttcggttcagttttctatgttatccatctgattttgggatgattttacagattaaaatcgatttaaagccatacgcaaaagaggggaaacgaaagaaacgcacagaattcattcacatagatgaagggaacagaaaatgagaatgttatatgacagataagcagcatattcaggacatatatccagatatatatacatataagctattaacaaggagaagaaaccaaaaaaaaaaaaaaaagaaaacatcctcagatgatatcagctttacctacagtttcgtaatatttacagacgtcagagccactcaatttcctcggaacaaagattttagacactatagaaacctcattttcaaatcttgttgcatcagcaatcgaatgaggaaagttcacaactactagcttgtcaccggtcttgaagttctctttgaaatatctacccaaaagcatgaccaacataccggtcggcaaattgtaagcgtacgtgtcacacccgtattttttgtagtattcatttaataaagcctcatatctatcatccctcaaggttctgtagtaatcgatgaccttgactggatcgacaaactgcagctcatttatatcatcgccttgtgatttctgcagtacctttctagtttcttcaatgctgggtgataaggaaaactttatatcgacctcaccttgtgggaagatagccacacgtcttttcaaccctttaaccacattttcgaattcttcttctgataatgttgtcttcggtttgttcttatctaaagactgtactgtcttgacaaatatcactgtaccgataatagcaacaaggaaaattttcttaaatcctggagcatctattttatctgatttgttagaccttttagttgagctatcagttgatgagtatcgtgctctcaagagcaatggtgaaaataagggtaattgcttttgaggcaacccaccgcacaccttgaaacaatgtcggcagcttgctagaacgctttttctcagtggtcgcaacatgtaggtagtctatttatctgggctcgttatgtattaatcttcctatggggattcattcattttagctttaccggcagtccttacaaaccgctttttgaaattaaatcgacaaactgaggaagaagaacggaaaaacagaagaaagccaaaggcaaagaagcgaccacatacacctttttttcgatctaaactaatcgcccaaaatgtcgttggtcaaacttgcgaatacgtgtgctcatttacagaactgctcgaaagttagagttgccttaacatcgatcccatatacgaaattgcagctacagtttgcgtataacctttaccaacaagggttcttatcgtctttacagaagggatcgactatgggaccagacaaagattttgttgaagtaacaccagacaatatctctactagaaggctttgggttggattgaagtatagagataacaaacctgtcctcagcagctgcaaattaatttccaaaccaaattcaagaatacacctgccaatggaagacatgaagaaactatgctctggcgtaactattagaaacatcaaaccactacaaccaggagaactgattctagttcgagctcataacaacattatggacattaatgaagccatatccaaaaagttggatggagaagtactatgcagagtaaaatgaatagaacaatcacatatgaccgtatttatacgtgtaattaaaaaatatacggaccatgtaaataataatattataaaatgcagacaatgatgatgagtatagtactacagtaacgtccttcattcattacctttactagcagtgataaaaagttttgaaaaaaaatgtgctccaggggaggttcgaactctcgaccttcagattatgagactgacgctcttcctactgagctactgaagctgtctgttatggaggattctagcattaaatgctttaatactcaataaaagcaacaatggagaataatttatcagcaactaaatttatagacgaagatcctacgccaaatcttagctcctttatatttaatattgaaaaacatatgaattttaggttgaatcctcaaaatggaattgatatttctacataatagtactacgattattcttcactctgttttatatgtgtcattatgttattacattatcaatccttgcatttcagcttcgtctaacttccatgacagtttctcataccttatgtcatcatctaacaccgtacatgataacatactggtagtgtaactactagttgatagatgatagttcattttcattccaacaattgtcgttagagatcgctacataatcaacctttgcacttcagcttccattaaatctgattaatgcttcttaatctttaagccatcttcttgcaccataaatagcaatgaaaccatttagtcttctattttccacttaaagaaccaggtttttgcatttcagccatcttaaattagacgacggtttaatttcggtgtagtatcataaaatttcggccatccttcgactcacgtataatgatggcctcagcgagaggatcagcaacaagttacatccacaataatacgcggagttatgagatattacagtaccctccccaaaaatataaggtttaccgcaagatcgtatcaggagaatgaacgggtctcttagtttttatccactattctttccactcacgccaatatactaaccaattgaaatgctcataaccagaatgaacaggccgcatgcattctttagccaactttcgatgaaaatacccactatgcaatggtaaatttccgaaacaaaaaattatacttcagtgttcccacaaaataacgatatgtttcttttcatttttcaatgaaagcatgattttttcccttccaatgccaaaatgctagtcctataaatgaaaaaaaaagctttctgctataagaacagcaaggggcatttcaacttacacataatagaaggtgagataaagaccatcgtgaatcctaatagaaactgcgggtttcttaggatcatgggtcgcgcaaaaccgccaagtttaccatcaaaaagctacaaagttcaatttacccaatagaattctaacgccaaagatttgtagtgattcatatgaaattttctttatgcatccagttattactattgagtttctctcaagatacattctccaaaaaaaaagcctgttctcgcacaaacgaccttaagaaaggtttaaaacagctgtcacattacattatagtagataaaaacacgaatggcattttcttaacttgcaggtgtactctctatagcatgtttaacatattttcacctctttattgcaaacactttggcgtttcatattctgtccatgtatatgcaccacaatgattttattttcttttgtatgcattttgtgacgatttgacaactgatgcatcatttcgttccatctatttcgctgttcatggcttctgtctctttctctgtcttttttagccatctcgcaactagctgggaatgttcttttttcagatccgagagtttttgttgtaaaacattattttcaatggttccactaatcaattcgtcattcaacctttccgtattcttatttttcaacgcaataacttctttcaatcttcgtatttcttgctccttacttttcagttctttttgtagaattgccagtgtattcaataaagcatcgtcatggctgacaatgttgccaccaatggcgccactattatcttgaaacaactcatttaaatgggcctccttgtcgtttcgatctgttagtctacgaattaacaaatcatccatgctatctgtttgtggattgcttctttcctcctttgctttcttcctttctgttataatgaaattgcccatggaatatgcgcccttaatacagattcgcgcaggttaataacaaaaatcaacgttaaataaaggtcaactacaaacagaataagtaaaagcgagcaagtgtagtagcaatttagcacaacatataaaacgctattataatggatgttgtgcagcagaaacaggataaacagttgcagcatcaaacacaagagcagcagcagatacgagaggaccagcaggaagtcccaccccaacgtccacgacaacaaaacagatggaaaccctggtggaattccactgccgacgatgagccaaacacgggaagaattgcagaatatcctaatggacaaggaaggagtagtccgacaacggattttcaagatagcgtgaactcgaataatgacaataaagggatatggtctaaaatcgcttcttttgcaacatccagatatagaagtgccccaattgttgttgatgataatacccgctactctcaactaaacactgaacaaatcaacttcttggaaaatgaggctaaggatataatttcaaaaaagtcgaaatcatggtgttggtacgaagcaattccacatatatcaaattcatcaaacataattgattccatagataccccaggaataatcagtgtctctggtacaggatcagccaaatgcccattgccattaaacaaatatcctggggagggaggtaaccctgggtataatgtatttattaatgattctttaatcctaccatcagataaccctttgaattttctgcacgtccaaccactaagaactaaggtattgaatactatcaaaaattactataacttccctaatgagcaacatctctatttaagacaaaaaaaaaccgcattactgaaggataagagaattattataatatccgtcgtgggggatttaccagaaaagtatgagcagcgctcattagaatcacaaagatcggcttattatctttctagaaaattgtcacaaaatctagcgcaagaacaacctcaaagagtcttgaccctatcgttccagtgcccactgcataatcaagatttaatacctacatataaagaatgtgtagagttactgaaccactgggctcatcttttcaaagaggtagattcaattttttttgtgggcgtttatcacagcgttcccttaactttgctattagcgaaatatatcgtgcaaaataatgaagttctagagtttgatgaaaacactacagtgagtgtattgagtttccagtcatgtttacaaggctatcgattttgggaccacagcactgactttactagcaatagttataataacttgggttccaattccagtactaacgaaaatgatagtaatgatcatgattcaaataatgatttcacaacgaagagccaacaaatcaaagaaaaacagttatttcagggcattgacaaaaagcaacaagacacattatctaaaatcaaaaattataggcggatagattctagtgaatctaaactagttcaggatgcattggattggctcttgttcaattgggatacgtttcgactgacattttttggtaagctttatgataattttatgacaatttcagaaaaacttgctatagattataatcaccctaaaatcttgagaaatttatggtgcaatgggaagtacatgggcattgatttaaagaatgctaataatttaaaccttgataccgatgatgaagcaactagtaacattaatgacgtccatgtaaggacccctaattttgaatcgagattgaagattcccaccaacagacttttcgaaataaccttatgggatattttgatgataacggagaatttaggatataaacaatttattcccataattaatttactaagtcctttttttatttcaaggtcatttaatgattacacattgcctccaaatattaggaaacagtaccagaacagcaacaaaatctggcttcaagaaatggacagtaagtggaaaatgaatggtcatcaactcaattacgaccaaagggagggtgaaagtctcggttcatcatcggaatcattattgccagagaatatttctacggtaaaggattttttgcagtttgtgcagtatcaaaacgaaaaatcttcggatttcgtaaggatatattcagacatttatgatgacgataaagtctataaatgctttctgtacaatacaatattcacgaaaaacccattaagtcgtaagcatttacgtttaaacatcgacctcgacactcctacaagcatattgaatactgtcaatcaatatgatttggtatggaaaattcatgattccttctccaaattgattcaattgaaaaatttaccgcagcgagagataccacatgcgttgaggctctccatctcattaaactgcttcttggatagtaccacgagtacttctggccctgtttttcagagggacaccgtggaagctttgagaagattaacagagatttggcgaacttaccaggattggtctccaccaacaaggggtttgaaacacctacgtgatatcctgagcgttttagccatgtatgacaaccccaaaaacttgattaatgatgttcgacgtacatagtagattcgtatatagcggaccgcgtaacatattatggtatttgtatagtgggtaacccgcagagtaggctggaaagtattcgtgaagaacataaaggaagctggcagaagttcttttcatacacctctacttccagaagccataatagcagcaacgctgtttctgcaatataacttgtggaaggtctataataggaagaacatgtctttcactgaggatcaagaaaaaatcgcgctagaaatactgtcaaaagacaagcatgagttttacgaaattttgaaggtagataggaaagccacagatagtgagatcaagaaggcatacagaaaactagcaatcaaattgcatcctgataaaaactctcatccaaaagcgggagaagctttcaaagtaattaatagggcatttgaagtactaagcaatgaggaaaagcgcagtatttatgacaggataggtagggatcctgacgatagacaaatgccatccagaggtgctgcttcagggttccgaggaagtgcaggtgggtctccaatgggtggcggatttgaagacatgtttttcaattcacgtttcggtggtcaaagagctggaccaccagaggacatattcgactttttgttcaacgcaggcggcagcccattcggcgcttcaccatttgggccttctgcttccactttttcatttggaggccccggtggtttcagagtttatactaataatcgtggtggctcaccgttcatgcgtcaacaaccccgctcaagacagcagcaacaacaagcagaagaaaatgcagtgaattcgcaattaaaaaatatgctcgttcttttcatcatctttattgttcttcctatgattaaagattacctgtttagttaaacacaatatttttactgtcatttttttattattttccaacgttagtcaaagttgtactataaaataaaactacaaggagcaagcaaaattgaaaaaacgcatttgtatactagatgacatttaggtcattccttcaggcttcctggctatgttttattttgttccacagtttaccagaaggacataatggtattagaattttaatatatcgaggaaattaaatcagacagtataatacttataaacatctttattttctgataactaatcatagcatttacgccatacatttactttttcttttgacaccgaaagtaatcaagccacttttataattagagttagtttatagatagtatttaaaatttgtgaagatttcccatgcgttgtgccttgctttctctcaaaatacatcttgttaattttctaatgtgtggatgccgaaataatattcgactcaacaaatcaagtaagtcttctaagctcgctactaatttccaataaaaggtatatatataaaaatgttctcaataatgtaattaaacaagatcacgagaattactccagatcctttagccttgcctgaataatctggttcacatcttcatcttccacattcctcgatggaagcttcagtttcttcgtcagtttagtagttatattgccgccaatactgtctttactgctttgtgttttcaaggatggtcgcttgattaacttgccactaggtaatacctcgtatcgttcagagctctttttagaagagtttccaaagaaatttttttttgaggaatggtctacattcccatttgacattgaatatatgctgctgttatgagtttttgcacttgcacgtgaattagttcttggccttgaaagaactttgtctgtgtaccttgtgaaagtactgggatctttatcccacgtccatccttgcctcatttcgctataggctcctagttccagcttctttctgatatcacttttttgttccagctcagcaaaaatatcagaatctgatggccatatcataactttgaatgttttgtaaactatatctaaagtgataggtaacagtgccaacaccaagctagtacaccagaatgtaatgtctttaccaaaatgattgtaaaagccatatgctacatcatatatttggtcagtattattcaaaataggaagggcacaacaccacactaaccaacctccacaggatagaactacagaagtaaaagccagccaattcctattgtgcatttcaacaaattgggatttaacgttaattaaggcaacaatggctgtgaaattgatgagacctagaggatacatagtgttatctgaaagagaactcataccccacattacaacatttaaaaatgtaatgataagagaattcgtagttgccaagataacccactccatgaatattaaccaattaaaaccttgtgaaaggcgcccgtacgaatataattcagggactgttagtagagtcattggtttcaagtctttctcaaacataccaatacatagaaccggtagtgatgtgaatagagtattgaacatggacaatgaccatggctcatatagagaggagcctgaaaacattgtatatctttgatatatcaactgcgtaaagtaaaacgtaatttctttgtaaaacgtgcaaagcataaacttggaggtgcgaatatagttataacgcccatgaacaaataacaatttcaagagaaaccgaaattggccaatagaataatcagatactctagatgcttgcaatccctccttaccggctattccaacacctatatcggcagattgtatcatggcaatatcattcgcaccatcacctattgccaacgtgactaagtttggatcggtatttcttatgttggaaaccataagggctttttgagaaggtgaagcacggcaacatattaccgagtctgttttagtgcaaagctcaacaaatacagacatgtatgtaggatttccttcaaacatggccatcgtggcaccgtcaattacaacaacgcagtgtgctatgtttccggaatcaacttcttgagaaaccgcattcatctttgatataatattttcatcagtagtagttaaaatgactaccgtagaataatctttgattaacatacacgaataccctatatttatagccgtttcccttttatcccctgttagcatccacatttttataccggctcttctgatcttttctatagcttctgaaacgccgtcttgtaacttgtcttcgattgcagttacccctaacagatttaaaccatcctcgatttctgcacctgcctcatcgactttgatttttctatcagtaagggaggttttggcttggtgatagcgtttattccaattttcatactgcccaatatcgatccatttgtaagcatagaccagagttcttaagccttcagtcgaaaactcatcgatggcttgcaaagttctttcaataacatactcttcattcaaaattaactcatcgcttccaatgtgctccaaaatttctgtatcgtaatcatgctgtagtccttcttttcttgtgtctattgggacattgttgttcggaaaatgtgttccatctatcgaaattcgcggcccatatttttctatttgttgcttatggagtgacttcctgcttttatttacaacgctgccaatctcctgatcagatttcttgaccgtttctagaaattgatcaatggagtcaatttgtttctctggatcacgggtcctgctgttcttcattgaaagactttttctcactgcctgcaatgataaacttgctctcggtacgctagacaaagaatttctcaatgaggtcctggccatagcctcttcatctaccattctttccagagactttctttgctggagaaccagctctgcttctgcgtctttacgttctttggtactggtgcatatgtctgccatttttttggcagccaattcgcgatcatgtaaacgctccataataacgttatcagcacctttgcaaattaaaagaacttgatttggttgatttggcatacgtacaagaacagacattctctttctttgagaattgaagtcaatatagttcaaaatttcataattttccaattttgcttcaccgtcaaaaccgtctggaaaagttttaatggtcaaaatctgtgcatttctattcaatacaatataaccaaggtctctagcagcggttactagtgctaattcatctggagatgaagactgatactctatggagtcttctcctattgattcgttatgagtttttttgggaagacagctatgacaaagagctaatgataagaagaaaaatttagccttttgagaaaacagggcggtcggatatctttgaataaactgaattaaatcaaacgaacttttaatgttctccgaaaatgtctcggagggtgaaataaccgaagcttgtttacttagatgtgaattatctttcccaaaaagtgatctcatactgggacggcctgtataaattgctgatgaatttcccttatattcaatagaattcctagatttaggaaagttgtccaaagatggacgatgccctttttcaattggtgcgtccgaaaatcctaaccgatcaagaacattttgatctccaatggaaacaacgtctatactagagccgttgtgagcttttggtggtagtctcaaggagttcgtattgtctctgttgtcttcaaagttatcctcagaattaccgagatctacattatgcagccaagatgatccacataaagaaaatttccgaaatatcatcttattatccgtcagcgttccggttttatcactaaaaatataagatacttgccccaattcctccagaatggtggcagttctcgattcgcatggcgtgttcgtttctgcatggtacatgtctatgtcccattccatcattttactttggactaccttgataatttccattgttacatatagggacaaaggaatcacagtgttatacatgatgataaaagacattattgtgggtgctacgccagcatctgcctgaaatagataccatgctttgttctggtcgatatattttttcttatgcaaaacatggccaagataagaaaataaagatattgtggcaacgacaaacaccataaacacgataatcatatttatcttcctttgtagcttaggggctttcgttcttgggttttttaaagcattcattctgatttttgtttcctcaccactgaaaatgaccataccaacaacattttgagtattcctcaaaatactaccacgataaatgacattatcaggacctagagggtatttcattatggtatcattgcgatggtttttcaattcaagattaccttcaaaattatataaatcaatattgggatcttccacggtaacttgagcattaatatttgcaagacctgatgcggctttggttaacttatttaattctggatggggttgtttacttttcaaatttgtttcgccatctaaagccatcgtttcaacgaaacattcgctattttcgccgtcacatgtcaataaaagcagatctgcaggtacccaatcatcttgtgtgagaagtacgaagtctccaacacgaagtttttcccacttcttttgatgaatatgaacattgtatttattcttgagtagttcaaagttattgaagtgcgtgtctaagaagtgtccttgagaggagttccgatcatcgtttaaaggtggattattttcagcagcggccgatttagttagatatgcagtggatgagacaacactacttggtagtgtataaacttcttgtgcgtcattatttccatctttaaccaacactcccactggtttattgttctcttccttatctaaacgatgtctcctgaaatcgtcccaagcctctcttgtcatggatatacccataaatacacataaggggataatagttgtataagtaccagttgtagaccatccaggtatcatttgtaatactgcgacaatgaaaaaataagtattggctaactttgaaaattgtgcatacaactgtctaggcaaaaaggaatagaatgtatatcttgatgaagttattcggttgtcgcagtaaggcttgttgaacctttcgtctatcaaatgaccatcccttttagtagcagcttgtttgtattcaattgcattatgatctaatataatcggaatatgtctaccgtctttcgaatggaacgtcctccttcgatctaggatagtatcaagtattttagtgataatgctatatgacacatcaggactaccatactcttccatttcataatcctcttcagcagcataattgccgcttgtttcatctctgtcatctttatcgttattatcgctaccggagaacgtcttactctcatttatatcttctaactctatctcatcatcagttcttccgcgatatttatcatacaaatgcttgttgaacatctgcgttcgtagtgatgaagatcttcttctttgcccatcagctatgcccataatatttttttctttttaataaagaatggaattaaattatctacttcaattaggatgtttatttgctgtatggaagctatgtgtatataacgataaaggtcaaataaaagaaataacaaaaaagaaaagagtgaatgaatagtccaaaagcaatggggtaatttggcacttgatcttttctcaagacttcctgcaatattgaattcttctttgttaaatattcgcttacttaaagcacttgacagactggggtcgaaaataacccggctgcgcagcccgtcatttgcttatttagaaaatatgattaaagtgtaattagttatttcaaagtacatattaaaatatattatcatgaatcatttcctagtaatccttttaattcatacaaaaatgggatagtttcttccgaagatactttgcatttgctgagaggcctgctctcaagaaaggcatcgtctcttaatggtttttgaaagccaaactttacggacatggaagcctgagcttttcttagcaattcaaaggactttgcagttcttagcctttccctgccttcacggttttcttgagccaatttcaaaattctttcatctaacttgcgtcgtaattcgttgtcagaaagttgcttgaaatctggtttcctacaactatcctttccgataaaatctacgcggtgattttggcgtgaaccggcagaacattcctcctgacagtcgtagtcttcatattcctctagttcggtgtcgttttcaaaagagtcattcaccgattcagcaacatcaatgaagtcaactttcctctctaagctaagaccttgtactgacgaagaacggggtgactttctgcctttgaggatatccagatggaaaccatggttgattgtattggttggggataccttttgtatcctagaaatattgccacaaattttcgaggttttccagaaagtaatgagctcctccaacttatcctcaatgatgttcctatcattctctgttatgccatttcgaatgtcaatagctaatagattgttctcgatcatttttaagtaattaagtgcctgaaacaatttatcattctttgaaaatgaacatacatttgctctttcacaaccagtattagttgatgtttcttcaggaaatgcatacaatatttgcttatggtcattcaaagacaccaggacagtggagagtagtgaatgtaatcctcttaatagactaactatattttggaatgtacctattggattatatttttttttgagttgcacccttgccatgtaatctggaaagattttgtttagtgcgtttctcatgtttacatttgaaagattttcgtttcctgtcatatctaaagacagcaaacaacagagcataaatttctttagcagtttgagacgataaagcttaccatcaaggtcttttactgtggtagtattattatagtaaagatttggtacatcgataccgtataattcacagtatttcgatagctcacttgtatcgctaaagatgacaatatctggaatgattgatttgagtttataaaacagtgcatcacttgagaatactaggagctcttttatcacagatgagtgctcgtcagcaattgaaataagagacactcttgatataaaactatgattttttatttctttaaatcgaagatgatatttatgaatcattacatccacttgttgtaatgattcgagcactttccgtacctttaataaggttttatagcaaatcaaatgtcttcgaaagtattcttgctgaattgataaatacactgctacgagtattaaaattacaactctcttcagacctggactatttttttttctacagtattttttcaactgtgtaagtactcgataagaggttataatcatcgaaaggtagttgaaattttgtctgaaatataattttttgtcctctgctaccgccaatttaccatattttgtcgccataaatggtacagatttgggaggtacattctttaacaaagttgagcttttatgaaagttcataatagattgatcaagatgtagtgataacctgtaatgattcatatcattcaaaaaatgagaagtaatgattgaataccgaaattcttcaaagaattggtgtgttacaccgaatggctgttgcatgaaaattcttgaaataatatcatcccaattaaaaaacttcgttgtttttcctacggttataggtgaaaaagtacagtcattagatcccacaattgtaggggagtattcatgtaatacgctgcggctgcttaatagggacggttttcgccacgtagagtaaaattcttgacgattgttctcggtgacacctattatgttatcactatcaagggttagactagaactcatgaatccatcctcttcgcttgatttcagcatggaaaaaatctgtaaaccgggagcctgcaaggcggatggacgtgagtttgttgtcattattaagttaatcaacaaacgtttcacaagtaagtaaaaacaaacttgttgcaataagcgtgaggtatgccgagcagttattgagggggtgagattttgacctttgataaaactcctataaccgtctagtatccggtagtcacctaatcatttatgatattgggtgaagatgaatgtttagtttattttcagatcaagtgtttttatttacgttttgatgttttcatgcgggatgtcttcaaaaaaatgatttcgcccaggatcgaactggggacgttctgcgtgttaagcagatgccataaccgactagaccacgaaaccatagtaagttggagaattctgtataaagagtatgctacatttctctaaatatgttaggaattaaatataaaaattccgaaaactttgaggcaccgtctttttagctggccagatagcttgcttacctattttcttgctagtttaaattcgaccggaatagaaatttggttacaagaacgctattgcgcaccagatgcaaattttttttttattttatatagtgtcactggcacccctccattacattgtctaatttaaaataactaaactgatatactcacttactctaacgattgactcctgcttggtcaaaaatatgtatagatgttagaccatctttatatgccattattttgaaaacctaagtgagaagtaagtttcacacttcatttgagaaacgatacacctgcactgaacgatgatcccaaaaatcgttccgacaaatacagacaaacaattttcttaaagattcaaattagaaacatactactcatatgaaagaaaagatgcaacggttagtattggaagaatgacgatgaaacactttttgttgtttaataggttttagctatccattagatcaggagaaaagtcaccaatgttaaatatgtcgaatgtttctgtatccatagaaaaagagccatttagttgttgctgcgagttactgttttgaacttttacggtacccttaccgccactgtcctttggagtgacattgatgaagtttgtagcagctgaatcaccattttgttccagtttcttagatttcataactttctgagctgcagcaacttttcttgattccttggtctttgttttacccactctctgtttccgcttgggttgaattgttgtagttatattaggagttgtgctggagctagaagtacattttgatgatggttgtgatactgtgggtgtattattactattattattattattattattattattattattattactattattactattattattattattattattgttgttgttgttattgttattgttattgttaggcaaaggaaagacggaggtagaatcattttgtggtactgaagtattggttttataatgttgtggtagatgaaattgttgttgcggagcgaacgcatgcattgcggaagaaacattttgatataagggctgcatattgatcatagggttttgtccggatggattagtctgcctcatacctggattttcaatgacaggagaccccatatttcctggttgtaatggcatagtgttgttagctggcgctatacgattagtgtctggaggaaaggcactattttgtaattgctggttagccgccattctttgcatcatcatatgcatgtactgctgttgagatgttatatcactaacaaccggatttgcgacagtgctttgatttttcatttgttgaggaattgttttcatcttattgaagcgggctcgtatgtgttcttgcaataaactattgccatttgcgttattgtcatttgtgggcgtagtttcttccgcagtattgttacgtgtattagattgataattttgatttccaagattttgctgtagtgaattttgctgtagtgcttgctgctgaaaaaacattttcatagcgttcatgtcatcaaacctgccagattggctttgctgaaaagatggcgcctgtccttgattttggtggtgtaattgatattgaaagaagcgctgctggtctgaaaacattgaagattgggtttgtgcattaaattgttgatttgtaggaggcactgaaggcataagtccggttgaatgagaattttccgatggaatatgagggaccatttgtgggttgacaataggatacggtgtctgttgctgctgttgatgttgttgctgttgctgttgctgttgctgctgttgctgttgctgttgctgttgctgttgttgttgttgttgttgctgttgctgttgctgttgcggttgatgctggggttgatgctgaggctgctggatctgctgttgagatgattgctggggctgtgctggtgattgcaaatcattgaagtgtttatgtagatttatagttgcgtactgctgcccagcaatatcactgtttatagcagtatcaggtgcaaaattagcgctattctgtttgtcgtagacaccggaagttctcgatagaaatctttcggagacgtttcgattggttggatcgtttaaattaaagttacttccgtcaccattgggcctaaaactctcctctgaaactggaaaactattttgagttggtggaatcacatttggtgggagattagagaaatgggaaggcatattagatttagaattagctggcaaaattggtattattctctctcttaaaggattatgatcctgttggtacccagattctaggtctccattgaacaatgattgaaaaatttcccaccattccagtaaaaacgtgtcattagcgtccatcagcattttcgaaggtaatagcccatcttcactaacaatgtcacccttagatgcaatatccattaatccctgcttcaggctggcgttcaagctagttttcccacccgaagcagatccgtttattctagataaaggaaggtcagcttcgcttaaaaattttgcggcagagttccagtaattgtttttgattaaatagttataaatatgggcgtacaataattgcttagagttcttagccattacatccgaaacgaaaactcgagaatccgcatcaaactgcaactgagtatggctattcaaacctttgatattgggagctgagctaaaatccgtgttactagagcgctcatttgtattaatattggtcgtgttatccatatctttatcatgcacctttttcttatttcactgcagtttaacgaaaaattgacaaaagaaccgggagataccaaagggaaaaaccaaaagagtcacacaggattgcaatagaaatctttctggtcttttctactatggtgattttattatacccctcctcttcctgttatacacgcattgtatttcggcattgcctcttggccgcttttttcacctgacgtaatacctgttgcagcaagcgagtttcgtgtgcgtatagaaaagtatttaccttgacatttcgaagaagtatgtaattaccaaatagctcagaagaacacttggtacgtaacaatcatcgtttacctttttcttctatcaaaaaattttcttcttttttttttccttctcttttcttaaataaaattgaaaaattgttacttagtacttcataattttacttaatatgcagtatggatcgttataaataatattcggctacaagaatctttaatcttcgaattcatcttcgtcgaattcatcgtcatcgaattcatcgcttactcttgaatccaaatctttatcgtccattgagttgtggggtagctgattgcgccctgtttcattaacactttgctcccttcgtgattcggtatctgaattcccaagtgaatgtacgtcatttgaaacgttgatctttgaaacaattcttgttggagcgccggcctttgacacagagagctttttgaactctttatcgatactagtcgcggctgcagaagatgctctccttgatttagttctattgtaattggagtcttcatcatccatatcgtctaaatatcttagttttggcgatgcaagtggagaacctagctccaaatatatttgttttccaatgtcccctttggacattgtagatttattgggcgtggatcctgagctactatgggaactcaccaggtcagacgcattttctacatcagacgaagcggctaaaacttcgttgttatttgtgctgccgctcacatttctttgcggggctttagtgaccttggcggttttgactgaatttgccctatttctactaatgttgctttgttgtgatacgtcagtatcttcatcgatgttatcagaatcatcattgctaatatccgataagttgtcgatgtcgactaacgggtctctccaaaaatttacgtctgtgaatttctcttcctgattgcctctaaatagcgttttgcgacctgaagtaatttctgagtcaaagttatccaacgttctattagggggggagccaggaaccatggaagtattagttcttagatcgacactatcaaggctgactggtggaaagaaatgatcgacaagctcattgatatgaatataggagcttctgtaacctgctaactccaataattccatatgaacctcaccctctgtatttattgtgaaaattcttgaactaggtatccccacagttctgtaagataaagcatcagtaatcctattaccaaagccggcaaaaaatggtgttgatttttcctctgtatccacttcgttatcactgtcttcaaaatacaaggatcttatgtcgtttagacacgcgattttaaagacttcaggtttttttagtattacttcccgccttaacgcagccatcgttctatcgggtgataaaatcacaggcccatttggtagtttgctgccattctgttcaattgatcgcaaataactcctcgtggaatcagcttgtccagcacttcttgcagttagatagagtatattatagccattcctggagatctcgctaaataacttggctacacccaagtgcgtccagtcttttcctatcattgccagaacatggcctaaagcgtccgattttgtgatggtgccatcaatatcactgataacaattggaacatcccacctccaaacgaataattttgacgtaacaatagcttttccgtgatctacggaaaatttcagatcattttcaccataagttaaatttaggcactttaactggtcattagtcaatcttatcgttcgtatgtatcttttctcggtctcaccgctccctgctgttcctttcttgctagttttttcacttttactgctttgttctttgctaaatgatgtttcgtcctcagtatcggaaccagaaggtgaagaagataacgaattcaaagtacttcctgattccattgcatctaagcctaaaactgatccgcttgtggccattgttggaggcgtacctggaggagataaatcagtaaggtgctcgtaaggatttacgatcttgatgttgccatttttgtcctccttgataaaactggaaatatctgaatcattaccgaattcgtcctttaacaactgcttcagttgtatgtctgtgtcatgcatcatattcttgtttggcttgtaaccttcagtgtctagtagtaagtcgccattgttatcaagtttactgggtatatggatttcagtgagttttttgtttagtttttgctgaaagttctttgtacgctgctcaacaagcttcctctcttcaactgaatctggtggtgtcgttgtagaggattcagtaggagaaagcgaccctgtagtttcactatttttactgcctgaatctccagtgtcattgatatctaaaaaatctggttcctctagcactttcttttccttcttcttattttcattttcaccttcaccttcaccctcggttcctccttctaagatggatgtttcaggtgattgaggggggcttgatgtggcgctcatcacgggcgacacaagcaattcgtcagggacatcagtgacctggtcacccatctcgaaaacgaaataggcttctccagaatcactcagtttcattggcatattactcagtttctcatttataaacacttggactttcttttgagatggctttagaatttgaaatttgccgaacctcacatgaaagggagaacatgatagccttccgtctggatgctccactacaatgacatctatagcacctgatagcgtagccggattgatagaagaccatgttttagacacagacccaagagctctgcctacgtactgcataatcgaccgatgtgtctatcttcagtaatttcttccctgtatgtttcttagaaggtaaaactgtgattacgaaggtgtagtgtccaattggtctgattaacacttcttgaacacgttttactaaattgttgaatgtattttctttataaacacaagcccccacgatggcctactcttcacttgtccttgctcttccttctaccctcaccgtgcgctgctttcaacgctggccggaaaagccgagaaaaagagatagataatagagaaaagagagcccattgtctaaagggagggaaaccgaaggacgaaaagggcccgcgacagaccgtttagagaatgagcagcacgtgggcacttcgattttgtctcccagtgatgtagtgttatgatatacaagatgagtttggaccctgttcaagcaaatctgtcacatttgttagacttttttttaaacgagccctccaaacaagaacgctcagtgttaggaactgcgaacgaagagagaaatgcgtattaaacttagatgagtattcttgccgtaaatgactatatacaaaacttattcggaagaacctatatctatgtatgtgaaatgataagtacaagacccactgtgatgtgcagtgatggcgaatagggtgaggtcccttgtactgtctttattgtagccgcttgtaggaaaagttttatcacataaaattatcctctagagagttagatgagccagaaatcaggctcttagtccgttggaaatgcgttacttaatccgcgtagggtcatttgatacagaagcaacattatactgctctgaacacttgtccagacgaatctagggccaacgccactaaagaaacctaacacaccttcagattggtagaccgtccgaaggctgagcgaaatcgagttggaaagtgctgccggtctgccgtttgttacatgtggatgtgttactgagtatgatttgttgctttggctgggcggctgttgagtttggactctagtcttaacaacatccattggtgtggtaatgattcccgccagtccacctgcacaggcaccagtcaatatttcattaggtatagacaactcaccatccctaccatctttctgttcaatcttgaaagccaattgcctaaacttttcgtagaaggcaaactgcaatgcactaaatggcaaatctctggctaaagtggctttgtatccaaaaaatagtgagcgaaacccttcttcttttataactgtctttatggcatttcttaaattcgaataattatagccagattgaaagaaaggattattgaaccttccttgcaattgtagccttgtctttaggacctctgatggaacataaacaaaactggagataaaatcgccaagaaatccagcgctcaaatgtgtgatggtatcgttaatctgccaatcttctatcattgttctcttagtatattcataggtcccaaagaagattgccgctgacgggaaggagcctaacatggcagccatgtaaccgccgtatagcccccttctcacgccttcttctagccaaatggtacgatatgcagagatcatgttcctgtattttttgacattgggtgcgccctgttgtcttgtcttaacagtatccaatgaatgcatcgcagaatctcctatttttccaccaatcccaccggagacgacacaatgccatatagggcttaagtcctcatctgaatcgcctctttttttgtgcagtttatcatcttttcggttattatttggttgatctggagttccttctgatgtcgggggatggtcatgaggcgtatgtattatcggtattgaagaactcaggttccatgagttcattatcttttataccagtcggttggaagtgaagattattatgcgtgcttcgttagaatactcagcgtttgttttcggcttgctttgatgttttttcaaattaatgaacacaatgtaagaagtcgctatcgttgtagggtcctagagatgtcaagttagagttcaatcgcaagaaaaataggaatgtgataccttctattgcatgcaaagatagtgtaggaggcgctgctattgccaaagacttttgagaccgcttgctgtttcattatagttgaggagttctcgaagacgagaaattagcagttttcggtgtttagtaatcgcgctagcatgctaggacaatttaactgcaaaattttgatacgatagtgatagtaaatggaaggtaaaaataacatagacctatcaataagcaatgtctctcagaataaaagcacttgatgcatcagtggttaacaaaattgctgcaggtgagatcataatatcccccgtaaatgctctcaaagaaatgatggagaattccatcgatgcgaatgctacaatgattgatattctagtcaaggaaggaggaattaaggtacttcaaataacagataacggatctggaattaataaagcagacctgccaatcttatgtgagcgattcacgacgtccaaattacaaaaattcgaagatttgagtcagattcaaacgtatggattccgaggagaagctttagccagtatctcacatgtggcaagagtcacagtaacgacaaaagttaaagaagacagatgtgcatggagagtttcatatgcagaaggtaagatgttggaaagccccaaacctgttgctggaaaagacggtaccacgatcctagttgaagacctttttttcaatattccttctagattaagggccttgaggtcccataatgatgaatactctaaaatattagatgttgtcgggcgatacgccattcattccaaggacattggcttttcttgtaaaaagttcggagactctaattattctttatcagttaaaccttcatataccgtccaggataggattaggactgtgttcaataaatctgtggcttcgaatttaattacttttcatatcagcaaagtagaagatttaaacctggaaagcgttgatggaaaggtgtgtaatttgaatttcatatccaaaaagtccatttcaccaatttttttcattaataatagactagtgacatgtgatcttctaagaagagctttgaacagcgtttactccaattatctgccaaagggcaacagaccttttatttatttgggaattgttatagatccggcggctgttgatgttaacgttcacccgacaaagagagaggttcgtttcctgagccaagatgagatcatagagaaaatcgccaatcaattgcacgccgaattatctgccattgatacttcacgtactttcaaggcttcttcaatttcaacaaacaagccagagtcattgataccatttaatgacaccatagaaagtgataggaataggaagagtctccgacaagcccaagtggtagagaattcatatacgacagccaatagtcaactaaggaaagcgaaaagacaagagaataaactagtcagaatagatgcttcacaagctaaaattacgtcatttttatcctcaagtcaacagttcaactttgaaggatcgtctacaaagcgacaactgagtgaacccaaggtaacaaatgtaagccactcccaagaggcagaaaagctgacactaaatgaaagcgaacaaccgcgtgatgccaatacaatcaatgataatgacttgaaggatcaacctaagaagaaacaaaagttgggggattataaagttccaagcattgccgatgacgaaaagaatgcactcccgatttcaaaagacgggtatattagagtacctaaggagcgagttaatgttaatcttacgagtatcaagaaattgcgtgaaaaagtagatgattcgatacatcgagaactaacagacatttttgcaaatttgaattacgttggggttgtagatgaggaaagaagattagccgctattcagcatgacttaaagctttttttaatagattacggatctgtgtgctatgagctattctatcagattggtttgacagacttcgcaaactttggtaagataaacctacagagtacaaatgtgtcagatgatatagttttgtataatctcctatcagaatttgacgagttaaatgacgatgcttccaaagaaaaaataattagtaaaatatgggacatgagcagtatgctaaatgagtactattccatagaattggtgaatgatggtctagataatgacttaaagtctgtgaagctaaaatctctaccactacttttaaaaggctacattccatctctggtcaagttaccattttttatatatcgcctgggtaaagaagttgattgggaggatgaacaagagtgtctagatggtattttaagagagattgcattactctatatacctgatatggttccgaaagtcgatacatctgatgcatcgttgtcagaagacgaaaaagcccagtttataaatagaaaggaacacatatcctcattactagaacacgttctcttcccttgtatcaaacgaaggttcctggcccctagacacattctcaaggatgtcgtggaaatagccaaccttccagatctatacaaagtttttgagaggtgttaactttaaaacgttttggctgtaataccaaagttttttgtttatttcctgagtgtgattgtgtttcatttgaaagtgtatgccctttcctttaacgattcatccgcgagatttcaaaggatatgaaatatggttgcagttaggaaagtatgtcagaaatgttatattcggattgaaactcttctacaatagttctgaagtcacttggttccgtattgttttcgtcctcttcctcaagcaacgattcttgtctaagcttattcaacggtaccaaagacccgagtccttttatgagagaaaacatttcatcatttttcaactcaattatcttaatatcattttgtagtattttgaaaacaggatggtaaaacgaatcacctgaatctagaagctgtaccttgtcccataaaagttttaatttactgagcctttcggtcaagtaaactagtttatctagttttgaaccgaatattgtgggcagatttgcagtaagttcagttagatctactaaaagttgtttgacagcagccgattccacaaaaatttggtaaaaggagatgaaagagaccacgcgcgtaatggtttgcatcaccatcggatgtctgttgaaaaactcactttttgcatggaagttattaacaataagactaatgattaccttagaataatgtataacctttagtagtgaatctgcggtatcataataaatgagatacatcttaaacaatttccaggaaacagtagatatttgaaaaagtgcaataaatttttgaaatctgctgttatttgatctaaaatcttcttccaacgaatctactttgtattgaaaaatatcgagctccctccttatagcatccaatgtttttaagggaggtttagaactcttgttcaagtattgatctaaatctctgtctaatgagatgattttccaatacaagacctctgtgctgttttcttccctgtaaacatcaacgttaggcaaatcctgcaaatatgctgcatgttgtaatagggaggatacttctgtatgaagtgcaattggtttgcgtggccccgattgaagataatcgcatccacacaggcgatagaatattcttcccaaggttactttagcgatgctttcaacggggtcatcattaagtaaaggtctaaagtcatccacatgaaaatttttaaaggtatggatgcactgtgttaggagcgaatttgccaacaacggttcatcgtaggggaaagttgtagtggctaaaatcagatatgcttgaacgagccttatatcgggatgcgccatgaaatcacattgtttcaattggaataatgagcagcgtgcaaaattttggcacatgactaattgcataccatcttcccaattgagccttttgttgctacccaaatattcatggagaggatatactgaaaatatttctgctaacttctcgactggcatataataaatgcacatggtaaagacagaccatattagtgcgtcccagtatttgccgtctacactgtgattcttgtctgcccttctatcccagtactgttccaccctcaaatataattcactgatatctccaatggaaccaaaatacaaagcacctaagttttccatagcaaagttcatcaattggaatgattggtctttttgaagataattcatccaaaacatacattcttcagtatcagtatccaaattagctggtgttctagtaagatctctttgttttgttttgtacagcccaatattcgttatccaatattcataattttgccagaataacaataggtcagggagatattccttggaagatgaagccgttattagttttgttgatttcatacattcggagtcctgtcctctcttcctgcagtttccacacggtatcatacgatcacatttgacttttcgcctcgtacacacggaacagggatgcttggatttcagttgagtggtacggttaaacattattattaggatgcaaactcgtgttcgtaacttttgtcatcacctgctctctgaaggttggttataatatttcattctcttacgcttagcttacatggctgcgcgcacttcatttaaagccgtaaaaaataaagatttcatagaatatgaagctttgaatctcatgtaaacatttatataactatgtaacgaattatttatccaatgaaagatccacatggactgattttatttgtaaatagttatcaacgccggtgtcgcctgattctctaccaataccactcatcttaaatccgccaaaaggaactttagcttcttcttgattggtttgattgatccaaacagttcctgctttaatatcgcgagcaaacatgtgcgctttcttgacatctttggtgaagaccgcagaggcgagcccgtagcaagtatcattagccagcttcagagcgtcatcataatttgtgaacttgctaacaaccacaaccgggccaaatatttcatcacgcagcaacttagatgtttctggtacatcagtgaagatggttgggggaatgaagtagcctttagctccaccaataggaaattcagaggtctggaacatgtccaacttttcctcctttttaccacgttctatgtaacttttgatgcggtcatactgtgtacttgatataactggaccaacgatgcatttctcatcaaacggatcaaattttcctgcaacatcccactccttctttgcagtttctttaaacttttcaacaaacttgtcgtagatcgaactttgaacataaactcttgagtttgcagtgcagatctgtcccgaattaaaaaaaataccatttgctacccattctatagccttatcaaggtctgcatcttcaaatacaagagcaggagacttaccaccgcattctagtgtgatatccttaaggttcgattggccggaagcttccaatactgagccgccaaccttagtacttcccgtaaaagatattttgtcgatatccatgtgggttcctaaagctttccccacaacggaaccataaccaggaatgacattgacaacaccaggtggaaaacctgcttttttaattaaagtagcaaaataaagtagagatagagaggtattttcagcaggtttgatgataaccgtgttaccggccgctaaggcaccttgcatttttctacaagccatagctagaggataattccatggaacgatttgagcaacaacgccaaaaggaacttttagagtatatgcaaacttgttaaaagtcaatggaatggtttcacccatattgaacttgtcgaccgcccccgcatagtatcttgtaagttctataatctgggctaagtcttgtttagcattggaatggaaaggcttaccagcgtctaaagtctctaatgcggcaagtgtgtcttgctcctcctcaataagttttaataagtttgaaagataaataccacgttgctcagaagatgtcttcgaccaaacgttatcaaaagcagccctggcagctttcacagctttgtctacatccttttcgttagctgcttggaaggatgttatcggttcgccagtagctgggttcacagtttcgatggtctttccatctgatgatggacaaaactcattgttgataaacaaccctagcggttgctttaaagagattttcaattgtgggatttcgatatcagtatacaaggtaggcatttttcttttggctaattttctaaatgtgtataatctatatctctatgatacaagtccaaggtataattacctggcatgagtcaaatttattcccatccagatttgccattttatacaattagtttctgaggtatgatcagttaaatctacgctattcgtttgaacaatctccctgtctcctccctaaacttactaattccttaacccttagggagtttagcaatcagcttaagaagggggctgatcaacaatccggttcaagtcttggattagcagtaatgaaaatccctaaatgcactaaagggcgtggaagaaaggtactgtagagttctaatagtgatactttccttgtactccagggggggaaggaagaacagacgtcatatgcagaaaaagaaaaaaaaaagacggaagatctacgtaatggtgggaatagagaaaactaacacgcaagtataatttcttgacacaaaaataaatctcactgagtttatagctctatttttttaccatcttaagggatttctaggacctagtaacaacaattgttccgcatgctgaaataatggtgcttacagttttatatcgagtagtggactactactgtttgctagactgtcaacatattcatccgtcgtcaggctaagctatttaggtacttacgcacttacataatgataactatcacattagttgtccaaagagagatttatgtgaactgcttttgtttgaagataggtatcaacaccactttgccccagttctctaccaataccactcattttaaacccgccaaaaggaacggtaacatcttcatcgttagatgagttgatccaaacagttcctgctttaatatcgcgagcaaacatgtgcgctttcttgacatcttttgtgaagaccgcagaggcgagcccgtagcaagtatcattagccagcttcagagcgtcatcataatttgtgaacttgctaacaaccacaaccgggccaaatatctcatcctgtaacagtttcgatgtttgcgggacatcagtgaagatggttgggggaatgaagtagcctttagctccaccaataggaaattcagaggtctggaacatgtccaacttttcctcccttttaccacgttctatgtaacttttgatgcggtcatactgtgtacttgatataactggaccaacgatgcatttctcatcaaacggatcaaattttcctgcaacatcccactccttctttgcagtttctttaaacttttcaacaaacttgtcgtagatcgaactttgaacataaactcttgagtttgcggtacaattctgtcctgaattgtagaaaatgccagctgctatccaatcgatagccttatcaaggtctgcatcttcaaatacgagagcaggagacttaccaccgcattctagtgtaacgtctttaaggttcgattggccggaagcttccaacacaaatccaccgaccttggtgcttcccgtaaaagatattttgtcgatatccatgtgagatgctagggcttggcctacaagtgatccataaccaggaacgatattgacaacaccaggtggaaaacctgcttttttaattaaagtagcaaaataaagtagagatagagaggtattctcagcaggtttgatgataaccgtgttaccggctgctaaggcaccttgcaatttccaacaagccatagctagaggataattccatggaacgatttgagcaacaacgccaaaaggaacttttagagtatatgcaaacttgttaaaagtcaatggtatggttgcacctttgtcaaacttatcagcggacccagcaaaatatctggtaagctgtaaaatttgtgccaaatcacctttggcatttgaatggtaaggctttccagcgtctaaagtctctaatgcggcaagtgtgtcttgctcctcctcaataagttttaataagtttgaaagataaataccacgttgctcagaagatgtcttcgaccaaacgttatcaaaagcagccctggcagctttcacagctttgtctacatccttttcgttagctgcttggaaggatgttatcggttcgccagtagctgggttcacagtttcgatggtctttccatctgatgatggacaaaactcattgttgataaacaaccctagcggttgctttaaagagattttcaattgtgggatttcgatatcagtatacaaggtaggcatttttcttttggcttattttcacgattgtttttgatggacatgcaatgtaaaaatgataggaatgggccaaaagtatttttaaggattcgctccctttatatgaacattcttgagcaaaattcgggatatgatcagtgagtgtcgacaagattgcatccctaatgtttaaacgagttaaaaaaactcatcattggataggagtaaccaataaagggtatatgattgctattattagtatccaaaagccgccgggaacatcatagggcgttagcaagtaaacgcatggcacgataatggcaaccttgtttcttctggcggcaaaagataaggcaatgcaaaataaaaaacgagaaaaaaaaaatgatagaagggaaagataagcaaattttctttcgagctggaacgcttcattttaatctcacgcatttgcaacccatgctgatgtctgaagcgctgacaaatacttcatacgttcttcttgtgacacattaagaggtagcacggaggtgcaagtaaagatggcaaaagtacggaaagtaagaaggaagtttgcgggtcaaccagttgcccttactagtgtacgtaaacatatgtatatatgtatgtaaatatctatatgctgcactgcgatatcgagtaggtgatagcgttgaaaccctcaataaggaagaaaacgttataaattgcaatgtttttaaaaaatggtggctctgcgtaatacagcgcaaaaaaagataactgaccggggctagtgtttcagccttactatctcatgcattttcgtattatatgccatgcatcctgctttcgtaatcatcaaattctgaaaattgttcgggatctctctcgtgatcattttcatcttcgttatcattatcaacactatcgaaagatgcttcatcagtaattaaatttctgctcgttccaataattcgtccgcttattgctgatttatcatttttcgaatgatgttcatcgtccgagtaacttggtggtagcataggtaaggaatctagattaatttcctcattgatgatcttctttccagtgggaggggacatagtgaattcaaatccaggtggtggcggtaatatttcaccgtttcttataattatatcatcattgagatttgtagtactaccagccgcaatattgtcgctatcaccgtctgaaaaatcttcgtcgaaatcattgtcttcaccaccgctttctaatagggtatctttaccgtagtcttcgtaagaaggaggaggtaatttaatgccgtttgactttgcgtatccccattttttaacgtttgcttctatataaacaaagccataagtgccgaaattcacatgaatttgacaaggtacgttggagccaatgatcgggtataggtattggaatttccagccgcggatatgaccaccaacagatttttcatttagtttttttccgttcctggtgaaaaatactgttccactacgtgacctatagccaatgccaacaatgtctcccttttcacactgtggaaataacgttcttaattgctcatttagtttgaaggagtcattaaatcttctggcgccgttagaatcgtatgctatcgaatggtggtgtcttcccggtaacctgaaatatggataaggctgtgtggaaagaccaaatgagatgacacctttcgatacattttcatcactgtttagtgggccatccgtttcaaatatcttgaattcacaataatatactttatttatacacggaatgggtagatttgtggatatagaagcatcataattataatttagaaaagaaacctctgttttattttccactatgacagtatggtttggcatatcaggatttgggctaaactcccatgcataagccccctcttcttgaatatattgccttgtttgctcgttcataatagggtcttcacgggtggtgtctggattgctatcttcggactgttgtaaaagtccctggttaagcagaaatggtgggttctgcttgatatactcctcaccttgcttataataaaactgctcttcaggtgacaactgtgccagcttatctcttacttcatcagcatcgtcaagattgttgggccaccttaaactcatgttttccattaatcttctgctatgaacgtgtgcattattttcgtcataatcgctgaataaagatattctttggccagggccatgctcattataatatgcagttataagccgcgtagctatctgttttgtaaaaaaataaacgatacagatgacgatgtagaccacgattaaggttccaaacgcaaacaacattatatccatgttaagttcgtcagtatcgtctcccccataagatacatcgccacgggggatcaccgaagatctaccacaccgtatttgtccgcttatcgaaccgagaagcagcgattctatcagaaacttgaatgacatttgcttttttatatagaaaaaaaatttggctctccaaactttaagattttttataattattaaccaatgacaatatagataacttgaaacaactcttgaaaattttgtagttaggcaccagtcctttggtttttcaatgttctataaaaaatcactcctccatgcagcagtaaagcgctattctcaaaaatagctcaacctgagagaggaagaaagagcagtagtaaatagagcaaggttcttaaagcctgtatcaatgaaattttgttatggcgtttatatggataacctggaatttgccttttttctttatagcgcaccgttccgaagaaaaaaataaaaaaaaagggccgacggagggttaggtcaaattaaatattgagctaggtttagttatctcttttttaggttttttatatacaaaaaagattatatttagggtacatatggctggagcataatgtctggaatgggtattgcgattctttgcatcgtacgtacaaagatttataggataaccatcagcttcgattattctacactgatgagccctttcttcttattcttaatgatgcccactacattaaaggatgggtacaggatgaatagtcaagtaaatgaagatgctataggtatcaatcttgacctctcactgcccactcacatttcgcctacgactggttcagagagcgccagtggcagtaacgccagtacacttcgcaacgatggaaatgcactagatggaggtcttttgaggacttcagcagcgatttcagcacccacaggtaccagtcaaccaacagaaactattggtgaaaaactgagtaatgaagagcgggtgaactcgaatgtttccgcttcgaactcgacaacggcgggtacagggcgtatgttaagccaatccttgactaatgattcaccgtcgaacgaaatatcgacggatcagttgaagatttttcaaagaatggacgaaatgagtgcccgaatgattgagatggaggaaagcttcaacaagttatctaataagatcgcggaacagaatacaatggttttaaacctaaaacaagataactataaagttatgaacaaattgaatatattacttaagttggttgcgcagccaagcgcgcgcccaagcacaaacaatgcccaaaataagcttgctatcgaattgctaaattcgatatcagccgttagtagtgcttacttgcagaaaatgcagaataatggctctggtagacagcatactgctgatttatgtacaggagattccaacacccattctggtatcaaccagcatcggactacgaatggaaccatagatgtgaatacgaatactgcacagctaaacaaccaattttctaacgcactaaatactatcttacctgatcagcagcataatcgaaataatgtttcccaaaatataaaccaatcgctccctaaccgacaacttggtcctgttataaacacacaagccaatcagaaccagtcgcaggttttaattcataacacaaatacacatcagcaggtaaatcgctcgcctattagtttcccgaacgcttcaactgacaagccattcaagttgaacccaaatgggattaaacggcgcagaagaaatacgcaaagtaacaacaatgcgagcacaaatgaccatgctagtgctgcacaaaagcccatatcagccctatctccattaacgaattctcataattctacaactagcatgaattataccaattcttccattcattcaggcgtcaccagtgcttcaaattcatttcatgacttaaattcattgaataactttggcacgacaacagctttaagtttgcccagcttagccctagataacgcttcttttcccccaaatcaaaatgttataccccctattataaataatacccagcagcctctatcattttcccaattgatcaatcaggatagcacgacatctgaattgttaccgagtggtaagtcaggggtgaacacgaatattgtaaatagaaacagagcttctactctaccgtcgtacccaaaaccaatgacagtgaaaagtaatgtcgacgatgatggctatcaagaggatgatgatgatgacggtgatgacgaaggtgatggaagggataatgaagaagacagcactgctgaggaagatgaagtagatgatgaaatcgaaacagatatgaagaacgcttcgattaacaagcggaggaggagcttgcatcataaaaaaagtaactctttaaacggtagaagaaagcttcacggcgagtcggctactaagcccaacataaactctgatttacattataggatattgaaggctcccactgacgtaaagactatatgggaagagtatgatactggaataagaggaaagccatcgatcaagcatcttgaggccaagtatggtaacaagtggaggctcaataaaaataagaagaccttttcaaggcgaaaaagattgtacaagttcattctgaacggtatggagagaggtaaaacggcacaagagatgatagaaaccttagagaacaaaaggctatataaagatgatgaggatggcgaagtaaagaaaagaaccattggctggttgcaagagagccttgctggaatataggcacgtacgatagtaaataatcgtttacaatcataggaaggaaggaaaaaacaagtgtaacataaatacattctgtaaatctacaaaaatcgttagtgctgttttctttttgagattgaaaagtacgaatcatacacatctcttattctgagaagggtgcatatgacgtaaatcaatgcgtacaaagcggtttccggtgctggcctggcccaccacagttttggcgtggttgattttaaaaaccttcgggaaggtgaaaaaaccactccgaaggttcgaggatgacaaatcgccccttagctgtggccatacaagcttggcaccgacgaaaaagggaaaaaggaaaagaatgtcgtacaagaactcttacaaccacgttgagatttcatttaacaacgcccccctttccattatataagaaggcattaatttttatgtaataaaaaaagaatttctcgaaaatgtcttacaattaattttttcttttgtagagtagggctttaatagactgatatatacggtattataagtgaacgaaaaaaacagcaatgggtttatttgataaagtgaagcaatttgctaacagcaataataacaacaatgattctggcaataacaatcaaggcgattatgttaccaaagctgagaatatgatcggcgaagatagagtcaatcaattcaaaagcaaaatcggagaggacagatttgataagatggagtccaaggttcgtcaacaattttctaatacctctataaatgacaacgactccaacaacaacgactcatatggttctaataacaacgattcatatggttctaacaacaatgattcatatggctctaacaacaatgattcatatggctccaacaacaatgattcatatggctctaacaacgatgattcctacggttcttccaacaagaagaagagctcttatggttctaacaatgacgattcgtacggctccagcaacaacaatgactcttacggttccaacaacaatgactcttacggttccaacaacaatgactcttacggttccaacaatgacgactcttacggttcgtcaaacaagaataagagctcttacggttccaacaatgacgattcttatggctctaacaatgatgattcatatggttcttccaacaagaagaagagttcttatggttccagcaacaacgattcgtatggttctaacaacgatgattcatatggttctaacaacaatgattcatatggctctaacaacgatgattcctacggttcttccaacaagaagaagagctcttatggttctaacaatgacgattcgtacggctccagcaacaacaatgactcttacggttccaacaatgacgactcttacggttcgtcaaacaagaataagagctcttacggttcttctagcaacgatgattcttacggatcttccaataacgacgactcttacggttcttccaacaagaagaagagttcttatggttccaacaatgacgattcttatggctctaacaatgatgattcatatggttcttccaacaagaagaagagttcttatggttccagcaacaacgattcgtatggttctaacaacgatgattcctacggttcttctaacaaaaagaagagttcttatggttccaacaacgatgattcatacggctccagcaacaacaatgactcttacggttccaacaatgacgactcttacggttcctctaatagaaacaagaactcctatgggtcttccaactacggttcatccaacaatgatgactcttatggttcatctaatagaggcggtcgtaatcaatacggtggtgacgacgattactaagtttttggatgtcttcgataaaaaaaatatattattgtgtttagacttaagtatgaaaattttatgtatgagctgtggctatgtatccgctggcaaataggtctgctttttctacactttccaccctcaacctaacagagcccgctggcacaaataatcgatagtaggacaacagagctactccttcttatgccccgcccctttgagcttgttgtattgctcttgatagttgtgtttttcactttcatcagcatcggtagtcttgccgtccttgtcttgactagccattttcttaaaagcgtcactcactacctttgcatcgccctgcaatttttcctttgagctctgaaatatttcgctcactttttgttggtctgtattcattctggatgtcttggttgtagaaatttcttttattggttcattaaagtcaaggtaaatggcgagaactagaatagagttttattctttttaccgttatatagataattctagccgggggcggtcgcccctgagattcccgacatcagtaagacatagtactgtacgattactgtacgattaatctatccacttcagatgttcaacaattccttttggcattacgtattaatacttcataggatcggcaccctcccttaagcctcccctaaatgctttcggtacccctttaagacaactatctcttaaccttctgtatttacttgcatgttacgttgagtctcattggaggtttgcatcatatgtttaggtttttttggaaacgtggacggctcatagtgattggtaaatgggagttacgaataaacgtatcttaaagggagcggtatgtaaaatggatagatgatcatgaatacagtacgaggtgtaaagaatgatgggactgagagggcaattatcatccctcagaatcaacatcacaaacatatataaagctcccaattctgccccaaagttttgtccctaggcatttttaatctttgtatctgtgctctttactttagtagaaaggtatataaaaaagtatagtcaagatgtctaacatgatgaataagttcgctgaaaaattacaaggtaacgatgattcccatcagaagggaaagaacgccaaatcctccaacaaggaaagggatgatatgaacatggacatgggtatgggtcatgatcagtccgaagggggaatgaagatgggccatgatcaatctggaacaaagatgaacgctggcagaggaattgcgaacgattggaagacttacgaaaacatgaaaaaataatgttacgtttttttgggcgcaattaaccaagtccttttatttttttaatggtttatttatgaattgtttatgtttatgttctttatactcaaaatcaataagtgcttattttagcgaattttcttctacgaatatatataagtcatatctaagacttccatccgtgctttattacgtttgtatgatgcatacaatgatgccaaatcagcttgatgctgttggtattcagtcgtccgaaagcctgttgatgtgacactcaaatcttcggcatgtgtgaacggtggccgagcatagttcgtgaacatcatcacttaaaataagaactacactttacatcagcgtggaagataaaggttgttttaagctcaagggcgctggaggtgtagcgcttcggaggaaaataatattgaataacttcgctttttgttccaaattctagattatcgtgtatgttcttgttcgtacgtccatctccatagttataatgagtgggcatgattctgttacaaaaatatctcatatcctgaatgaaccggttaacgaaaaggtaatggtacaaaacgggttccatgaaagctctaaaattgcagacatcgaattagagatacaggagcgaccttcgattaaacaatgggaatcgccgcggagtgctgtaattcctacttcaaatcataattttagcccatttctctatacgcaatttaaatctcgtggtgcagcaccgtttgcacctgaaacaataaaatctgtagatttagttgagctaccggagggtgtacccgcaagagtgtttcatgaaaagacgggtttattttatcaaatatctccacactctattccaacatttattttagccaaaaaagaactcccggaccccataaaattttatgagttagtggaagacttagggtcagtttatggatgtgttaagttgaaaattataccagatgctgacaaatttactcaactaaatgttgatgtagatcgcctctggtttaaagcaagaaaacaatttttcaattcgaatgaatttcaaagaaccaagatagttgatttttatgcgaagttgtataattttcacaataaaatcaaaaagagtactctcacaaggatcccaagtatcgataaacgcaccttggatttatatagactgaggagttgtgtgaagttgaggggaggcttcaatgctgtttgcgaaaaaaaattatgggcgcaaattggaagagaattaggttactcgggcaggattatgagttcgttatcaacttctttaagatctgcctatgcaaaaattttattagactttgacatatatgaagaagaagagcaagctgctcgtaataacgaaaaaaatgaagacatggtggaatctgaaatatttcgtcactcaaatagcagaagtagggacgaagaggagccacttcataaaaaagctaaaatacaccgcgatgtctttagagccggatcgattaatcatgaatttaaaagaatgcgggacataaagcacataaaagggtttccgacttattttaactcgttaactgagtttaaactaggctatacacagtcaacagagaccacattaccgggctatgattttactttttgggagaatggtatggaaatatacgataaaagcaaatacgaaaccaaaacctctccagtatacaatttgagacagtattacgaaaaaagtctggctgttttcactgctattgtagcgaaatttgggagtagctatcctgatttgtttgcgaaacacacaacattacctcaaaaggaattcgagaggttatactttcatttgctatcggagcactttatagatttcgaaattgacaccggtcttggactaccctgttccatgagatcaccaggaaacaactcgtccaatgaaaagtttgccattaagaatattctagaccagtggaatttagacaacattcctctcaatgaactatcgcttttacaacaccttgatctggatatggccaattttacgagaaccacttatgatattggaatgttgttttcttgtcaaggttggtctgtttcggatcattttttaccttcaattgatttcaatcatttaggttctaccaagttggtgtacagtattgcgccgaaagatatggaaaaattcgaagctttaattgctcgaggaaaaagtgaatgggatactatccaatcaaggccgcgctactccacctccgatgacgaattaaagagctttatagaaacagatttctacaagtcatttttggatgcagaacaatctgctgactattcaaacactggagataattcaaaaaattcatttccagaagataagatagcaggaaacactctacatgatggttcacaaagcgacttcatatttgagcctaatttcatcttagccaatggcataaaactttataagacgacacaggagcagggctcatacatttttaagtttccgaaagccttcacatgttctattggatcaggtttctatctatcacagaatgcaaaatttgcgccaagctcctggttgagattcagttccgaggcagcaaaatggacatctaagatggggtttcttcccggtttagatgtaaatcaattacttatcaatgccctactaaactccaataacccagttttaaggaaaaaatgccgtgatttaataagtaactacgtcgttgaggaagcggaaaacagcaaaaaattaggggagttgattggcactgtagatgtcgtttataataaattgaattatatttcagatattagtttagagtcaactggtctttcaaaaatcgttgttacacacggtgcattgcaacgtaatttatctctgaaggaattcgtggtattgctagaaaaaccagaaaacggtgctcatagtatatgtggcatcccaatacgtgatcaatctggtaatctcaatgtttgtttgcactcatactttgatagcgcaagcctaggaattgctctcgatggcttggacaagcctccgacttcttatctgcttgttcacaatgaagattttgaaaaaaagtgggacgtgttaatgacttctacttttagaaatagaactgtgccattaaatataatacagtatttgatctctcatactgatagtaatactgagtttaatcgaatgttacgctccaattttgatgattcattactacttattgagaaatgtaaaaagtttattaagaccttcgtggatgtttcctgttctgttaaagatgtagatttcggaaacggtttcaatttacgtcatctaccgcttaagttttctgacaacatggctgataatttggagagcttgtatgaaagtgtgcggaagtgctcaattgaattttcagaaaagccgacaattatcagactgtatcacgtatctcggcagtttcctatcgataatagagatattattgatggcaataatctagatttgcttaaggaattatatcagaaatcgttaaccatcccgttgaaggtttcttattggactaagttgaccagaaaaatatgtaggcttgaatggttatccgtttatgaacatatattcattgagcgatgtgatattaagaatgaagaccctgcgaaatattcacttccactgttatattcttacttcgaatttggtttgaaatattgtgattcggaagatatagataagttaggggaagtgagaaagctgattttaaaatatcaggacatgatgcagaaagttcgagtttttctaaaaaaggatccaccctcaaaaatatcgctaagtgatttagaagacgttttattagatatagaagaatatcggttacccatacaaagtagttttttcagtgagcttgattatgttattagagaaattgaaaatgcaaaaaaaatgaacgatgtgaatattctttataacactgataatattgataaaatagacgaactcatcaggaaaaatgatcctaaatttgtgaagtttgcgaaccagtttaatggttcgagattagataagagaccgctggccagtgataattcaggatcagtgaaagccaaacaggagttaaaagttttcaaattatggaaccagcacttggatcaaataatgcaaaaaaataaatttattgagatactgccgtcgatttttagatgtttagatttgaagtcagacaaatacattcctttggaaagttgttctaagcgccaaacgaaatattgcttttgtagaagggttgaagaaggtactgcaatggtcgaatgtgaaatatgcaaggagtggtatcatgtggattgtattagcaacggtgagttggttccacctgatgatccaaacgttttatttgtttgctcgatatgtacaccaccctgtatggccgttgacaatatcgaaggtgtgacttttgagcttgacgacttgaagaggatcttagtagaatctttgaagctaagtttaattccagatccccctatcttgaagaatctctttgacgtttttgcgtttgctttgaacttcaaaaatgaaatggaaaaagaactatttactaacggttatgtaaatcaattgtcctctacgcacaagatcaagtattacttgagaaagttaaaagggtcacaatgcggctttactaatctgacggatcccttaaggaaacattgtcaggtgaaagatgcagaagcaattaaatggctcacagataatggaagaatcataatcacaggaattccaaattgaaacgtaatactatcttattgattaaaatcactatttacttatctaaaatgtacctgcgaagtctgcatgacatattctctcttcttttattgcgcatacctcgtttactcatactcagatgttctacgacgttttctatggttggcagtagttacctattgttgacactccagtattgggtgtttcccatccagcataatcccggtaaaaaaagacaccccagaatctaggagagctcctttcgaaggtggaaaagcgcgttttgctgtcaatattgatgtttattagtaagtgtttaccgtttcttgatagctttccttacgtaacaattgttcttctgctttccttcgtaggaggaacgcgccaaggcaatttttctcgagaggtatgaaaaaaataaaaaaagctcatttccatgacaacttcaagtaattgaccatctataggaaccctaagacttttggcaacttcgacttagagctcttttttgtggttttgttcatttacgctaaataactgagagtttaaatttattgatttatatattattgcatcacacaaacatcgctttctttttcgcatttttgacaatgttaagaatctgcgtaaaaaggccctgtataaagatcgttctttcacaagtacgtccagcattactagtaaggaaggagaatctccacataagtactggagtaaaagttgaaaagagcagtataataaaccaaaaggaccctaataaagtacgcgttgagataaacgagttaaagagacaagctgaaattgaaaaggctgcaataaaggaattggagaaaaatcctcaataccaaaaattagctgaagcattcaacagtcatgatcatgttcatttacgtgaatcagagaccgagcaaaacgacataatttcattgggcacgatacgagactacaaaagcagtaaatgtgagcaagctgataagccttcgtcgttgaatctgcattcgcatacacattctcatggacatacgcattctcatgctgctcacaatccattattagtacttagtactgagcaaattaggaaaaatgcaggcgtaagaatcacatgggtcggcttaggtgtaaacgttggtattgctataggtaaattttttggaggtatcgtatttcattcacaagcgttgtttgcggatgctatccacgcaataagtgacatggtttctgacttgttgactttgctttcggtagggctagcagccaacaagccaaccgctgattatccatatgggtatggcaaaattgaaactgttggttccttggcagtttcaacaatattagccatggctggtatatcaataggttggagttccctttgtgcactcgtagggcctgttatcccacatacaatcattgacaccataggaaacttaggtcatgctcatacttattctgaagacattattgaagacgttactgatatcaacgcagcctggattgccgccgcttccattgcagctaaagaatggatatttagagccacaagaaagattgctatcaacactaattcaaatgtactaatggcaaatgcttggcatcaccgtgttgattcattaacttctcttgttgctctggttgcaatcagtactggttatttggttaatatacaatcattagacacgattggtggtttaattgtttctggtttaattatcaaggctggtggcgagggtatgtgcatcgcaataaaggagttaatcgatcagtcagtttctcgtgatgatccacgctacctagagatagaaactttggttaaagatacgttgaacaaactgatctctaataataattctcagaaaccctatggattgaaagaactgacgttactgtcctcaggaccgaatttacgcggacatttaaccttggaagttcctttacaaaaatggggcaatattttaggtgttaacgagtttgaaattgtgacacatcatttacgtaatgtgttaaccaatgaagtatcgaatttgagaagactggatattgaatacgtggaagaaaaaaatggtgaggaaaatgagcatatcaagggacaacaaaactacaaagaagatgttcttattaagcacgaccatacgaatactcatatttgagcttcccacagtaataataacaagtgaagaagagagggaaatgtcgaaaatacccgaaacgcatttcacaattacaaaaaggccaaaaaaaaaaaggaaagacaatacgcttatatttgtcacgtatacctactatttgatttatgtacgttttatatacaaattgcatttactatttataaaataaatcattaactataatactctaactgaatgttttaggatcttctctattaaaaatatacgtggaaaacgactatggctgcccgagagactaaaaaggaaagagcgagggatataacaatagcagtcattactggtgataataatgacataaaagaattactgaaggaggcaaagtatatactgtcaagggtataatggtgaaagtaactgcagcttgtatcataattggtgatgaagtgctgaatggaaaagtagttgatacaaattccactttttttgcgaagtattgctttgatcatggaattcaattaaaagaaattgcaactataggggatgatgaaacccagatcgtagatactgtgagaagattagtcaaaaattatgattttatcatcagtacaggtggaatcggccccactcatgacgacatcacttacgaatgtatggcgaaaagctttaatttgccttgtgaactagatgaagaatgcaaagaacgaatgaggcataaatctgaccctgaagcaaggcttgatgcagatgctctaaaggcgcattaccaaatggcaaccatgccaaaaggcacaaacgtcaaaaattattatgtgtgtgatgacttgtgggtacctatttgttctatatctcacaaaatgtatatactacccggtatccctcaactatttgcaaggatgctgaaagcgttcactcccacgttgaaaaaaatatataatttggacaaggatccacgtgagtatgttcgttattttgtcagaacacacctaactgagtctcaaatttctaaagagctaaagttgattcaggatgaatcaacaaaagtttcagaagccattaaaataggctcatacccacattttggtatgggattcaatacagttagtattttgggtgaaaagaaagacgattcatatctgaagagtattgtcaatagagttgttaataacctcgagggagaagtaatttcttctgaacttgaaaacaagttctcgaaccaggagagctgaatacccgagtatttagaactatgtatagatatagattttttttttgggagcaaagtcatctcagtcatcgccggtagttgcgctttcttctcaacaaaaaagtacactgctcgtggtagaaaggtaccttgaaaaattaaagatcacattgctactgttagagcttcaatcgctaaagtaaacatttgaaaaatgcatatccgaaaggaccaaaccagcaaaaggtatataattcattcaatagatacaactgctccatgaaaggaaaaaccttcatttacggtcgcgttttttttcgtgatataaaaaaggtaaaaaaaacgcgtcgcgttagaaaaaaggtgtgtgtgaagagaaagacccattgaatggagagttcggttcttgggaattgcactgagccgtggtgagtttgttgctttactacatctcttcttttataagcaacgcttaagctgaacctagtcaacacacataactgaagtcaatttgaccaggtgcaactgaaacctggattggaattggtattcacttgaacaaaagactctggtaaaatgtctgaactctctcaaatgacattgaagatcctttacacattggataatggatccaatggtagttatttagcccgctcaagggctccaaaacaggtaagagttgctaatattcctagtccattcccgacagattcgaatgagcaaacggagttgcgaattggcgccatccatttgaagactatactgcatgaaatatacttaaattcacctgaagtgttagaccatgacactttaaaagatggatatgattataacttgtattatcgtgacatatgtgaagtggatgagccattagtaagccttggtcttctttccgggcttcgaaaaaagtttcataagaatagcccctaccagtatacagaaaacaatattggtgaagaagaaagtgaagagagagatgaggtaactgaagaagagtatgaagatgaatcttttatagttactggaagggtatgctcgaatgtttccgctttactacgaagatcatatagcaacatctcgaataaaaagggaagggtcgtaaacaaccaaattccggaagaaactttggaggttaaactaagattcacaaaagttataaccaatttaaggacgtctggtaacaatactacaaattctcggatatcgtgtcttcaaatgccgtcttctttaccatcagcaacacttccgtttaccccaaaatcgcaatctcttttcaagacaaaccaaataaaaaattcaaggaatgcaaggaccacgataacaataaataatactaatagcgggactgtgggaagaagacagacgaatcctatgcctgctccaaaagctgtcagaactcagtctttacccatctggaatcttaaaccaaatatagcgaatactggtttcccaagaaattcaattgcgcacaaaatctacttagcagatagaaaaacagaagccaatcaacaaaacaaccagcatcaaaacatagcttacgaaataaatactttgcaaaacgataatactattcagaggaccaagatcgatgattcggtaagcaagaggttcgattttatgctcaacaaaagaaagtctacgaaaaaagtgtcacctggtatagcaacgatagcaaaaaaaccagcttcaataaacataaatccaaagcaaccgccgaagactagtggtgaaaaaaaagcaaatgataagcaaacgattgtcaaagttaagaattcgaattccaaaaattcggctaagtctacacaagcaggatgtaggcgatcatcagtgatagaacatttaaatgatcatgacgattcaattttaagtgacattctatcggaaccaggcattgaagggcagaaattgcagcaaaaacaaaaggggcgtaagatatctttaactagtgaaaatgataaagaaaatattccaccccaaagcataactagtaaagagaacaagcttgaaggtgacttggattttaacgctgagttccccatgagtgacttttcggatgtagtatttaaagatgagatgggatggttttccaatttcaattgcaatttttttgaatcaccaacttctgcaagtgcatcacaactcaatcagcaaaatttgaagccttctataacactcaacgatccaaacacctgtaacaccattgctctcgaaaatgaagatgtcagtgaattggaaacagcgcaaaataataaaatatctttgcctagcgatgttgacaaaacctccccaatagactcgttgtctatacctttaattgaacttacacattcaagctcgacaacaaacatgcagcgtatatccattaaagaaggatcgacactaaatataacagatagtaataatgccaccccatgtgataatgatataaaagatagaaaggcatctgtaatagattcggacaatacaaaacctcaggcagggcttataaatttctctactccagctgaccagccagcttctgataataatgttacagcttcgaaaaagcttactagcatgctggaaactcagcaaagtaagagatctcatgaagaagttttggatgaagaggaagaggaggaagccctcaaaaagcaaaaggcaataccgtcttcaccatgtgggatgttcaattatcatcaacccatggaattatctgaggacatagttgaagaagagcaaggacacaatatcggcgatgataatgaaagcgataagaccaacgatttattctcaacattcatccattcaggaataagagtaagtcaggtagtaacaagtcccatcggtgaatttcagtcaataaaacactgaaaatattacatgaacttattcctagcacagcatgtatatatatatatatatatatatactcagatcatacatgtagcaccttatagagaacaaaaagaagtatttaattagcattttcatgtcgttaacatgttatcgcgttctgcagccttacgtataaggtcgctggcattcaaaaacgagcacatatactcattaaacttctccctatcattagcggaaattgtctccttgaatataggatccatttctacctccacttcatgggacgtgtattgatgggagttccttcgcgtggtagtaacctttgtcaaatccaagtgtaaaggcattttatcattaaaggtgtaggtggaacggcttttggttctttgtaaaataaagccattcctgaaagcggcagaagtttcgtattcaggcacttcaaggctgatgctaattttagcgtctaatgaactttgaggatagcgaatgagaaaatccttgacccggacctttttgatgtaagtaagtttaagttctttgtttctaaggtcttccgaacaacgccatgaagttaatttgccaactttcgaggcattgttgcagttatatatagaatctttcgtatacttttgtacctgttttactactcttggggcacatttacttggattctccgattttgagcggagtagctcctggaaactcgagaacatttgctcaggaacgttagacactaagcggccatttctgttttgaacaataaagggcttgttgtgtggtgtcatcctgcgatgtgtccttttgtctgttataacaccaaatttcatttcgatttcaatgtgtgatatcgacgatttatcaatacaagcaagatatttccatgctaacttacaaacatgtttatggaattctgtcgcacctcttgaattgtttcttgtggttttgtataaagctctagttgatgttaatggcttagtggtttcagagatatgcaagcttctgaatttcgaggcaacattagcgtcagctttctttgcgccaacattttcatgagaatttctactattggaaggagtctcgggttggtcagacatatcttaaacttcctatagtgttttcatttttccttttcagtgctttttttttctttcccattttgctggtagtcaacaaagttgtcttaaggaaaaaaaaataaagaaaatattgaaaactaataagtttttttcctgtaaaagtgtataaaatatataggagatcccgtcaaataatagaaaaaaaattttttgccacatatacctgtagccccaggaatactgaaaaaatggagtaaaatgaaatgaacaattcgtcgtgaagaatacaaagaaatattaaagaaatttcgacgtaatacatagttcaaccgattaataagaaatacccagaataataagagaaagaaaatgaaaaaaggaaaagaagccccatgtctgtagtgaacgtgttctcgttagttattcagaagaagctggactgaaactcttcgaagtgtagggattgaacttaactatcttttcctctttaggagtggaggaatacgtttgggagatttgtaactgggtcaatagtgcttgttccatgtaatacttgtcaatttcctggtataccacttgttcttctggggtgagcaaacttcttggacaataaaagatgtcgtcttcgaaagttttactgatgttgtttttgtacattatggtgttcatgccgtcttgttgggtagtgaattcatcactagaactcaccctactgttgttggcagtgttatagctgaaaatgcccgagttatttttactattgggtaccgagggagaagaatagaatgactgagggctggtgaggttgaattcatgttgttggatgctttccgtaaggtagaggcttgtgttcatttttgcttccgcctgcaaaagtggagtcattttttttttgttctgaaatcaggagaattagagtagggggaaggtgagtaaatataaggggtcgaggaacaaaatccttataaacaatccgtagagtaaaacgctgcttgttatcttacagcaatgtaataacaagcaagaaagataaagcaatacgaaccagttgctacttggtggcacagacgtgcgaattaattaaggttgtgtggacaggaaaatagcgtttccctcgaagggtattgttcttgttctttttatattttcggcatttttatgctcggcatttcccaacagaagcggatatattttaagggcgcggagatgagccaaacggcaagcgatatcaaaatatctgcataataacggcaatcaacgcgcacgcgaatggccaagagggtacaatagcagcaatgatgcggcttgtgaaatggaggagtgggtgcggtagagcttatttttttgcgtttggtgaagcgtccttggcctggtcaaaactttgcaccttagacggcgatgctggagtgtcactgctatctggagggagctctacaatgttgtggttttgtatgggagtgtggttcaggaagagtggttgcatatagctgtatattggtagtggaggaggctgatgcggcaatggtatgggagcagatggcataggatgagggaagtatggtggtgcgtaaagagatatagtgtcttgtgggctagcaggagttgatatgggcagattgtatggaacaggcgcgggctggacaacaattccatatgggcgtaattgcgggaacattcttgttgcgttagggtcgttcgcagtgctatttgcggactgctgcagtctacgtaaggacatcaaatcaacgtccgaatgaacagaagattgatgttgtcttaagttatcgattctactgaagaatttaaggcagatattgcattggaatggtttctcccctgtgtgtttcctgatatgtctagccaaatgttcggtcctattgaaactcatgttacaatcaggatatcccacgcatctataatttctcttgacagaagcgttgtctttgttccttttcggttgttttcctctcatgtttaaccagtgtcatgctaattgtcctggactatagacgtgagtggggaggaatagtgctatgaagtcgcaattgaatcaagaatacacgaaagaaagagaaggaggcgtctgttcatatacacacaaacaatagttgaaatcaagaagatacaatgaaagaaaagagaaggaaaataatgttataaacgattgaagggatccgctgaggaatgaaaaaaaaaaataagaaagtaagagaagggaaaaaaaaaagaaaaaaagaaaaaaagaaaaaaagaaaaaaagagggaatgatcgaagataaaaattctcagaaatttgagaagaaggaaaaactctacttaaataaagataaacttttcatggcttgagagtccggcatccacgtaacttaatggtccgtgcggtaacatggcagggtgtgcaggaccctatggctcgagaagttgctaccggtgtttaattttttttttatcttaatattaggaagagaaaaagcatcagttacgagactcctgaaggagcgccggaaagtttcttttttttttttttttttttaattttttttgtgtggggaaagaccgactaccagtaatactttaaagatattattaaaagaaatcccgaaaaaagaaagaccatgagaaaaccgagtgcgtttcatgcatgtaacataatatttcttcccctcgttaagtgtgcatcagcaaccataatgctgaattaaccgcaaaggttaccataaaggatcgcatataaacaaaactcgccctttctcctgcatcccttaccgaaaaggaaagtttatatacacttaaaggaaagtgctactgtaggtcgtcaggccgttgatgtactgctcttcgagacaactattgtaccttaactgtaagaatttgctcaagccctcaaaaaacacaacgtgcgggtaacgacaacgaagtgggcgcaagacaaagatggaatatcctatccgatgggcactataaaaggcgaagggaaaattagttttttttcttgtcaagcatttgccgagcgcttcaatgttgattggtctagaagtaacaatcaagacagataaagtctagtacgtgtgcaggttaatgcgcaagtgagaagtgtagatattgtagttgtgatatttactattctaacttggcgctattaacgctttcacaacccaaaaacatcaagaaaagcctttcaataaattgctcttctcttggcgaaagaaagcggggggcaaaaagaatcacgggacttatgtttcgggatctctttgtttcttctttttttcccggagaataattttttaggaccaattaccgtagttgcgactacaacaattgttgttcatacccccacgatttactttttgaaaactagtttttggaataataatgttgtaaaatttccctttttccaccccgatttgtattttatttttcgttacaaaattgggactaatattaagggcgacagtttttcttaaaagtaagattttttacttaaaaattcttgttcttaacgaaattacatacgtattaaaattatttattagatagtcggtattgtctttttgtgaaaaaaaaaaattataatactaattgttaaaaaggcaggtatgaggagggtatagtaggaaagagaaaagacgttacaatttttaggttttcggttttaatagaaattgtttgattacacataataggaattggggggctggcgggagggaggcgcatgtgctctattactttcttgtttccacaacggatggaacaaccacaacgacaacaacaatagcaaagataataaagcagatgatcaaacatcttattttgttttttcttgcttttctggcactcttaacggccttgttggtgtgacccacaccttgctctacatcttgctgagcgtcttcgacgtttttgtcaatgacatccacattttcttgttgttcgatgaccaactcttccatgtcattgaacaattgggtaagttcagccattgttttttccaacttcaacaactcttgatgtctagcctgtacttcggccaatgctgtcttggcctcaccacgtctattggcgtttagcaacgcttgggaaaagatctgctggccattgacatcgttgatggcggcttccacttcttcgtcagtggcttccggttggataattgtgtactgtctcttcgcctgctctttgctttcttctttgtagttagaatcgataattctgtagtcttgaattaattttaagaatttctgtctgcaattttcagcttgtgcctgtttattagagtcgtgcaatccgtctctctgggcatctttgatatccgctttcaattgatactgcaaatctgtggcctgagagatgtaatcgtccaaagaacgtctcaattccatctcctgttcctcactcacttgagtaagtaggtctttgtgttgcgcatcaatttggttgataatgttttcgtacctggacaagttagcatttattgagttgatcttgttcataaaagctacgaaatcgtcgctaccatctgagtgaccagtaggagcattgttcaagtcctcttgcatttcatagttttcagcgtacggattgttattctcataaggattagcgttgctcattgctgcaatatttgtgcgtgtatgggcagttttcaaatgtaaagtattacaattccacactattccagctctcttatgggtatattaaacgatttaacctgccaacagcatttatttgtcattttacttgcttttttcatccatccattgaaactaaaaacgtcaaaaaaggccatttcgtaaacaacggccgggtgataagcacgtcgtttaggggggaccctttgctgccgcttggtacccggctcgtaagacataaagatgccacatatttacttttagctggcttctttattcacacaggctactcataagagcttcagtagacgcgcatctgtcggttcttcgtcaatctatttccgcacatactattacgtacgatggctattaaaccaaccaaaagttttcagaattgtctagaagctgaagtgcctggttataacgactgtccgacagttttgttttctatcgaccctaatagcggacctagatccaaatctaaacaaagaacgaaatcgaaaagatgtgttagcggcagacttgccacagaagtgttagatctttatgggaacactaaaacagctactacgccgccaccagttttgaggaggccatctgtaactgctgctcaacaagaatctgcctgtgaaggtgtgctcgtaaaagaccaaggcgatagacagctccagccgatattatgcagtaaagaagaattagtggctaagatcaacgacctctgtgtgtgtggctcgaagctctcttcgaaggagttggaattttacaagaaaaaattagattcaaacattaccaagattttacaaaacgagcacaccaaaacagtactatcccagattttcaatgaaaaagacaaaaatatggccgtgaaaaccattaaacattggatggttactgacacaacaatctcaaattggtgtcccgcattcttaaaaatttttgaaaatgcgatgcctaattaatcaataatattattatatttataaatagaagtacactacgcagaacattttattttctaaaaaaaaaaagaattcctattgaataattaaaaatcaaggttacccgcagtctgcttgagaaatttaataaaaaacatgtaatcatctcatcgcgtcgaacagcatatagcaataagggctcatcaccgcctcatgtttcttcttgtcatatcagatcaagaaaaacaaaaggttggaaaatgaatgaggataaagagcaaaagatcaacatacacgatatattgaatacaagaccgaagctcaccaaaaagacagccctagatgttttcttcgaagatctggatgacaatgtaattactcccataaacgaatatgttcttgattcaggctcatcatcatcctcttccatttatcaggcgttgaagtgctcaaataacaatgagtttgttgcagtacttttacagaaattccagaatttgcacattcacgtactagaacagcaacggaggctcatcgaaagtaaaagtgacttattgcctatctcattgcatgatatgaaatacgtagacgaactgataaatcttttgattattcatggtatagatgctaatttgtctcctacgatgaaaattccattcgattcgaaaagaataaatactttcaagaagggccaaaaaagcgcagaatatgaaacgcctcgatggcacaccataaataacgatactttatctcaagtcataactgtcttttataatgttctaactagtgagaggtcttctgactacctgagagaaataatatcaaaaggcagtgcttacgcaaacattttattaggtttgattgtgttacatttgcagttgcctaataggtactcttcacaaatgattacaaatctagaagatactcaagaaacttatactttgtttggggtttacactctactagtagaaacaattcaagacgaaaaggttagggagccaatcctttcgaagttaacaacgttaactctacgaagaccggaaaatggtctgatcagcttgattgatttcgttttgggtgtgagagatgctgaagatatagatattgaaaagtttaaccgtatctaccaaattttgatgagtaagccaaaaacaatgacaaatttgcaatacttgacggaactattcaagcaaatttatgatggtctcacctttgtgaacaggcctatcctggtcacttgtttgaacggactaatccttaaattttacctgaggaataagaggattgttaacgattttttgtttaagaaggtccgctccattatctttaattccccgttaactgatcatacagcaaaggaactgaacgatgttataaacgttcttatatctttatccaaaaattcttcatcggatttgctgaatgatttagttactagttgccctgatgaagacggtactacgcctggacagttctttttatatgtatggatatatgctctttttttgaagaaaaaccaaaaactagacccattagaaataaacaaattgtctatttcagataataaaagcacagacagcatacattttccagagcaatcttcctcaaagtattacgaggttgtattatcattattaaaatctctaatagtcataacagaaaattttcaatatctaaatgtactgagccttaacttactgaattttgagcacgagaaatggaagtatttaattgatcttgatactcagctaccctacatatcggttaaaaacacagatatggcagagttgtttttcgaaaaaggatccaaaaactctcaaatttctgagtttcttcaagatatggacctttcgatagaattatttatggaatttttagtgctgctaaatgatgaggaacaatcaaagactttatttttagatattctgaaaagatgggtccatcatacaaaaaaaagtgaaaaaagatcttccgataatcatagcgggatgccaagcgttacagataacgcgttaatactcatggacttgaaacttttggaatgtatgaacaaccgatttaaaaccaagattgttaataaacctaaggacgttcttattgttattgatcaattgatagatgttgttcaggaaaaagatgaaacaatacaggaagtagaagcagattctgacgacgaagttgaagaaggagaagaaacagaagaattggatccaaatgaaaattcttcctacaaaattatcttgcagttattatcaaccgtcctttcagaatcgtccagtagtatattattgcaaaacagttatatattgaaatccatttctagaaaattacaatctttcaacactaatgcttccgaaatagatgcattattggcatcaatagataatatattgattaacggacatactacggaaaggaacgacaacatagaaattgagatggatgaggaaaggcttgacaaagcgataactagtctacatgatcctttagtgcccataaaatcttatggtttaacagaactacgtcatctagctgaaaagaagtctccagtaatttcactggaaaaggtgttgcaaatacatttagattatttaaagaatatggaccctttcatttatctcaacgttattaaaggacttacaacgctatgtgaattagagccagaaaccatattgcctctacttgcagaattttatgctaacaaaaaaaagaaaaacagattagatgatgtgctgaaagttggagaagtgttcatcaattacattcaacgtcagaacgaattgttccagggtaaattggcttatctgattatagatacctgtcttagtattgtgaggccaaatgatagtaaaccattggacaatagatggcgtatgtcatccatgtcaatcttaggtatgtgccttcaaatcaacgccaggggtgtctcggatagaattcgcgatatgctggattgtgtatttggaatattgcaattagaacaaccacaaaatcatttgaaggacaaggatgattcttttttgatgagaagaagtgccgtacacttgatacatgatttgttgtacagtacaggatttgatttacttccctttgagtacaactacgataagctaaaaacactattatcttacgttcgtgatcaagatgaagattacatggtttgtgaacagattgacaagcttttaaccgtactagatagtttataacccattacgcatttgattataatttgcttcttaggcaaaattaatatttacgttcttttatattctttctttttgtattcatagaacagcagccattaccaatagaaagttaaaatagccgccgatgcattttattacccgcctttctgttttctgggcacttttctttctagaaggtgaaagaacaatttttctcgttttctcgaacttccaccaagcgttgggtaatgagggaggagatttgtataaaaagagtggcatgtgaactgcctaccgtaagtgacatgaacacatgcattatattttttgtgatatattctttctcttgttttctttttcttgaaacgctacagaaccaatagaaaaatagaatcattctgaaatatggctggtgaaacttttgaatttcaagctgaaatcactcagttgatgagtttgatcatcaacactgtctattctaacaaggaaattttcttgagagaactgatctctaacgcctccgatgctttagacaaaattagataccaagctttgtctgatccaaagcaattggaaaccgaaccagatttgttcattagaatcaccccaaaaccagaagaaaaagttttggaaatcagagattctggtattggtatgaccaaggctgaattgattaacaatttgggtaccattgctaagtctggtactaaagctttcatggaagctctatctgctggtgccgatgtatccatgattggtcaattcggtgttggtttttactctttattcttagtcgccgacagagttcaagttatttccaagaacaatgaggacgaacaatatatttgggaatctaatgccggtggttctttcaccgttactttggacgaagttaacgaaagaattggtagaggtaccgtcttgagattattcttgaaagatgaccaattggagtacttggaagaaaagagaattaaagaagtcatcaagagacattctgaattcgttgcttaccctatccaacttctagtcaccaaggaagtcgaaaaggaagttccaattccagaagaagaaaagaaagacgaggaaaagaaggatgaagatgacaagaaaccaaaattggaagaagtcgatgaagaagaagaagaaaagaagccaaaaaccaaaaaagttaaagaagaggttcaagaattagaagagttgaacaagactaagccattatggactagaaacccatctgatatcactcaagaggaatacaatgctttctataagtctatttctaacgactgggaagacccattgtacgttaagcatttctctgttgaaggtcaattggaatttagagctatcttgttcattccaaagagagcaccattcgacttatttgagagtaagaagaagaagaacaatatcaagttgtacgttcgtcgtgtcttcatcactgatgaagctgaagacttgattccagagtggttatctttcgtcaagggtgttgttgactctgaagatttaccattgaatttgtccagagaaatgttacaacaaaataagattatgaaggttattagaaagaatattgtcaagaaattgattgaagccttcaacgaaatcgctgaagactccgagcaatttgacaaattttactctgccttcgctaagaacattaagctgggtgtacatgaggacactcaaaacagagctgctttagctaagttgctacgttacaattctactaaatctgtcgatgaattgacttccttgactgattacgttactagaatgccagaacaccaaaagaacatctattacatcaccggtgaatctctaaaggcagtcgaaaagtctccattcttggacgccttgaaggctaagaactttgaagttttgttcttgaccgacccaattgatgaatacgctttcactcaattgaaggaattcgagggtaaaactttggttgacattactaaagatttcgaattggaagaaacagacgaagaaaaagctgaaagagagaaggagatcaaagaatacgaaccattgaccaaggccttgaaggatatcttgggtgaccaagtggagaaggttgttgtttcttacaaattgctagatgctccagctgccatcagaactggtcaattcggctggtctgctaacatggaaagaatcatgaaggctcaagccttgagagactcttccatgtcctcctacatgtcttccaagaagactttcgaaatttctccaaaatctccaattattaaggaattgaaaaagagagttgatgagggtggtgcacaagataagaccgtcaaagatttgactaacttattattcgagaccgctttgttgacttctggtttcagtttggaagaaccaacttcttttgcatcaagaataaatagattgatttctttaggtttgaacattgatgaggatgaagaaacagaaaccgctccagaagcttctaccgaagctccagttgaagaggttccagctgacaccgagatggaagaagttgattaatctcttttttcgccttcatgttttatatattatataaatttgtttacttatttttactatttgtaataatgattctgctttacgcgcctttaaaaaagttggtcttaatgtaaacatgaaccatagcacacaatttaagacatcagctgtcaaatgaccataaaattgtcctaccagctgtccttaaagtttagtgtacacttacgaatgacttatttactcacctttgcaactttgttcaataaattcattgatcttttcaagttcctgacatcttttgtaactggcatagagcttcagacttgaccagcctatagcagcagtaccacaacctataatattgaaaatcattctaaattccgaaggggagcaattcggcgtccattcaattttaaactttctctgtatccatagaaaagcattcaatagaagacctcctgtacatttaccaacaaagggccatagtatcttttctgcaagaatagcataccaattccgcctgataaaaaattcctcagctggaacgctattactagagttttcaaaatttccgtgatacaaatacttacctcctttattgatcagcctcctgtaaattaagtcaaccaatcttttaaaggtaaaattatagcaaaatgtagccaagttagaatacaaaattattttaggtaaacctatacccttgtaatatttgtttccagcagtttttacaatactgagatacacccacttaaagagtattgcattagcactgacgttagaaatgttgctaagataatgtatgaacccatatattatgatcgaggaggttaaaggaatgcttaataagccacgttcagtttgcgcatatacgtccaatgcctttgtagtgctgatgtttaacatatttcgtagaacattctcagggaaaaggcagcgtagttgccataatccaatgtcaaaacttgtcttttcagggtttaaaagaaataaactagttatccctaatggtatcacgtatcgtgtaattttttgccactgataaaacagggatagtacagaagactggatggttactgtaggtctttttatgaaatttgttttcttgcattgaggacattcgccaaatttcactaacacataaggtggatgattatcccgtttggtataaagagacattagattgaacacgtagtcattttgaaacggtactgatttttgcccccaaatgggacgagtttcccatatttctgtaagagagaaagtcgtcataaaatcatggtgcccatcaacgagacattttaaacaggtgattataggtaaatcagcatcctttggtaggtccactgtgttcggaagaaaaagttcaacatgcatttgatagagccatcttatatagcagcgtttatgaatttgtaagttgcaaccgcacgtgtgctgtagccatgtagagtcatatgtggattcttccaaacatatccagcatatgcatcttttttttatgagagataaaaaaaaatgaggtggggtcatataaaacttggactatttccttggaattttcttgtttgtaaaatcagagcagagctcttttatttacttttgtttttgacgatggggacgagcgatgtactcacatcttcgatatcacttgcctgaaaatatataaatgcgttaaacgatagaaaatcaaaaacatcgttcttttcactagaatattttaaagtcaaaacataacactttactatttacgtaacgaagtcttgtagttgtatatatttacagagtgtagtgctttagttgagaaaatatgacactcggctttcctctttcttttatttactggcttggttgttgcatatccatcatgacgtgctttcttaacaaattttttttgatgttttttttcaaggtcaaaggatcctcaacaccatgatccttcaaaaattgatcacattttagatcattcgacaacaattcggataatcgcgtttgaatacgatcaatgagacttctttgtttctccaaattaacctccaatccagagatgtctaactgtaaaagttgcctcactgtttcttgtgaaaaatcttgaatgccgtacctttgtttaatctccaataactctttcggcgttgacccgctagataaagcatcttggatggtcctaatatcacgtaaaagggttgttttttcatttagtttattctccctcactgatcttttatccaaaaattcttttgccttttgggcttcttcttttgcaacgcttaactgagcttctgattcgtataatgcaaattgttgacccttgtttctaataatttctgcaatggcaaaaaacttcctctttgaaagcggcctcgtcgcttctatccttactaaatcaccctcccttgatatttcaccttcatcatgcactaaataatctcttctatgaaataactccttgttgattttcttattaaagacttttgtttctacacgtactttaaccgtcttttgcatcttcccttgggagacgaccaagcctaaaaaattttggcgagccattacagtttaactgatcttgatttgacttttgaaatctctaacccgaattcaactccctgagtttacttctgtttggccttatttgtggatttcctctaacagtttgatgctcgcattggtttggcacaatcccaaattgcttcagaattctaatcttatgaaataacaatcatgttacccggttgaatcgttacccgacatctctgactcttcttgaggtatagactcctccttttcggagtcatgactctcagaggagtcatcgaagtcagcattgagctgtgaaggaccttgataagctagtcgaaagatctccaacgaatataaatggatgtatatatagcaggctcgagtggcacaattttcttctcttcaagttccagtgaattagtctttctcgtgtgtaccaatcttactgtattgattgctgcgcgatctaaccatcaactaaccacagtttattggaaaaacgtttcctaataccaggaagataacatgcttaggacaagagtgactgctctcctttgtagggctactgtcaggtcaagcaccaattatgtttcattagcgaggactagatcattccattctcaatctattttgctcaaaacagccgctacagacataacgtctacacagtacagcaggattttcaatcctgacttgaaaaacattgatagaccgctagatacttttgctagacgtcatttaggtccttctcctagcgacgttaagaaaatgttaaaaacaatgggttatagcgatttaaacgcatttatagaagagctcgttcctcccaatattttgaagagaagacccttgaaactagaagctcctagtaagggattctgtgaacaagaaatgcttcaacatctagaaaagattgccaataagaaccactataaagttaaaaatttcataggtaagggttactacggtacgattttaccaccggttatacaaagaaacctgctagaaagtccagaatggtatacttcttatacgccctatcaacccgaaatttctcaaggtaggctagaagcgctattaaactttcaaacggttgtttcagatttgactggtttgcctgtggcgaacgcctcattgttggatgagggtacagcggctggagaagctatgctcttgtcattcaatatttccagaaaaaagaaactaaaatacgtaatagataaaaaattacaccagcaaacaaagagtgtccttcacaccagagccaagccgttcaatattgaaattattgaagttgactgttcggatatcaagaaagctgtggatgttttaaagaaccccgacgtatctggttgtttggttcaatatccagcgacagatggttcaatcttaccgcctgactcgatgaaacagttatctgatgcgttacactctcacaagtctttgctctctgtggcctcagatttaatggctttgacacttctaaaaccacctgctcattacggtgctgatatcgtcctgggttcctctcaacgatttggtgtcccaatgggttatggtggtcctcatgctgcttttttcgctgttattgataaattaaacagaaaaattccaggtagaattgtcggtatctctaaagaccgcttaggcaagacggccttgcggttggccctccaaacaagagaacaacatatcaagcgtgataaggcaacttcaaatatatgtaccgctcaagctttactggctaatgttgcttcgagctactgtgtttatcacggtcctaagggcctacagaatatttccaggaggatatttagcttaacatcaatattggcaaatgccatcgaaaatgacagttgccctcacgaactaattaataaaacatggtttgatactttgactataaagttaggtaatggcatatcctccgagcagttattggacaaggccttgaaagaatttaatatcaatttgtttgccgtggacaccaccactatttccttggctcttgatgaaacaactacaaaagctgatgttgaaaatctactaaaagtgtttgacattgaaaattcttcgcagtttctttctgaggactattctaacagtttcccaagggaatttcagcgtactgatgaaatattgaggaacgaagtctttcacatgcaccatagcgaaacagcaatgttgagatatttacataggttgcaatctcgtgatttatctcttgctaattctatgattcctttaggttcctgtactatgaaattgaacagtactgttgaaatgatgccaatcacttggccccaattttcgaatatccatccgttccagccatcaaaccaagtccaaggatacaaggaactaattacttcgttggagaaagatttatgcagcattacaggtttcgatggtatttctttacaaccaaattcaggtgctcaaggtgaatatactggtctgagagtaatcagatcctacctggaaagcaaaggtgaaaatcatcgtaacgtgtgtttaatccctgtatccgctcatggtacaaatccggcttctgccgctatggcgggtttaaaagttgttcctgtcaactgtttgcaggatggctcattagatctggttgacttaaagaataaggctgaacaacattctaaagaactagccgccgtaatgatcacctatccttccacttacggtttatttgaaccaggcatccaacatgctattgatatcgtacattcttttggtggacaagtctatttggatggtgctaatatgaatgcgcaggttgggctaacttcacccggagatcttggtgcagatgtttgccacttgaatttacataagacattttccattcctcatggtggtggtggtccagctggagctcccatttgcgtcaaatctcatttaataccccatttacctaaacatgacgttgttgatatgatcactggaatcggcggtagcaaatccatcgattcggtctcctctgctccatatggtaatgctttagtgttaccaatttcttatgcctatatcaaaatgatgggtaatgagggattaccattttctagtgtgatagcaatgctaaattcaaattatatgatgacaagattaaaagatcattataaaattcttttcgtcaatgaaatgagcacactaaaacactgcgctcatgaatttatagttgatctaagagaatacaaagctaaaggtgttgaagctatcgatgttgccaagagattgcaagactacggattccatgccccaacgttggccttccctgttcccggaactttgatgatagaaccaacagaatcggaaaacttggaagaattggatagattctgtgatgccatgatatccatcaaagaagaaataaatgccttagtagcaggtcaaccaaaaggacagattttgaaaaatgcccctcattcattggaagatcttattacttcctccaattgggatacgagaggttatacccgtgaagaagccgcttacccattaccctttttgagatacaataaattctggcctactgtcgctagactggatgacacttatggtgacatgaatttaatatgtacatgcccttctgtagaagaaattgcgaacgaaactgaatgagtacatacccattatgttgtatatgtatattagttgacgcatttatgcacatatgtagataatataaaatattcaggtcaaagaaaagttaaaagtttacgagagaaaattcgaagttgataactgagcaatgtgcacaccacaatatgtcgtggttgatttaaaattttatgattcgcctttttatttatatgctatgttattgtgtatgcaattagtataagaggtaaagaagctaaaaaagtgcccaaaaagaatgcttggcgaatggtgtcgtagttataagtaacactatttatttttctactcttcactttcttcctctgtagtgacctcggtaatttctaaaacctcgtctcccattagcagacttcttggacgacttactgatggaccttgtacctgatttgctgcttgtggtatttttgggtaattggctttgtctgatttgattgataatttgttcattttctttggcttcgtttaaattggcgccaaaaaacttagattttgttccagtactttgggcaatcccattgctggaagccgcggccctgttcacaaattcatcatttagtattgtgtcgtatttttcatgatcctcgcttgatctctttttgctaagatctgctatcgtggctttaaagtacttgaaccttcggcgatatttgtcctccactgtgcctaaagttgcaaaagccgaatcattcattggtaatattgctgccatcttttttaaaatactgtcaggcataaagttcccaactggaggaaccattctatttcctaaatttaaagataattccctcagacgttcgtatgtcattcgcagattattaagttcttgtgtcgagcgtaaatcgcttgtgtttttcaaagtgatcggatgtgagctacccatggtcgaaccgccgtatgtatacgatcttaggtgttccttcgcacttataaagcgcggtggattagcagccacatttcctccaatggttgttgatttctgcgcgataactggtatattatcttcatttgcttgaaagctagaagatgtcgagggacgggagtttggtgctgatattgtaaattgcatctttatctccatttttccagtcagcaatttcttagcattgggaccaactttcacatagcttgaagcaaaaccgctattgttcattattgaatactcttgtaaaactcggatcgtaatcaaatggaagaaaatcctttcgatttctgatttttgcatggatttaccaataccatgctcctctaaggtgtcatggttagcctgaacaattttggagcttctcgaacctttaaagacatcttggcaataaattattgtgactctttcattttggatactttccactaattttacaatcttcttggcaggttctgtaacatccctttcctcgtttatcacgttggcgctatttctacaattatcacagtttttatgacacagtttggagtcaaaatcctcattgaaataagataaaactaactttcttctgcagtcagtaacgttgtcacagtatgccattacttgctgtaatttattcagatgtttttccttattctctctgtctaagttcttatccttctggatcattgtctgcatggttctaatgtccctgaatgaaaagtaggtaatacaatatgaatagttcccatctcttccagcacggccggtttcttgataatagccttctaatgttcggggaacggtaaagtggtaaacaaatctcacatcaggtttatcaatacccattccgaaagcaacagtagcacaaatgacttgtatctcatccgcctgccatgccttctgtacacttaatctttcatcaggctccatgcctgcatggtaatatgcacacttgatgccatttctttgcatttgggctgatgtttgctcgcatgatttcttggagtggcaatatattatacccgtttgatttttgaacctagatttaaccgcatcacagatttcaaaaatggtatttttggtcttcttgtttacttcgtaatacaaatttgttctattaaaactttgttttaggaaaacaggttcctttagttctaaattgtgaatgatgtccattctgacttgttcacttgcagttgcagttaaagcaatcattggaatatcagggtattctcttttgaaaaattttaattctttataatcaggcctgaaatcgtggccccagttagaaacacaatgtgcttcatctacaacaatacgagccaacttaccgtctgcgtataatctactgatagctctcttgcattgttctgaggcactgatcatctcaggagatatgtaaactaaatccaataatccattaataaataaattgaaagtttgtcgtctttgctcggcagtacccctcgaactgaacatgctcgccttaatatttttattcaataaatgttccacttgatcttgcatcagggaaattagcggagagatgacaatagtagtaccatgtgttttacccgatttcaccactgcaggaagttgatagcaaagagatttaccaccccctgttggcataagaacaaaaacatccttaccttgcaaagttgcatttacagcctctagttggttaggtctaaaaccaggcagtttaaagacttcatgtaaacgatataaaacttcatcagaccaaggataggttggaccattcgtcttagaagataaattggatttactcactatatcacttaatgaaaaatcgtcatcaaaatcgtcttcctcatccttttgactaacactggatttctccctttttattttgggagaccaagatggtggtgggtgttcattgtcacctgtaagcttcctttctgttattattttcaggtcattgtctagttcctggatatctgctacttgggttctattctctctttcttcgtcaaatctttctaaatcgctatctgataggtactcgataccgttattgttattatcttcttcaaaatcctcattttctttttcgctgtctatcaactctagatcagaatgagacatgggcatgtgttgacggccaaaggagaaactcatgctatcatccaaaattgcgtccttttccagatcatcttccaacaagtcaatatgctccacgcctatttgattttggccatttgagggaacgctctgtgctgtgggagatgataaaataacttgaacatttttattttgcgacaaggtaattgtggacctagtgtcaccttcttgagaactttcctgaatatttgcactaacatccatattatcatgataatctgtgtcttgagttgggtctaggtcgtcgtttaccacaaaatcaaaatcgctttgatttagtaattcgttttcttctttttcttcatctctagtagtcatgtagctggaatgggcatcatcttctgcctccattgttaactcatcttcttctctttcgacatccggataatcgtccctcaaagatttacccataacatagtcaaaaggatcatccctatcaggtattctgtagttgactggttctcttgaacgcatatttctccttcttgtaagttcatcttgttcttctgacgtcatgtggagatgcgggaatgcgggagaatgtggagccccctccttcaatattacaggagggtcacagtctatatcatcctcatcatccaggacttgaatcaaatcatcgttattactatcattattgctattcttaccggtgttattagtaatattttgcttcgcaccagtgatggctaatgccttagtgacggtagtcgcagtagtacttgtcaggtttgaattcctggaagatgtattgtattccaaggggctgggcagaatgcttgatatgatattatcatcttgtgaagaaacttgactgcgacctttactttgatcttttgacattccatcttttttggcttttatgatctccttttccagactatctattcgtatcgacatatttgataactgaggccgtatatccctacttaactgtagccttttagcgtcctctgacaatgatgtggattcgataatactacacttctgtagcaataatttcgattgctctttcaatgccataattagggagccttgaaggcggatcacctctaattttatatcattttcgagctgtttgcctatacttgaattatcgattacgcttttattgttatttctactacctagatttctgctactgtcattttcgacaagagaactagccatgtgcggtcgaaaagtattgaaattgtgagttttcgagccattgggcgtcctcgggttcgatacaacacttgtgctggctggtatatcaaccatgggtacgtcagcatattgattcgatgtggcagtgtacgagagccattctgtatcgttcgacaaagtttgcatgacttcatgttgtttcgtagcagtattcgttggtccagatgcaggaatgctggttataaagtttgttgttcctggtccacattcatctttggatggcgttgttggtggcgaatttgtcttaggccttttgttcgcgatgtgcttttggatagcctggaatacgaaatctttgtcttcctgtaaagtcgccgtttcctttaaccatttgtgctcccttcttaagttatgtgacggcttcgtcaccattaccgccttgtgtgtacgtgtatgattttttaaatatatacaacaataatctgtattttttcctttcctctagccaatgactccaagctggctgataaaaacaaactaaacggtaaagccacaaatccgaaatgtatcaccaatgatcacccagcctgctaagtgccctctattgatccgtatatcagcttttagatcaggctcgagtttcttgttatatgtgcattgcaaaagcataaacaaatcctggcagccgaagccgggcaatccacttcgaaacgcacggctgaactatataaatataaaggacatgtggagagaagcttctcttccttcacatttcgcatttcatgatctaaagtggttctttcacaatagaagagcaccaacacgaaatatggctgtcggtggtaataactggagcatgtggctgcgaatgtcacgggtccacctcaggcagatcacgaagtctctggaccgaacgctgatcagtttgagccatgggaatttttcccaccaatataatcgcaatatttttgtcacttggtggaagagcctatttgaggcttctacagcttttaggagggcaagtggtttaacggtatctcctctcacgaggagaggaatcgcaaggtttgaccatttcagacctgttcccaatgtcagtaaatttgcttcttttcccagagtgcccaaaggagccccaaggggcctttttaccaactggaatatgactacatcaaagagattattagggcagagagcttattcgacttccagtatcaaatttacccaagaagccgtgaataacatgactatatctttgaggtgttttttcaactcactaggcggattaaatcagtgctcccactctaattcctgcaaagcttatcagaatgcgtctaatgttacctctaaacaggatcacgtccaaccagttgcccttaagaagttatctcaaaaggatatcaatttcattcgtaatttagaactatttaagataatgaagacccagaatgaagtcgttgatgaaacaagcgcatattacatggaaaaaccaggttcctatattgaatttaccatttcagaatttaacgttaatgggacattctccgcacctttgtcatttttagatccttctttgttagcggatttggatgaaatgattagaaattacaaatacgaattaaaatcaatatacagtagtgttgacatgatcttgcagaattatggatcattgccgataacttttcatcgaaataagattcgaatacattttccaaactcaactgtggtggaaacagaaaaactaattgcaggtctgaatattgctacgggtgttatttacgcagatacgtctcccgatatcagtctagaaggtacaaatttgaatgctctggttaatgttgacaattcaggaagcgtatggtcttttgttaaggagccctcgtttccctctaggagcgctttttcacctattttatcagatgcatcctatgatacttatgaattggtctagcaaagacgttgtttcatcgcgctattaccaagaaggttactttacttgttcttgcacatggacgcacgttgtgtgttcatatatatatatatatatatatatatatatttgtgcttgttttcattgtctctatagttaatacattctatttttatcgttatatttgcattctcttcgcataaaaacttcatgaaaattcggcagaaaataagccatatatgtactttatccataggcaaagaaaagcacttaacgagaatatacaacaattgcactagtactgcatgtatatactcttatgattatagcggcaagaaaacaaatataaacacactaacagatgaattcgaatgaagatatacatgaagaacgcattgaagttccacgaactccccatcaaacccagccagagaaagactctgatcgcatcgctctcagggatgaaatatcagtaccagaaggcgatgaaaaagcatattcggatgagaaagtagaaatggcaaccacaaatgcatccagtaactttggctcaaatgaaagtgcaaaagacggcgaatcaatcggcgccttttcaaatccccatgaggctctgatgcagtcaaaattgagagaagaatcccagagtaaaaccatactaccatccgatgacctcagccagcaattagaaaccgaagaatccaaagttgaagaggctctaaaaagaataacctcacccccattaccaccgagggctgactgcatagaagaatctgcatctgctcttaaatcctcattgcctccagtgctagcaggaaataaaaatgatcaagccccccttgaccgaccacagttacctccgaggcaggtagttaatgcggaaactcttcatttgaaggcgccccatggtaatgcgactccctccaaatcaccaacgagtgctgtaggtaattcttcttcatcgacccctccaaccttaccaccacgccgtatagaagatcctttagacttggctgctcaaaaacatttcctagcgagtacatttaagagaaatatgctcttttataaaagtgaagataactctatcaaatgtgatttggataaaaatatactaaatttaaaagaagattcaaaaaaaattaacaacaatgaaattcctgaagaggttagttcattttggttaaaggttatcggcgactatcaaaatatcttaataaacgatatcgaaaccttacatttccaactatctcgaggtataccagccgcttatcgattggtagtctggcagttagtaagttatgcaaaatcgaaatcctttgaccctatatatgaaacgtatctaacggaaatggcaccttttgacgtccaggaatttgaaaatcagctaaaaatgatggacgaagttccctctgaatacgtaaaacgcataagtaatgtgttaaaggcttatttactttttgacccagagtgtgagttttctaccgacattgcttatattatcaatatgattcttgacgtttgcgaggaggaggcaaatgcatttggtctacttgtacgcctaatgaaagtttacggtttaagactcttgttcttaccaagtgcttctgagatcgatattctttgctataaatttgatagacttgtagaagaattttatcctgaaattcacaaccacatggttgaaaaaggcgtccgttcttccatgtttttgcccggtttcttcacgacactgtttcaaaagaaacttcccactgaaattcaaccacgtatcggtgatatggtatttttagaaggtattgactctattatgagaattttagccacacttttatctaattcccgagaccatctgttaaaaatgggttttgatgatatgctggagctattgaaatcaggtctgttagatgcttatattaagcagaatgatggtacacgcggtgacactcttctctcaaatgaatgtatggataaattactacaagactctatgatgaaagtagcaataaccccaaagactatgaagaaatattcttctgaatatgaggaaattcacagattggacaatgaaaaagaagtgcaatataagtctatcacggaaaaaaatttacatttacaaaagcatgttcgtaaattagaaaacgactacacatctttaaatagagagcatgtgacaattgcgaacgagttagtgaaaaatcggcttaatatcgagtctgtattaaatgaaaataatggttacaaacttcaaattttagatttgaagaaaaagttggattcagaaaaaaagaagcaagttttaggtgtatatgtgcccaatgatttaaagaaagatttggaagagacaatgaaaaagaatacccaagtaatggacgaaaatttgaaattgcaggataggatttcagaactagaaaggcttattgaagaaataaaaactgcaaacaaaaatggtacgttattcgaatattctaattctaaaaataatcctttgggagccggctggtcaggatttaaaaaggtttttaaatagttaaactgtgtatatcagctactgctccccttgaatgatacatgactaaatataatgataaatttatttcttgatttttgattatttcatattttgttgacatttgagagcttcaattgtataaagttgcaagataatatatgaggttagggaagccggataaagaaaatagagtactttaaaactgttcatggactaagaattcagtgacgatgaagtagtaaaggagagtgtttaggatataaataagaccgagaaattgttagtaagcattacttctagcagaaataatgaaccacaatcgtgacaatatatactcgagttagcagttaacagtaaccctttccataccattctaaactttgcaacagtaaatatcttggcgtttaacgttttattttattctacgtttctcaaatatcggctgtactcatgtggcacatcatgaaaagagccttcatatcaagaattcaagaattttaattacatcgtgacaacggtttcctaaacttttagtaaaaacaattaaatgtgcaattttgttgattatactgtggacaaattgagcttagtacgtttccttcttctctttctgcaattatatttaattaaataatctcgtattctcgcatccgggcacgctttgtgaaattcatttgagaaaccaaaaacagctgatcagctagagctattagaagttagtgcccaggggtatagaaaaatcagtttaaggaagaaaaagctcacagaagaatatgcaaaaaattttcagaccattccaattaacgagaggctttacctcttccgtaaaaaacttcaggcaatggagactgattgaaacaaggaagattgccaaacaaccgaactaccaagttggtgatgctaaacctttacatatgccaaaagaaagaaagaaatttccagattacaagtatggggaatctaatatcttcaaacagagtaacaaaggtctatatggtggatctttcgttcagtttggtaacaatatttctgaaagtaaagccaaaacgaggaagaagtggttgccaaatgttgtcaaaaaaggtctctggagtgagactctgaacagaaaaatcagtatcaaaatgaccgctaaagttttaaaaacaatcagtaaagaaggagggattgacaactatttaacaaaggaaaaatctgcaagaataaaagaattagggccgaccggatggaagcttcgttatagggttttaaaaagaaaagatgaaatagagaatcccccacataaggatgcacctatcatagaaatggctggtggtaaaaaggccaaaatttactatgatgaaatagtaaacggctcaccaagaaaaatatcagttggaagaagaagattgatgtcatttttatatcctttagagaaattggaatataggtcagtagggaaggacctgaactacaaaaaatttgtcgagttatttgccgacgttccagtcaaggatatcctagctagattagaggatcataaattcgacttatccaccatcaccgtataaaaggaagaaataaagaagataattgccattccgaaaatatcgttggttttcccctgtatataaaaaagcatatctgtttgtacatatgtaggtatgcacacattctgaacattattgatgcgtatatgcttgctacattaattggcaattcattttttagactgttttacacccgtacatttcacagtttttttttgaagttaaattccaactgaatggaagcctccgctcctatgaaatttatttgaaatcagagatttcaggatgttgaacagtatagtactgatttacaagtatcaaagaaacaagaaagacagcaaacacaataagaaatgaccgttaagacaggtatgtgagacataaacaaggaactgaacgggttatgacgattttcgaacttataaaggggtttaccccaaatacgagaagaacatgagtgcattgaaaacttaaaaggaaacaaaaacaagaatattatataattttgagtgattaatgaccaatggaaatagccagaggaaaaataccatttaatatgcatacacaggcttatctcttcactcctatctaaaaaactattgtgtttgaagatgaggtccattttacaaaaagaatagtattgcgaaaacgccttcaaatggaacattttagtagttgcaccattgtaagaattgccatggaaaacaatcacaaaaagatgctatacaaagccgtacattatacgtcacttcccgccgacacatatacacgtgtatatgtatgcctatttcacatgttactaactgaagacaacctgtgtccttatatttaggaattgctattggtttaaacaaaggtaagaaggtcactagcatgaccccagctccaaaaatctcttacaagaaaggtgctgcttccaacagaaccaagttcgtaagatctttggtcagagaaatcgctggtttgtctccatacgaaagaagattgattgatctaataagaaactctggtgaaaagagagctagaaaggtcgccaagaagagattgggttctttcaccagagccaaggctaaggtcgaagaaatgaacaacatcattgctgcttctcgtcgtcactaagtttctaaaaactgatttttgtaatatatatatagatatcatattttctttttaacttaggaaaaaataacaccaaaaaaaaaaccaccaatactttcacacatgagagggcctagagtaaagtaccactagccatgcaaaaagcccatgtactgagctgatagtcgttaccaaccctacattttttttctgaagcaatataagtgttacccgaaaagtatgaatattattttttcttcgtaccgttatatctttttctggtatataaagcggtgagtttagaagaagttcctgtggtgcaagaatctttattggtatttaaaaaatcttttcttttcctttttttggttttttgaaaaagggtaataatgtcttttataatagacacccagagtcacgattcgtcttggttttagagattctgtttcgacagtttttttaggcggtggacgtatatagtttacttaatcgtttactatacggtggagtactaatactatttcactgtcgtgctcgcggttgatcttagataaatatatttctttttcataaagaaagtgagtggatcttccctggaagtacgaataatgtacttatgattagattctcttcacgcacatacctttttttttttttcaattgctagttcatacatacgtagaaagaagggccaattggaagcctcaactgtcccctggtgtaagctttcgctgtttcatcttcaactcaagaagcgaaggtagcggacagcagggtgaccgtgaatcttttccattgtcattgtaaaattttgagcagcagatgtacagctgatctataactttagcgcatttagcatcatcgtactgatgtgatagaaggcaatctaaaattaatgtgaaaaaacgttagtgaaaagaaaaaaacgatcgaatcttttgaagttaatattacaaaccttggatggcgcaggcctccttctggcatggattagacatatttacctcttatttgaacaaatctcaacaactaaaaaaacgctcaatatcttggaaaaaaagaacagtaatattctgtctctccacaccctcttctgaactctcatatacaccccatgggtgaaaagtaatatccgtaaaagtctcgctaacggatgacgttaacaacgcacgcccgctccttgcgaaatttattgtggggacgtcgttcacgtgcaaaagtcgccaaatattagcgacgggcaacatcggaaaaactctgcgcccgcgattccgattgagatgtgtaatttgtagtattgaacgtgacaggaaacaaaaaatatcaaaacgctagcaaggtttaaggggaggggtgaagaacgaacgataggatactgcacaaatcagcaattaagaaacaatatacaaaaacccccaaagtggtcatgttaaggagggcatttttccgcatggaaacgaaacgtgggcatgacgtggaagcgatgatccgagcgcttctgctactgtggtgaccaccgtaccaaaggaggggtaataagaccctgtgccctttgccagcatacgtgttacccccctcaaaaagagctggctgttcgagctagctgctctttctgttgccattcccgtaccaagagcgccccgtagctcgattttcagcaccttggtggatatcaggggaattttaccgccgcaagcgatcagcgtagagtgcgcacagaaaacagacagaaatgactgaagcggatgaaaaaaaattttctggcgcggcccaatctccgcggaagagtcattccgtgaaatgaaaacaaaagacgcgcatagtaggagaaagattatgcagcttgatagcgggttatcataccagcgttaatgacaccttcaagtgggtaaagtaccctttgttatcgttttcttggctacgcggatagactaatttaattgatatatatgtagctagacacgttcataatttttatgctctagtgcatgtgcctcttactcattattgtcaaaaatttttgcatgtaatatttgttttccgtagtcattcagcactagcctgtttgttaatatatatagatagacaaactaatgacaaggagaattgaatttctcatataacacatacaataaaaccaagaaatgtcttcaaactatgccactcctttagacgatgaggtgtttcccttatcttttgccaattatcaatttaccgagcatgtgtcacttggtgagcattattcactcaatacttcggaagatgccaaatataataatttgaatggtcctttcgtggtaccgagagacaccgggaagttcgatttgaacacaagttctgcctcggacgagactgtgttctcgttagataaccctcaagaaaacaactacaaacaccaagccatgaataacgtccaggattgtcgcatggccgtcgcggccaaaactacccagtcgtgtgataaattgaccgatctttatgccaatgccgcccaacaaaactacagattgtggctgtcttcattttagaataacgattaaggaatgataatcaaaagaaaaaaacaatctacctacatatatatgcactcaacatacataaatacacacgcattattgtttctataaacttccaacagacaatattcccatacaaacatcaactaactgatttcctcttcatacgcgttcgcttcacgtgatgttccttttccattgaaaggagagctcatcacaagagttacaatgggagtggcggcgcaccgtctgctgacaagaataagtgtaagaccagctaccggaagaaaaaagaaaataaaatggatactctgtgtctccgaatgcccctatttgttgtatccattgattgttatcctgtcttcttctttctttagtttaaatctttagcgattcagatccaattgaacaaaaaaaaggctagatcaaaaataaggggtaaaacatcatcttgcggggctaacccagatcaaaagcggcaagccaagaaaacctgtttgataacactgtaatatatatatatatatatactatacgatcgtaccttggtatccaccgctttctcagcacctccaaatttctaaagtgcaactaaagagtcttgtcaagtattcttttactagtgttaagaccttgtattggtaagagatagcaagtctaaacagcaacaatgaacaagctaagagacaaatttgtagattctacagtagaagaagaaagattgcgtgaaaatcgaaatcatgagaaatactggtatcgttggggtccctacttgagtgaaagaagctgggcgacagtccgtgaagattattctttaaacggtgatgcttggagcaattttcctttcgaacatgccaatgcaagagtattccgttggggtgaagatggattatttggtgtctcagataacaaacaattggtgtgtatgaatgtcgctctgtggaacggtaaagatgaaagattgaaggaaaggttgttcgggttgactgggccacaagggaaccatggtgaggatgttaaggaattgtacttttacctggacaatactcccactcattcatatatgaaagctttatacaagtatccctttaaaaaggcctttccatacaaagaattggtgcaaaagaatggtgaaaggggatacgaggataaagaattcgaagtttacgatatagatgggctataccgtgatagtgaaaccggtgacaacccttatttcgatgttttttttgaaatggcaaaggatgacgaaaaccctagtgaactgaactttcggctaactatacataatcgaagtaaaatcgactctggtgagctctacatagctccccaacttttcttcagaaatacttgggcttttgacggtactagaacaaaggacaagcccttgcttgaaagagatgcagaagcagcgaacttaatcaatatgactcacaagaaatatggtaattgccaaatggtctttcagccatctccaggtgggttctcttccggtacaaacgaggaagaggaagataaagaggtagaagatatagatcctctgctgctatttaccgataatgagtccaatttagtaaaactatttaacgaagaaaagaatccttccgagtacacaaaggatgcttttgaagaatatcttgttcaaggcaaaaccgatgctgtaaatcctgaaaataaaggaacaaaggcctgcgcagtatatcacttcaaaaatattccgcccggagagtatgttactgtgagatacaaatttacaaatgacccaaaaaactctatctttaaggcacaaaacctggctgtcgtagatgaagatgagtttgatttgattttcgataacagagaggaggaagctgataacttctactggaggattacacctttgccaatcagtgatgaattaagaaaccttcaaagacaagctttttctggtttgctatggactaaacagttctacaattttacatatgatgcttggtataatggtgacgccaatgttaagcctcgccctccccctaatagagctaatggcaggaacaagaactggaagcacctttacatcgaagatatcttatcaatgcccgacaaatgggagtatccattttttgcttcatgggatactgcgtttcactgcattcctttagctatgattgatccagaatttgcaaaacggcaattggatttattaaccagagagtggtacatgcatcctaacggtcaaattccggcatacgaatggaacttcaatgacgtaaatccaccagtccatgcatgggctgtgtatcgtgttttcaagatcgaaagaaacatgtacaaccgtgaagatcgtacatttttagaacgagttttccagaagcttttgttaaattttacatggtgggtcaacagaaaggatactgaaggtaaaaatgtttttgagggcggatttttgggtcttgataatattggcgttttcaacagatcagaaccactacccactggcggtacgcttgaacaggctgattctacaggttggatggcctttttcagccttcaaatgctaaatattgcattagagctcgccaaagaaaacccggtttatgaagatattgcctctaaattttttgaacattttatcttaatcagtgactctatgtcctttgaatacgctactgatattacgggagagaaatgtaaagaagttatcaaacaaaacctatggaatgaagcagacaaattttattacgatgccatctcttggggtgaccacaaggtgcaactaccaataagatctctcgtgggattgatcccactatatgcttctatgactttagagcctagtatcataaaacaattccgcggtttcaagaagagggttgattggtttgtgaacaaccgtccagaaatctttgatagaaacattgcgtccatgtcaaaaaaaggagtgggagaaagactacttttatccctagttactaaggaaagattaacagccatactgtcacgtttgctggatgaaactgagtttttgtcaccatatggtattagatctctttccaaatatcatgagaagcacccattcgaaatgaatgtaaatggtgtcgaatatatggtcaaatatttgccgggcgaatcagactcgggtatgttcggcggtaattctaactggagagggcccatttggtttcctaccagctttttaataatggaagcattacaaaggttttacctgtactacggttccgacttcaaagtagagtgtcccgtaggttcaggagattatttgaatcttgctgaagttgccgaagaacttggatatcgtatgattcacttatttgttccagacgaaaacggggagcgcgccattcattatggtgatcactctaagtttctgtcttctgatccatatttcagggattatgtgccattttttgaatactttgacggtgatactggaagagggcttggcgcttcacaccaatgtggttggactgctcttgtggccaaatggataagtgatgtaggtatatcctgtgtaagactacctcgtacgccaagatcatctgtggcaacgaccgcttcaacagagagctctgagcaaggtcccaaaatgaagagaatggcaagacgtaagagtgcaaagtctttggtaaactacactgccaccattttggacttaaccgaagaagaaaagcgccatcataggatagggggcacccattctgggttgacaccacaaagcagcatttcaagtgacaaggctagacatttgatggaggaaatgaatgaagaggaaggtattcacgaaactgtggtacctgaagatcgtcacaactttgaaaccaagcttataggcaagctaaaagataaggtgaaaaatatgaaagtaactgacaaggctaaagatgaggatatagacccaatggacccaatgagtccgttgaataaggatgtgtcttgattaactgcggtgaaccttcaatatctgtacgtttgaaaaatatttccaacgatatacctctatattttgatctatagaatatttaattgcagtagttttttatcagtaaggtagcgttgatattactagtgaaggtaactctatagttccttgacatgttctttagattctagaggttttttattgaatttgttttcccaccttatttaaactttgagaacaaaactagcaaaatcaataatataaggactgcgataatggcatagcttatgaatttattagcaactagccttctagtcattgtttttagtgtctttatacttttatccacatatgaatccgcttgaaacaaggtctgtcttgcattttccaaagtttctctctgtgaccttaaatccatcattatttgtgaccctattccttcagtttcatttgctattctactggcatcttttagtctatctcccgatttctgtaagattgcatggttgctcaacaactgttgcctttggtcatcgtcaatattagatgcgttaagatctccaaaaagtctatcacgatcgcctgagtctactaaggattgcagtggtcgtttgatatcgctctgtatagtcttcttccattctcttaacttcgccttgtacgtagcacgttctgaggcatcgcctatgctgttattaacttctacatccatctgatctagcaggtcaaacaactcatcttgttgctgttctacgtgcttcagtgtagtatttctctgtgataacggttgtgagggggcctctgctaagctcgctttggcttgttctaaggttgttttgaagtcagattcgtatgatattaatagggaactcatagtaagccatgcagcaatgtaaagagtgcggttgattcgttttatacaacttaatgtaaagctttacacttttccaagaatagtaattgccctatatagcacgactactccactcctaactttcattgaaaattagacagtcatgtgatcagtaatatcgtccatagtgatatttgtttgtttaccatttttgttcttatttactctctaatatgattctagtatatgaaagataccactgtcgtagctcgtatcaaaataaaactagtcagtcgttgaccattgagcatatcgtccgagaataaggctttactgtattattttttgatatccacacgttattgagctcattcactgatcgacacatttaggcggcttttccgtttggctgaagcaactttgaaacacaactacgacattataattaagcgcctaaataagtgaattttgtgccatagggttggaccgtgtatatataagagctattcactattttaatatttgttttggcatttgaaactcgttgacataagctttattattaggatgaataactccaaaattcctaaactttcctttcatagtgatccaaacaacgtcactcgagactttccaaagacaaaacgacagaaggttcagaaaagagaaatggatatgatactaactcctaataacaacaagctaaatatattgcacagctctggatctggtatacggcgctgctacactgatgacacctccgctacgtatactaagaaactaacctttgggggggaccccaagattattgaaagggttaagaacaatgaacgtaaggttagaaaagacatagattcactactgaatgctatttctgaaattgaaaaggaatctgttcgtattcatgccagggaactacctgcaataacattagaattagatgcaaaagtcaaagcgtgcagggagctacaaaatgagattgatggactatcaacggagatggacttgaaggataatcaatgtgatcttcaaagaaagaatgttgagctatcatcaaaaaatatagtgtctatgcatgcagtaaaagtacaagagttcgaaaacgatttagaggaagagctatcgaatgccaaaagggagtggacgtataaattaatggaagtagaaaatttgaaacctgacgaaaggttaactgacgaaatgcgacagcttaaaacagaattcgaggaggtcaataggaaactattcattctacagaatgaaaatgagaacgagtgtaaaaactacaaaaaagaattggacaagaaattcgagatattcaagaaagttaagaacgatgctagaattgaattagatggggagcaagaaagactttcgaaagttttaaaagacctacaagacacccatggtgaactgaaagaaaatattaagacgtgtagagatgagtttaacgattttgaaaaaaggattggagaggcagaagtgaacttccatagcatggaacttgccgttgttcctctcaaaaagaagcttgcttctacatcacaagcattgacgcaagtgcaggaggagaagaagcaagtcgaaggagaagcaaacaattggaagaagaagtacgttaatgaactagaaaaggttcaacaggaattatacacacgacaaaatctggccacttcaattgaagaaatcaaaggatacacccgatgctttgcgtatgccaatgaacgacaaatgcctgatgaattccatatcaactatgtggatcggtgcatttgcgagaatagtggagaaaaacgggtacaagtatttgatagagtagttctcgaagaaatccataaggatcacaaacgcttatataacgaatgcattccgttcctggaaaaatacatcagcaagttaattaactgcagcattatagtggtttcgcagcaacccacagcaccaatgaaaaagactttgctaaaacagttaattgagcagtacggtgagaattataagatgacattgaacattttgcatcttgacggaagtattaaacacagtgacgttggattagataacccaacagaaattagagatctgtcacaagatgaagaatgcatgaacattttaactttagataccaagttgggaaaagatgaagagtcccattcaatgaatatatatatcggtagtatgtccacggtacagctgaatagagagcttgatgatgctccctcagtcctttcgcatattctcactaaaacaaagcagtgctttgtcttcaagattaacgctggtgaaaacatcgagaaggctctagccttagcgggaaagctgaaaagaacaataacattacctcagctagattaagaaggccagatcttgtgcgctacaatcacttcgtctcgttcccttacataaaaaacttacgtagctacattgtcgtgcgtggcatcaacctaattatcctagcaaaataaaagagaatgttacgggactaacaggcggatgtaaattactcacttaaacgcagccaaacatcatcgagaacttagggtagcgtgccacaaaatttgcatgaataaacttttgttttcctaattcgacagcattcccttgttcgcaacacttcactgataggaaatcgaatagcgcacactctcttctgggacataccccaatgcggtaaagccacgaaaacaccgcgcgtaaaggggtaaacaagtccattcctacaacctcttggagaaattctttacctactacaaccccgcgcctgatactttcagtattcatgacaactcgagccagatcccgctcgtgggcgtgttcattctgtgacgatccactagcgacttctttgttcagcctgcaagagacgcgttcaaggaagaattcgcgattttacttcttcgagggaatctcgcaccgcgttagttagtttccaaccttgaaagcatcggagacgcatttttggcgattttgctggattgagctgaatggtgccaggtcgaggctgggagggagactaactcgaaagtgacgaagactcgaaaattaaaaaaaaagatactgcagaaggcaagattgagaatggagtaaaggcagcgtgggtcccctgtggaaaccgcagttttcctgcgccaagtggtaccggtgcgagtgcagcaattaatctctcgatattttcttagtatctctttttatataagaatatattttggaattggtaatgcttatcttcaatagtttcttagttgaatgcacacttaagagcaaattggccaaggagttcttcgttcgctttaatttatttcctggttattgtcaatttattcatcccatctccccaggatagaagaaattagtgtaattttgctgacaatacattttaacgacgataacaataatagcaattaaataaaatagcactaccaccactccactgctcgttagctatttctgtaaaataaataaaaagatcatgaaccactcagaagtgaaaactgggttaattgtcactgcaaagcagacatattacccaattgaattgtccaatgcagaactactaactcattacgaaaccatacaggaatatcacgaggaaatctctcaaaatgtgctggtccaatcttccaagacaaaaccagacataaaattgatcgatcagcaaccggagatgaatcctcatcaaactagagaagccatagtaacatttttgtatcaactttcagtgatgactagagtaagtaatggtatcttcttccacgctgtcaggttctacgatcgctattgctctaagagagtagtgttaaaggaccaagctaaactagttgtaggcacctgcctttggttagcggccaaaacttggggagggtgcaaccatattataaacaacgtctccatccccacaggtggtaggttttatggtcccaatcctagagctcgtattccacgcctttctgaattggttcattattgcggcgggtccgatttattcgatgaatcaatgttcattcaaatggaaagacatatcttggatactctgaactgggacgtttatgagcccatgattaatgactacattttaaacgttgacgaaaattgtttgatacaatatgaactttacaaaaaccagttacaaaataacaatagcaacggcaaagaatggtcctgtaagagaaagtcacaatcttctgacgacagtgatgccacagtggaagaacatatcagtagttcaccgcaaagtactggactagatggcgatacaactaccatggatgaagatgaagaactaaattccaaaattaaattgataaatttgaaaagattcttaattgatctgagctgttggcaatacaacttgcttaaattcgaattatacgaaatatgcaatggtatgttttctataataaacaaattcactaatcaagatcaaggcccttttctctctatgcccattggtaatgatataaactcaaacactcaaacgcaggtattcagcattatcatcaatggcatagtcaattctcccccatctttagtcgaagtttataaggagcaatatggtatagtacctttcatattacaagtaaaagattataacttggaattacaaaagaaactgcaactggcctctacaatagacctaaccagaaaaattgctgtcaattctcgttactttgaccaaaatgcctcttcatcatcagtttcttctccaagcacatattcttcgggaaccaattatactccaatgcgaaacttcagtgcacaatcagacaacagtgttttcagtactaccaacattgaccattcatcgccgatcacccctcacatgtacacttttaatcagtttaaaaacgaaagtgcttgtgacagtgccataagcgtaagcagtctacctaatcaaacccaaaatggtaacatgccattatcaagcaattatcagaatatgatgctagaagaaaggaataaagagaatagaattcccaactcatcatccgctgaaataccacaacgtgccaaatttatgacgactggtatattccagaacacaggagaacttactaatagagcgtcttcgatatcgctatcgttaaggaaccacaatagctctcaactgtgaccattttctcatcaagcctacatatatacttaattaataacggaatactacgcttttccatcgtaagtaataatgacattcatacttgacattttaataccagataattttaatgcccacctacaaacatctagcctcaatattcttcacctgaaaccagctgaatagtaatataccaatattctttcaacgattgatataattatcatcatgaacggaaaagatgacgcgattttccagtatttttttcttcctttcgttctaacgtttgcggtaagcaaaggagagtagtaattagcaaacagttataaatagaaagcctctctaagattatagatatatagtcatactaaagcttgagatctcatctttttcgagaacctaccggcatattaaactgaagtaagacatcattctgaggaaaggatcggtattataaccattattatttgttgcactttattactatgtggtcgaaaaagtttacattaaaaaagctaatcttaggcgggtatttgtttgctcaaaaggtctattgtgaagacgaaagtaactctatatacggtacctggtcatctaaatcaaatcaagtgttcacgggaccggggttttatgatcccgtagatgaactattgatagaaccttcattgcccgggcttagctattcgttcactgaagatggttggtacgaagaagctacttaccaggtaagtggcaatcctcgtaacccaacttgccccatggcttcgttgatttatcagcatggtacatataacatttcagaaaacggtacgttagttctgaatcctattgaagttgacggtagacaactattcagcgacccatgcaatgatgacggagtttcgacttattctagatataaccaaacagaaactttcaaggaatatgccgtaggtatagatccttaccatggtatttacaccctgcaattgtaccaatatgatggtactccaatgcaaccactatatttggcttatagaccaccaatgatgcttccaacagaaactttgaacccaacatcgtcagcgaccagcactgacgacccatcctctaataagaaaagatcactgagaagtttagtgaggaggagcctggaaaacagacacaagacgaatgccattaaaagacaaaatacctcatttttaacctccaatgccatttggtatatttctgcgggtatgctaggtgtaggttcattattatttttagcattttaggcgcactacagggatacttattcaaccaatgggggaaagaggccccatgtggccttcaaataaatattaaaaactataaacatataaggcaaaacaactttatcaggcgagaaagagaagcaagaataggtgtaattttatgcacccaaggaattgattgtaatcatattattaaataaggtggatgaataaaagattttcaaaccagtttttccgagatagttaattatgtacgagtgacaaatgggatatcaatcaatgaacacaatcaaaacaccttattatgactttcttgttatattcttatatacataaccaacatttaaatgtcaatttcttcagtttctagcccgcagtctgtacatcttcttctttgaatttgataaccgtcttcatcaatacctccatcaactggatcactaaaatgatgaatatgggctttcccatgcttcttttctcttaatctattagtatattcttgagctcttgttttcagtcgcatttccttgattttcttttcgtattttttctcccttctgtgagcctttccttcttcacgacgttgccattcctcatctaaaccttcttctccaccccatttcttgaacgcaaaggcttccacttcacatctaacaaatagttgcattcttgcaaatgtccccgaatgagggttcggcttttctagtctatgaaagagatcctcatcattcaattcggggtctgttaaaaagtaatcttccttacattctgttttcgtcagtagtgcatacttttctggatgctccttagaacactgtttacaaacttgtaacttgaacacatcatgtagcacaggatccatctcaatattaatatgacattcaatacatttcggcgcctttgaaatatgctctggaggaggtgcattttcgtacagcattttccgttcaagttgttcctttttccagtcctgtagtgtcttctgctttttagatccaaactcagattcaaattcttggtcatcggtaaagtcagaatttggaagcttgtccttagggttgatataaccaccattcaagttctgcatggtggcaaaatcgtactcaatgtaatcttgtttccttatgctaggtctgattctatccgttggccttttgtcgagtaccgacgcatcccttttacttccatcaactactccgctaccataaagtgaagtagtgttagtgttagtgttagcaagcgcagacggttgtccattatgatttggcacatgtactgcggctgctgcattatcatcccgattgctgccactagtaactgcgagaggccgggtttttaaaggttcattcctactttctattcgattcaattggtcgctactcagtattcccctttttcttaaccgttctattgctaatttcctgttagcctcctgcacagctcatctcatcgttaaattgttagtaaaaagaaacccacggttaaaatacaaacacagaatcattttcacacatactagtttggccttttgttcgggagtcatagcgttacgttcgataccttcactacgaagatccaaactctttttctagttccgataaattccttaccttcttttcactttcctcttttctccctacaacttagcaaacgtcaaacatgctgtagatagagcttctatagaagtacagttattcaaacaaaaaaaaaaaaaaaaacaagggttgtggagtatgccactagcagtctgctatgttgattctgcttattatcaacgaagtatcccattatgatcttatgcaatgcacattcctgcccttacgctccagggcagaatcgaaccacggccctcgtataagccgcaaggaaaactaccggtgctatcgttctcgtttggatgattttcagtatggaagaatttggatagatctgcagcgccatggtatataagagaaagaagcggtaacgtttgacactgggttcagatctctcttgtcgctcaatcaaactaagactagcccagaccattatagccatgaagtttttcccactccttttgttgattggtgttgtaggctacattatgaacgtattgttcactacctggttgccaaccaattacatgttcgatccaaaaactttgaacgaaatatgtaactcggtgattagcaaacacaacgcagcagaaggtttatccactgaagacctgttacaggatgtcagagacgcacttgcctctcattacggggacgaatacatcaacaggtacgtcaaagaagaatgggtcttcaacaatgctggtggtgcgatgggccaaatgatcatcctacacgcttccgtatccgagtacttaattctattcggaaccgctgttggtactgaagggcacacaggtgttcactttgctgacgactattttaccatcttacatggtacgcaaatcgcagcattgccatatgccactgaagccgaagtttacactcctggtatgactcatcacttgaagaagggatacgccaagcaatacagcatgccaggtggttcctttgcccttgaattggctcaaggctggattccatgtatgttgccattcgggtttttggacactttctccagtactcttgatttatacactctatatagaactgtctacctgactgccagggacatgggtaagaacttgttgcaaaacaaaaagttctaagctgcccgacctcacgaaatcagtcatgcggtagtccattataatataactattattattattactattactattattattattattattattatctattgtttatattctctttagctttttatcacctacgacgacggatatattcggcgtttgcaaaaagtgaaaaaggcgtcttttggtggacatgaactcaatcttcaattctttgaaagcggtgtatgcgtataaggccttttaaccatcgtgcaaaacaataaaagactaccaataaccgacgtgaatcatgtctgcaccaactccattagcagaggcctctcaaattcccactatcccggccctttctcctttgactgcgaagcaatccaaggggaatttcttctcctcaaacccaatatctagctttgttgtggatacgtacaaacaattgcattctcacagacaatctttggagctggtcaatcccggtaccgtggaaaacctgaataaggaagtctcccgtgacgtgtttttgtctcagtattttttcaccgggctaagagctgatttgaataaggcattttccatgaatcctgcttttcaaacctcacacactttctctataggttcccaagcattgcctaagtacgcattctccgcattgtttgccaacgataacctatttgctcaaggtaatatcgacaacgatttatctgtttccggtagattaaactatggttgggataagaaaaacatttctaaggtcaacctacagatatcagatggccaaccaacaatgtgtcagttagaacaagactatcaggcttccgatttttctgtgaacgtaaagacattgaacccttcgttctctgagaagggcgaattcacaggtgttgctgttgcatcttttctacaaagtgttactcctcaattagctttaggtttagaaactttatactccagaactgacggtagcgctccaggtgatgctggtgtttcatacttgactcgttatgtctccaagaagcaagattggattttttcgggccaattgcaagccaacggtgctttaattgcatcgctatggagaaaagtagcacaaaatgtcgaggcaggtatcgaaactacattacaagctggtatggttcctattactgatccattgatgggcactccaattggtattcaacctactgtcgagggttctaccactattggtgctaagtatgaatacagacaatctgtatatcgtggtacattagattccaatggtaaggttgcatgttttctagaaagaaaagttctgccaactctgtccgttttattttgcggtgaaatcgatcatttcaagaacgataccaagattggttgcggtctacaatttgaaactgctggtaatcaagaattactaatgttacaacaaggtttagacgcagatggtaacccattgcaagctcttcctcaattgtgaaaatcttcccttggcttttttatggttgaataaataatcattgtttttatctttcctatgctttttttttattaatttgtgtaacgacttctccctccagcatacgctcccagacttttttgtttttgttttaatataaataattatgtatatacgtgggcaccaagttgagggggaattccttgtttatagttatgatacgtctcatatccttgtccttactttcacaatggtctaaaataaaagacaagaaaacaaaactgcaaatatattaaattctatttttcttttttagaagaagctattaataatagatcaaatgttccagccatttatattcacattgtatactccttcactttggtttacacctacattcatttgtgcagttatgctttgaacttcattcaaaggtcgccaagaccagatatggatctcctctgaaatcttctatgcctgtcctgcagatacgggggagagtcgataaaagggtatgaactatatcttttgttttgctgtttcgaatgaatacttggggctgctattggaatattcagtacaggagcggttcgtctgatagcatttttgaaagcttcatttatggagattgacacggcatcggtagggtcgctcggatagagaaagcttgcatttagattagagcaagtgttcgatatcacggagaagctattatctgtacatccttgttcgtattcttcatccagcaagtaattaaggtcgtcatcatcataattatcatcatcatcatcgttatcatcatcattattaattatttcagtattggggggctctatgtccgaagtaggcggcagtttgaatttatcgctcaaagactcattattcccaatagtagctccttcattaatatgcgaaaattggcaaattttgctaatgacgttttcaaaagctttcacactattttccaactctgattgggattgactaatcaaaggtagaaattcgatttcccagtaccgttccggattataaaagctaataaagtatttgaaacctgcgccatttagccttgttatttgtagtttgggtagtactggatgcacaatatcaccatgtcgtcctatcgataaatagtttactacatgcccatcatgactactagctttactagatttttgaaagggcgctatattttcctttaacttatcaaaccctgtacatatctgatatatttcaataggtccttttgccattaaagatgtaggttttaacttaatagtgttttgactgtcttgactttgcgtatcattgaagaatactccactactttcagtgacattatttgcggatacttgggaatttctacgaatgcaactgctattcggaatatcattatgaatgggaacgaatgaattcataacctgaacattgccataggtaaacaatgaaaatctctgagttgatattcttttcctttgtgttccggttttcttcgaggacgtgccattttttttggctttaacagatttatttgtatcgtttgagtgttgggtcgaatcctgtttcaactttttattgttgctaagtttaagtgactgttttaaagtttgaaacgtagattgaggtttcttttcttgttttgccgttaatctcacgctatttttctttgtttctccccttgataaaaccataccactttgtttaatttcctgagagttatcagacgaaaaatgtagaccttgtatccttcataggtgaaggaatacttcctccgtaataaggtaatttaaagttcatagttcattcactctttttgtttacatctccgttcttcgtgataagttcatagataataagagaacaaagtatttaacgcacatgtataaatattgtattaaaagggtacctttataaatatgagatccgagggacgtttattggaattatcttttaaatcgtctatatcacatattccagtatacataagttttaattttagaaaacgtttaaataaacaaagagaaaaaaaataagacacaaaaaataacagtatctttattcttgacattcataaaaatgcatgataatattggtttcatggggtagtacttgtattattaaaagaaaggaacaaaaaattcattgttcaaaagcttagagataaaaaaaaagaattatagacacaaaagaaaaacatgggttaacattaattgacattaataatagaaagtgtaataaaaggtcattttcttttaatcaactctctttcttccaaccaaatggtcagcaatgagtctggtagcttgccagtgaatgacctttggcattctcatggaaacttcagtttcatagtcatacaattgtctaatggagttgtaaacgacatgtgaacccttaacaccaacgacagcagcagtgtcagaaatggtcttgtcatcagcgttgaagttttcttcggcagcacgagcttcagcaatggcagcttggttgtctttgatgaagccgacagctttaatggccattctagtggctcttgttctatcaattggagatggcaaaccaccttgttgtacatgacctggataagctggcttagcgtcaaatctgccatcggcttcagcagtaataacttcagccaatttagtggctgataaagccttagaagcgtttgtactcttcaaaatcaatttaccaaatctacctctaccttctgccttttcaaaagattgagctaagtattcaatatcctcggacaattgctccaaagaaataccttcttctgggacataagagacttgagcaccaacagccaaagaagcgtaagtggccaaatagcctgagttaccaccttgacaatcgacaacgaaggctctacctctggttgaagaagcggattgtttaacaacatcacagtattccattagagcattcaaagcggtatcagaacccaaagagtattcagtacctggaacattgttagacaaagtagctggtatcaagaccattgggattctgaaagctggataactttctcttgctctctctaattgatgtaaagattcaaaagcttcgaaaccaccaacgatgatcaaaccatcaaattcgtacttttggaaatagtaagcaatcatacctagatctgcttcttctggagtgactctgttagtaccgatttcagaaccaccacgggattgccaacccaacatatccttccagttcaaagaacgaacactttcatgtcttgccaaaccagaccaaccattgtagatagcgtatggtctgtgaccttgggacatacagtaagtagccatcgagtagacggcagagttgataccaccagctggagcaccgacattaacaatggcaatcttcagtctcttgtcctttggtagctttggttcgttgtggtcagcagagttgatagccatgaaattgtttaaatgttcaatgaactcagtgtctcttaaagacatagctctcttgaaatccttagcttgaatggcttctgcaactgctttggtcaacttgacggattccattaatggtttacgaacaattttgttttcgttaacagcaatcaatggtgatggggtgtctggagtggattccaaaacggcattaacggcctcaagaccttgtaaagtagccaagatacggtcgtaagcaacagcagtaccacctctttgaacgtgacctaaggtagtaattcttgtatccaaacctaatctgtcaactagaactttgtggacgtcgcttggagaaattggggtcaagtcagcagcgatagcaccttctgcaacaacaacaatggtggttctcttaccccttgatctgtgcttggagacaatgtcacacatttgatcttgccattcgctggaagtggctggcttctctggaataaagatatagtcagcggaagtggcgataccagctaataaagctaaccaaccacagtttctacccataacttcaacaacgaaagctcttgagtgagagttggcagtggcttcaacgtaatcgatggccttacagattctgtccaaggcagagtaagcaccaatagtagcatccgtggtggacatatcgttatcaatagaaccgacagtaccgcaaatattcaaatgcttcattctttcgtattgttcgttggaaattctgtttgttttcaacaattcctcgatcaaagaaggccattctgatctaaacagatcagcaccagtcaaagaaccgtcaccaccacaaacgatcaaagcatcgacaccggcctcaatcaaatgttgggcacccaataatctaccttcgcgcttcttgaattccatacaacgggcagtaccaatgttggtaccaccttcagcagaccaaccacggacgtcttcccagtggaattccttgatgtattctggaccaccacgaaccaaaccttcataaccttccatgacaacaaaggcacgacaacctttgaagatagcggaacgcacgatggctctaacgttagagttcatacctggagcatcaccaccggaagtcatgacggcaattgccttttgaggcctgttcaatggctttggcagagatggataggtgtcggtggttttcatacggtaagccaaatcagtgtaagagtgaactttagaggaaagaccagactcagcagaagcttctggtgctggtggtggagttggcttggttgaaactgcgttcttagtagaagtaacaccaacaacgttacctaatgggtccaaagtgtacaactgcattggaaatagttctgttgggtagccttgaagaggagcgttcatagcatttagagtgtccttgactgccaagatgtcggaagtgttaaataccaaggattgggtggcatgtgatctccagtcttgagtcttggtaatactgttcaattccttcaaatgagcctcaacatttttattgattttttcatcaggacgtagaaggatcttcaaagagatggaatcgttagacaataaagtggagttttcatctggagaagagcggttttctaatgacaaaaacttggtgtaaaaatctatggcagctttataagattgaacggaatatgcagtgacggtacaataagaagtaccattcacaaaaggagtagtaacagtcattgcgtatggttagttcttggccaatgctaaactagtctctaaatctagttctattgttcaaatgaggtataagaaaggcttttaagcaagaagaaggaaaaaaaaaaaaaaaaaggaattttcttctttatgaaaccgaagataagaagcttttaatcaaggaagtaataaataaaggacaaaaagaagaaaaaaatattattgttttataaaatgcaagtaggaaaaataagaatgagagcggataaaaaaaaggcaggaaaaaaaacaacaacatgaagcgagagacttcattgcgatgtaataaatgaatggtagataaagaccggatggaaaaaaaggccgatttaacatggcaaacaaaagattacatacgtactgatcaaattgatcaattcaatatctctgttttcgtttttaacattcaactaccgtcatagcgttatacgtaggaaaaaaaaaccgcaatcacgtaaccgtggcttccactaatcggctcttgtgccgtcagattccggatgtacgggtggacgccatttggaacgaaaaaaagaaattgaaaaaagtggaagctagaaatcactgtcttaccctggacggtatcgtatataatgactccggtttttttttctctacccccttgcctcttaccccggattttacccaactttatcttaatcttcgttttccttttagcgtggagatggtaaacgctagcggtaacgttaacgttgcaaagggggtatgcgggactggctgaaacgggcgatgatacgatgcaacaaagcagcagagaatggctatgaatagtctttacacccacagtttttcgtgtggcagttactatatattagtaggatattcgatctatatagatggtagtacttacaatgctgttcttgggtttttgcggatcttctttcttttttgtagttttattttatgtcttacttcttatttccttcttacttcctcattggttaaggctcacgttgattgcaataacaaagaagtatatactgtagcatagctcttcatatcatttttgccgtgcattcgaagactatatatatatatgcatattgtctgacctttcgccttaaagtaaagaagacaacagaatataaccatgctgagtagcagtagcaatagacccatatctgcccatctaaccatccattacaaggctattcaggaggaagagggggaggatatgagaagcggtgccggaagtggtggccatcatgacgactattttctggagagtaacagatctcccactcctaataagaaacatgagttcattaaaacggtgctcaatatcaacgataacgactctgaattttcggaatcgtgctcaccaagagagaagttacataacgagggggcttgtaatacagacctgttcggggacttcatgtctaaaagacaacagaggctgtctaattctatgaacatttacgacctttatcagtgtgtacataacctgtcgcctagcaacaacaaccatcagttcatagcaagaaggttcagcgattctcatattccctccttgcatcaccgccagcagcaacagaaggtaacaacaaaaaactttgtacagcccacgaaggacattcaaaggatcgcctcgtacgctgcggattcagaccagagagtcaagtatttaccaaactatcatcagtctgctccttctactgcactgtctgcggctgaatcgaaagcggctgtaccaagaaagctccctgacagagacagtacacaaaattacgtactaaaattgcaactctcgtcacccaactctcaaccaatgtcaccaaggactcgcccgggctaccgcccctcttgctcttcttccaattgctcgtcatcttcctcatcatcagcatgttcatccgtttccatctcagatccgaacaacataacagcatacgaaacgaataatgtcaaccctcagttccccagtaaccagccattagatatttctagtccttgtgcaaggcatcaccatagaagaaattctattgctgtaaaatttgacaaggctttatataagaaaacaacaggatagttgattagaagactatagctaaataatcatttcattgggaaatgactatcacgatttaacgaatacccccttttctctttcttgccatttaatggtcgtcgctctgatatttgcacacatacgctcacgtacataggtacacgcagatgggacaggcgcataagtacgcgctaatacatgtattgatataagttatgtttttatttatcaaaatgatattgttgcatttttttttttaaatctcacgttatttttcatttatatacatacacttaagagaatgtcagattttctcttttcggccaccattatggtatctaagcggctatttaacttacttgttcctataccgaaactatctctttcgcttactgtccaccaacctagttagctcttcaaggacaatgtttccccttctgtcttcaaattttttcttaagctcatcgatcaacagcgagatctcaaactcttcaatgttcttgtcaatttttttcgaatttctttctatgaactccactactgctctgtcatcattaacatccagatcgttataccatgactgaactattttcaacaggtcgtcgtacttcattttcgttttgttatcacatgtttttttttgcagtcttttgatcacttgtccctcgttcaacctccttctcagtctccaatataaaaatctgcgtgactttttccattccaactcatttcggattactcctttaactagcatcctagtcgatctatcatgtaaatctgcaaactgtatgctgatttgattgtaaattggtatcaactgtctctctcttattttcaatctcttcgtaagatcattttgtttttccaaagataactttttttctgtcaacgttcttctcaaatgtccatatgtggagtctaatcgaatcatcgtctctatcattttctccttacggtattttatgctaactactccgtcaggttctaacacacctcccctagattcaacatcggcatacatttccatttgttcaggattaatagttggatctataacaacccatgatccgccccttaattcaccaaagggcggaatgtatatcagtatgggttgtttgtagtcaaccagagcgtcaacaataaaagacccgtactttagtacttcattgtacatatccctttgaccgccagaaaatcccctccaattggctaagataatcaatggtaattgctcaccatagttaaaatcatttatagtttgagctgttttgaacgcggaatttggataccacacctgtcctgcttctttaacggaaaactctgaagaatccagattagctgggtcagcggggattatttcttcgatagtcttagtttctaccgcaataacacccacgggaatacctccaagacgtgctcttccaactattacacctttggcccatccagataatgtctcaaaaaacgaatccttatcaaataggcctgactggaagttgttatttgagtcccatttaccctctatcaaccaccttgcctcatatggcacttgcttggcaggtttgaagtctacatccctatcccatctatccatagtttcaagaagtggaggactcatatctcttttcgccgggacatatgataaccatgtcattattttttcgatggctttcatatcattactggctgttaaatgcgctattccgtttttatacatgatttgggttccgccaatttgtaggttagatgtatagatatcggtacccaaaactttattaatcgccgatgcacccgtcagtatgataggcttatcctccacctgaatagtacgttgtcctagtctgaccagataggaacctataccaacggaccgacaagtaacagcagtaatagtgaaaatgtctctatacgctttcgaagtggcaccagcaattaaacccgagccctgtaaacattcaacacctaaaccctcttcgaatccgactattgctttaataatatatctctcttcaccgtataccatcttgtgttcaacaacaaccgaatttcctttcccagaatctttcagtagctgcatgtcttttggagctaagtataagtactggaaaccctttgttggatcagaggggtcattccatgctacacgaaatagagggatcagctcttcggctatacccaatttagctcctgaattcgccgccaagtatatcctcgggatccctctctctcttgcataatttgtgaccctatcaaaaaacaaatcttctctcggtccaaaagatccaatattgtaggtaatatcattagaaatcacgatcatgttacgcccttcaggatattcaggtgtctgaaccataatctcaaaagcaaccatccctatattattaaggcctggctccctgtttacttttattaaattaccgttttgttctatcaattcaacccaactaaaaaaactgtcattcagcttatgttttggaaaataccttttccactgttggattgcagcttgatgaaacagacctgggaaatcgtacacatatgttgtacccatgaattgagctttgtaccttttaggttgtagccaatccttgaccgagtaaggaagagagagagatttctggctataatggctctgctcactacacggttccaaaatcagattcccatttttccctatcttttcgtaatatgtctcaatttttaccacatacccagatttattagaaataagtaatctaagcggggctggcttctttgtttctaggcactcaacagagatgcaaatttctacatctgtgattctttcttgaaacaatctggtttcgtgagtctttagaattgtactcacaatttcctcgagacgatgtactggtatgttaagaactgtattgaaacttaaaaaaatatgattcaagtctgaatttgagatgtcaactgctcctagatgttctaacatataaaccacttgagcattgatttccgctttcaagttttcttcggttgttttttgatcattatacatgaaggaatttatgattttcctgacaaagaaccttttatctagcggcgtaaatttgctaataccttcaaaaatgcgtatactactatcgtatgtaggtagtgatctgattttatagttcgacatttttcctaactctaacggtgcttcataggatggatccatatttcttatttgagagatttcatcgtacgtagttccatcaaaggagtaaaatttaacagcgggcgcattcgcggcgataaatgcaaatgtaatacgattaaccttgagcttggatagacctctctcattttcatgaagtttaatttttaaagttttaattagatcattttcacttctgtaacgaataggagataaaatattaacaataagagagttctctccgctggaaagtctttcctcaggaatatgaatttgttcgtatacctcgtctaatgtcttttccagagattcaagcgcacgcatgttgacaagaagaccaaaactatttgctgagctcttacctgatgttgagggaggtttagaaagttttgtaaactcatcactctcaccatcagaattgactaaataatttcttaatgagctgaattgccatgacattagtaaatcaggcgctcctttatgaatcttaatactttttaattgataattgccgtaggcataccttgcataaatttcagatgctatactggaaagagccgtatcttgatggccaaaaaaaaagaacaaatcctgaagttgtatcagatttgaatgtattaaattaccaaaatccctcatacaggaatatatgttcctgctgtgaatgttttcggcaccagtatcctttatgtgcaattgcaggagagttttaatatgctcttttcttttctttatgggagggaaaatccctctgagtagcactgatcttgcctttacagcaacctctttagcccacttagattccaaacttgccaaatcatgtataacagccctgaattttaaagacatcttagaggaatcctggcacaatggctcgtattcatgcaatattgcagttactaacttgttctttgcgactacgttagcatgcgataaacttatgcacaaaatttttttcaagtttgtaaggtctttcctccgcagatttagtaagtttctttcttcatgtatatcatgattttcaaaaattttctcaacagcatagtactttttaatcaactttaaaaaaatttcacattcgtgattagctaaaccttcgctatacctttcactaattttaagaagtggctgtaaggcaacataaactacatgatcatttgtattttcttccaagtagcgcttcattaatttgtgcagttcctttgcaggaaaagaaacagatttcttgactagatttcccagcccctcattcaattgccttggtagtctattgcgtaccgtagaaatttgggaatcccattctgaataaggaagcctaccatctctcaatatttttatcaactcttttagagtagtttctattccagagttttcatgatatccattgagaatattttctaacctatttattaagactctgagcttatggtttggtcggctaccctctattagcggtggacctaaaacaggtaattctccgcggtataaagacgattcgttagctttggacggcgaatccaaagtcaattttgcgatgacatcaccagcctcaattatggaaccgggctgtcttagtaactcaattacaccatcacttttcgctactagtggcatctgcattttcattatttctatttctgcatattgctgtccagcaaaaacgtgatcaccacttcggaccaaatatttcaccaatttccccggagttggagagatcacttgagtgggattgagttcagcttctaaaaatatggtattggagtctatcgaaagtcttgtacctctgatatcgtccttccaataaactgtatggcatttaccgtcaacggagatcaacaagcagtcactggacaatttttgaacattaacttcacattgagacttattgatagaaagaataaattgttcttcagatgattgagcaacattgaacaagtatctattattatcgaaaatgaagtcaacaggaaacttcgttttaagaaaatctttaggtggaacttggcccctccgcaataattccaaatacttattcctcaccttttctgtgaaaacgtatgctttcattgcggcaccacagataatagcgagcgttggatctagtttgctatcggaagataaatttttcaaaatcaaatcatctaaccaaccagtcgatatgttattactctcaaagtcccgagtttctaatagctctatcaggtactctatgggggttttgaattctcctcggatggaaaaatcttttagagctaaaaccatgttttgctttgcatcttgcctatcgtttcctacagcaaaaatgtgcccaaattgggaatctgaaaatgagtgaatagcaccattatttcctactgagaagtaaccccaaacattggaagaagaacgaaaattgagctcatgtattttcccagtggagggcttgaaaccttcattaggatcttctgaagtgatcctgcatgaaatacaatggccttttggcgagggtctctttaaatttttaaaatcaatatacgaagttcccgttggatctaaaccataaagttttctgatatcacttatcatgtgcataggaatgcccatggcgatttgcagttgagtggcaggaaggtttacgccagatatcatttctgtcgttggatgctctacttgtagtctcggattcagttctaaaaagtaaaatttatcatcttttggtgaatataagtattcgacagtgcccgcagaaacataacctaccaattcacctagacgaattgctgcgcgttccatcctttgaaacgtttcaggcttggttattgtcactggtgcctcttctataatcttttggtgccgcctttgtatggaacagtctctcccaaacaatgtaatgttagtgccatattggtcagctaataactgtacctctaagtgacgagcatcagtgacaactttcataacaaacataggcgacccaggtgtctcattcactgcttggcgatataatgcaataaaatcatcctcattatctactcgcctaatgcccttacctccaccaccttcggatgccttaatcattacaggaaatcctattaatttagccttttctaaagcatcttcaggtgaggaacaacatccccttacatatacatcatccggcacagatacaaagttcgtcttgttatcgatatggatagtgtctatatgtgaaccagaccaagggatacacgggattttagcgctttgtgctacaatagtggaagaaatcttgtcacccaatgatctcatagcgcgtccaggaggaccaatgaatagtattttcctttgtgaactagctaacagctcaggaagacacggattttcagaagcatggccccatccagcccagaccgcatccacatccgtttgctctgccacgtccagtattaagtctatgttggcgtaattgttgttgttggtaccccctggtacctgcacatattggtctgccattctaatatactccgaatttgcgtgtaaatcatcaggtgtcgccattaccacgaattgaatgattttttcatcattgaacgtctcgtacgcccattttcttatagatctcatttctttcaccgcagcaataccattgtttgctattaagatctttgaaataacagtatgtccaccacgtaaatcaacaaaatctcttaatattgaaggttgggcactttccacagtatttagccctatgaactggggcggtaatcgagtatgtttatgaatattgcctcgatccacataattggaataccttcttctagatggaaaattcaaacctattcgagatgaatgcctatacgaatgggcaaaaatgcgttttctgtattcagggcgctgtcctttcaaccgtactatctggctgcccgttatattatagaatcgataaggatccaaatataacgcgagcttgtactgtcctattcgaatgcaagtaattgtgaatatggtaatgtaaaagtgagaatgtatccggcgagccccccagctttggccgtgtgtaattgtcttccctttctacccaagatgacttcttctttatcattcttcattattcatcttttcttgtcatctgccgcccacccattttagttaccctaacggaaacattgatgaatgatgctattattactgtcataagcaataaaaagagaggttcctactacttctcccgtggaaagctagcgatagccttgtactctatctcactttcagaatgcgtacacatttatgtttaaagaggcgttttgtgctagttttgtctcaacgtgtattttatcggttgtaattgtactgacaattttcgggcctcgtttggctgtcgcactgaaatcttcgacagggtatcgaagaacgatacaacgatatgcctataaaggttagttagccatgatattacttcctggttagctggtgcgcttcttagtcctaacttgcaaatttatatctacgtatagaaaactgtcaatatgtcattaccgttcttaacttctgcaccgggaaaggttattatttttggtgaacactctgctgtgtacaacaagcctgccgtcgctgctagtgtgtctgcgttgagaacctacctgctaataagcgagtcatctgcaccagatactattgaattggacttcccggacattagctttaatcataagtggtccatcaatgatttcaatgccatcaccgaggatcaagtaaactcccaaaaattggccaaggctcaacaagccaccgatggcttgtctcaggaactcgttagtcttttggatccgttgttagctcaactatccgaatccttccactaccatgcagcgttttgtttcctgtatatgtttgtttgcctatgcccccatgccaagaatattaagttttctttaaagtctactttacccatcggtgctgggttgggctcaagcgcctctatttctgtatcactggccttagctatggcctacttgggggggttaataggatctaatgacttggaaaagctgtcagaaaacgataagcatatagtgaatcaatgggccttcataggtgaaaagtgtattcacggtaccccttcaggaatagataacgctgtggccacttatggtaatgccctgctatttgaaaaagactcacataatggaacaataaacacaaacaattttaagttcttagatgatttcccagccattccaatgatcctaacctatactagaattccaaggtctacaaaagatcttgttgctcgcgttcgtgtgttggtcaccgagaaatttcctgaagttatgaagccaattctagatgccatgggtgaatgtgccctacaaggcttagagatcatgactaagttaagtaaatgtaaaggcaccgatgacgaggctgtagaaactaataatgaactgtatgaacaactattggaattgataagaataaatcatggactgcttgtctcaatcggtgtttctcatcctggattagaacttattaaaaatctgagcgatgatttgagaattggctccacaaaacttaccggtgctggtggcggcggttgctctttgactttgttacgaagagacattactcaagagcaaattgacagcttcaaaaagaaattgcaagatgattttagttacgagacatttgaaacagacttgggtgggactggctgctgtttgttaagcgcaaaaaatttgaataaagatcttaaaatcaaatccctagtattccaattatttgaaaataaaactaccacaaagcaacaaattgacgatctattattgccaggaaacacgaatttaccatggacttcataagctaatttgcgataggcattatttattagttgtttttaatcttaactgtgtatgaagttttatgtaataaagatagaaagagaaacaaaaaaaaatttttcgtagtatcaattcagctttcgaagacagaatgaaatttaagcagaccatagtatccttgatacattgactcataatcagttaaatagccattcaatccctttgagctatcaacttcatattcctccacaaggtccttccacccgcgaattttacgcagccgacttaattcatctcctgtaaattggaccaagggtttggtgccatactttaatggacctacattgacccaatgcagctctttacagtatttctttagtgcttcaatactggatagatattcaaacatattttccgcggtatctatgaaatatgcgctacaaatgataattttatcatagtctttggaaatgggagaatatcgtgtgaagtccccccatagtgggtccagattactgcggtggccaactttgctcaaatctgccgataaacttctcaactgattatcaaacactgtctggcatgaatattgttgtacaaaaggacgtatcttaacgtcatgcttatattcgagtgcaaataggttacatatgtacatcaaggctgataattcgatggagtccacctgtattttggggaaagtggtggcaagagtatgggataggccacccacaccagcccctggggtcacgataagaattttctctttcatgtccccggcactaatcacatgatggttgattctactaatgataaaattttgtaaaggatctctttccacactatagtaagagctgaaatcacgacacaaatgtgctaatgcttcatggaccacactttggctgcctcgagacgaaactattggaaatacgaagtcaggattcaattgaataaggtgaccatctttaatcttatagccgtgttccgcgcatatcttttcaatttcctctgtaaattcttcatcgtgttcgttggaatgaatcaatttccctaaagtgaactcaattatcttgtcaataactcttgcgttttctcggataccctcattatttttcattaatttggtgaagtagcctaatttttgcaactgatcttctgaaattccatttaattgtcttgctctccgaaataaaaggccattatagccttctcctcttgctcgatactcatgtaaacggattaaattccccgtaagatcaggaagagtgggaatctgataattaattttagaaagattcgattgatcggcagatattgatttctcaacatcaaccaattttaaggagggcgataaaacgctgactttttgggccagatttgattttcttgataatagcttttcaacatatgatacaaaccacctctgcaacggcttattttgccttagcagtgtcatcaggactaccacaagggctagaattatatttgatgccagtgagctaaccattggcgctcctcaacttcgtatatcaatatttttacctcttctatttcctgaaaaatttgttaattgtacagcatcgtttacgtttttttttttttacgggtcttcttacctaaccccgaaaagtattgtggatcttaaaagggtctcaattatttgaagttcgataaaaaccaactactttgttattttaaaactgtattatacaaacgctggtaaacttccagagacgatatgcgtctaaaagaattgttacctaattttttgattgttcatcaagaggtccctgaggatcctattgcattcaagtccaccgataaacgagagaatgaaaataaagagatcaccatccctgagctaatagatactaaagttcctgaattagctgacggtgctactgacactttatatggtttactggtcaatggccatttacaaactgcatatggttcctttagacactttgacaatatatacaaagttcaatataaaagaatgataatcaaatacccacatgggggagaagggactgtggattttgctgtaaatggtagaagtaccaaaagaagaaaagtggaaaaagaatacgtgccgacaagtcaaccggtatttaacggaaacttgaaacgaagatattcgtactattcccctgatgatcctaaattgaactcagacgatgctaagcctatgcttattattctccatggattaacagggggttcgagggaaagctacgtgagggcaattgttcatgaaatcaccacgaagtatgactttgaagcatgcgtgtttaatgctagaggatgttgttattctgcaattacaacgccgctattatacaacggtggttggaccaatgatataagatattgtgttaatgacttgaggaaaagatttccgaatagaaagttttatatgatgggattttcgttaggcgcatctataatgacaaattacttgggagaagagtcagatcgtactaaaatcgaatgtgctatttccgtgagtaatccatttgacctgtacaactctgcatattttattaacagtacaccaatggggtcacgattttattcacctgctttgggtcacaacttactacgcatggttcgaaaccatctctctactctggaagaaaaccctgatttcaaagatgttatcgagaagcatttaaaaaagattcgcactgtgaggcaatttgataacttgttgacaggcccaatgtttggatataaaaatgcagaggagtattacaagaatgcttcatcatataaaagaatacccgggatcagaactccttttatagctttgcatgctcaggatgacccaattgtcggaggtgatcttcctatagaccaaataaaatccaatccatacactttgcttctagaaacttcgacgggggggcatgttggatggttcaaagacagatccggcagaaggtggtacgcagaacccttatgcagatttttgaaaatatttcacgacgaaattactgtaaagggcttaaaacctgacttggaaaatgttcaactcccagatcctaattgcgaacccatagccacaacctttcgcgcgaattagtttgtaaataagtcaactttttagatgtgtaacctgataatttttttttttgatgttcgacatcattatttctgaatgaaaacgtgaaaagcttcgccaaacttaaaatggaaaatttcgaatggaacaaaatataatcgatgcgatgaattaaaaccttggaagaagagggttaattgttaaaattacatatataattggcagacaagaataaaaaatgcatgaagtagtaacgatatcggtttcgcagagagcaaaccatttgactactcaattcttcaatatacaagagggctatttacaattgtctaaagaacaacaagtcaatgactccaaaatttttctgaattcggttgtagataaagtttcaaaaacaatttcatatgcaccacgtgccttactttgggatgcccgtacaggtaatggttcactaggaacatatcaatattcagaaagccaagactatcatttcggcaatgaagacaaattcaaggagcaaacagttataaagactcatccaagaatacctaaatccgaatatcagagttctctagatgcaggagcaccgctgccttgtttgaacagagaaaatacgatgtattggtctgactattctaaacttatctatggtccttcaagtttcaatattttgagaaattggtaccatgacactgaaaatccaaaccaacctgactttcaaaacttgggggagcgaaagtttgacaggtattccattggttatgacgaatttaccgaaaattacttgcaagagttttttgatggaaatttgcatagagaattggaaaaatgtgacaccctgcaaggcttcaatcttgtaagtgatatggagagtggatggggcgggttttctagtgctctactggtggaattaaggaatgaattacctaaaaaggcggtcttttcatggggacacaatgaagatgatccattcacagatgacttccctatgaaaagactttcaaagaaatggctcccgatcatttcgaacaaattaagaagcacaataaatatgatgcaagaatccgatctttacttcccattgtatgctgctcctggactaactaattgggaaactgctggaaagagctgtaggatatttgattctataaatgcgacaatttcccaaagcaatcttgaacaaagaaagacaatggattatctaacaactgccattaccttaggatattcgtcgcgaaatatggtcactggcatggttatcggtgacaccgattactcattctgttctcgagtacttcctttcaagaatagccacaaaccaaattctactcacatattttcaaaaagtttcattgatagaggaaatcaaacgcataaacatcattccgaacctgattcacggagtaagatgattgaaatgtatacacacaggtattttccatctgatacgataccgacagaattttccaatgatcgtgaatttgttttggaattagaatcatctgaaaaaaatcgagatatattcaaacattggaatgagtttgtggtaaggtacttcaaaaatgatagtgacagagaagaattgaaaaatgaactttccgattacgcctcagcgtacgaatctgggtggtatgaagacgaagattctggtgatgacgatatgtgataagcagtttgcagctacgtatttcctttctccagttgaggcaaacaggacttcttccatctttttcgaagtttttacttcgccatttgatctatatctacgtaaattacattaattagaaagtcatgctatatcactcttgcccttgaaagcatccacagctgtccgtcaaaaacttaatttctcaagtggaggagaaaattttacctcttgaacttaaagaatgtaaatcttcatttgcgtctttaaagtcatcgttttgattttcaccagttgctgttttttgcaaaaaggattttctatttccaatgctactgcgatcagaaagactagatattggtgcaagtcgcagagaatttgatctagcaacgtcgattttatccaagccaacaatattctcctcatcaggatctttgattttattcgcgtcatctgaaaaagttttcaattcatttaataaaaatgtgatattagtgacacgagatttcactgattgagaaccccgaaaagagccatctcttttcatattatttggaatattcttttcattcatagtttttttcaaatcgctaacttttggtgcggtggctctcattgttttccatgatcttgcgtcctcagcaacaaacctatagatactaccttttgcattagcatcagaaattacagtatcgttagcttcttctatattgtcatctatgctgttgtcgaatttattttgcttggccgcaaaatcgttgttatcatacactgctttcccatttgaaaaaatagcattagggacattcttgtactccagaggtgtagtacgaacttgagagtccgacagtaaatcagaagtagaaatttgattatcacgagacaataaaatctgcgcccccttcttgctgtatttatttgatccagtatcagaatagtatgacaataaatcttccttggtaaacaaagttctagtttgcattttgtactcagtttgtgacttgtagtcattgagttttaaaaagttagctgcttgtaaatggtacgaataataggtatactcaggctcagaaacgttctctagaaaataattcaaaccggataatagtgccatttttccatacttgtcaaagatctcttccatcatttctttttgcacaccatgtgaatccagttcacgtaataatgagtacagttttgaaaagagaatgctgcttggaacctcagtttcaacaatgttaaataaacatataatgtggtttttcatgtaatgcgccaagtcgatgaataattccaaactgatacttggctgcgtaatatgttcaacgaggaaatcaatatcttccacaactgcattcttttcaacatccttgacggtgtcacttttcaatttcaatagtagttcatataacatatctgaggtctgttcagcgtaataagttttatggttaaggtctgtcatggtgatacaagactgtgccacaacttctttattagttgcatttttcaactggaaatttaaaagctttctcattatatcaagaacactcaaccccactatactgacatctgaaacaagtaatgacgacatcaatttcaaggaaacaattggatttacatttttatccttgtcgcttagttgtctgaccaaaagaagtataacaatatatcgtaactgaacaggtataccattgcatacaaactctagcagttccttattaggtgtactttgcagacagcgcaacagagtacgaatagacaaattcaatttgtctgtctcagttgtgttaaaataggattgcaatgcttttactgaaaggtcatgattatcttcggcggccttatctaacccaattgtacgagtttgtgttcgacttagcctttttcctaaattgctctccagagctgcttccagcgacaaagttttaaatttcggatttctctcttggaactttgaaatagtataggcaacagacttggaaacaaagtggtttagttgtgggttgcttgaaacactatttgtgtttgatatatcaatacagcatttcagaagcatgtcatcattatgaattctttcagtaactattttaaaaaaaagatcaacaaagttctggtataactggacgaattccatgtcaccgttacacaagacgtcgtccaagttctggcatatactactaaatgccagttctattaattcaacaacagatacatcattgttaaaattgttgttggaaagaactttgttcataatgtacaaaaaatctttaacaaatacattcaaattctccttacaatgcaacacaattttgttcattaaatccaatgtaacggctatgttccctatgcgccgatggttcaagtcggaagtggaacgcttaatcaggtaagtgctaactttctccaatttactacgcctcgagttaacgtaatatagcaaatatgaagtttccgaagatttaggcttcttatctgtggtccttcccgtaggataacattgattgaccagtttctgatgttttggtgtgaacatcatccgcatagacaactgcatcgcaaaccactttcagaacaattgaaaatgaacgaaagatgaataatagagcgaatgatctgggttcaatatacagtctgccactgaattaatactactccaatagcggggttgctcacaatactttcaatttatcctggctgcctggctttttcaacaaaaccattaccttcctagtagttcgaacaaaattttcttcctcttcctttggccggggttgaagtttaatgaaaaattaatgctatgaactattatgacaaaaaagcatatgcgactcaggaagatagtaaagaaaaaaagcaaaacatttctaagaggactatactagcatttcaagatgccccccgtaccaatatacgtgaaaggcggtgtatggaccaatgtggaggatcagattcttaaagcggctgtacaaaaatacggaactcatcagtggagcaaagtagcatcccttttgcagaaaaagactgccaggcagagtgaattaaggtggaatgaatatttaaatccaaagttgaattttacagagttctcgaaggaggaggatgcccaacttctagatcttgcaagagagctgcctaatcagtggaggaccatagctgatatgatggccaggcctgcacaggtctgcgtcgaaagatataataggctattagaaagtgaagacagtggaggggctgcgttaagtacaggagttactgacttgaaagccggggatattaatcctaacgctgaaactcaaatggctagaccagataatggtgatttggaagatgaggaaaaggaaatgcttgctgaagctagggctcgtctgttaaatacccaaggtaagaaggctacaagaaagattagagagcggatgctcgaagaatcaaaacgcattgctgaactacaaaagaggcgtgagctaaagcaagcaggaattaatgttgccattaagaaaccgaaaaaaaaatacggcaccgacattgattacaatgaagatatagtatatgaacaagctcccatgccaggtatatatgacacgtccactgaagaccgccagataaaaaagaagtttgagcagtttgagagaaaagtcaacagaaaaggtttggatggtaataaggataagccaagtaaaaaaaataaggacaaaaaaagaaaacacgatgagaacgaacacgttgagaaagcagcactgggtgaatctactacattgacggatgagtataaaaaaccaaaacttatactatctgcaccaggaacgaaacagggaaaagtcacctataaaaaaaagctagaaagcaaaagacaaaaactaatcgaggcacaagcaactggcactgtgttgacaccaaaagaactactaccccacgactccggccaagaagataatgaacgcagtaatataaagagtggtaaacagctaaaatcacgcatacgaaaatttttagtgcaaatgttcgcatctttgcctagtcccaagaacgatttcgaaattgtattaagtgaagacgagaaagaagaagatgcagagatagcggaatacgagaaagaatttgaaaatgaaagagcgatgaatgaagaggacaacttcatagaaccaccatctcaaaatgatgcgccacgcgtctcattagtagccgttccattagcttactcaacgctacccataccagaattcaaaaacaatccgcagtccgcgattgacaataagtacaacttgctagtcgcgaacgccataaacaaagaacctcacatggtaccagaagatacggtagattttctcaaagaggtggagtcgcgtatgcagcatataacccaagggcgcacttccatgaaaatacaattcaaaacagcaatgcccccaactgaggttcttctggaatcgatccaatcaaaagtggagtctattgaacagttacagcgtaaactacaacatgtgcaaccactggaacaacagaataacgagatgtgcagtaccctctgccatcacagcctgcccgctttgattgaagggcaacgcaagtactacgctgattactacgcctaccgacaagagatacgatcgcttgagggtcgtagaaagcgtcttcaagccatgctaaattcttcttcttccatatagcattagtatagcattaatataacttttatgaactaggacatagaggacttgtgacaacgcattacccggagttagaacgttttcttgccaagttggccacatcggcaaaccagcgatggtaataagatgtagtactgacaaaacatggtggataggccagaagagcgtgcattggctggcgaaaagatcgaggacaatgattccaaaattatatatacatttgatactatctttattgttgttgccgctaattttggcgcaggattattatgcaatactagagatagacaaagatgccactgagaaggaaatcaaatcagcgtacagacaattgtctaagaagtaccatccggataaaaatgctgggagcgaagaagcccatcaaaaattcattgaagtcggcgaggcatacgatgtattgagcgatcctgaaaagaaaaagatttatgaccagtttggtgcagatgctgtaaagaatggcggtggcggtggcggtccaggaggccctggcgcaggtggattccacgatccgtttgacatattcgaacggatgtttcaaggaggtcatggaggtcctggcggcggatttggccagagacagaggcagcgtggtccaatgatcaaggtccaggaaaaactatctttaaagcagttttattccgggtcctcgatagaatttactttaaacctaaacgatgaatgtgatgcatgccatggtagtggctctgcagatggtaagctggcccaatgtcccgattgtcaaggtcgtggggttataatacaagtgctgcgcatgggtattatgacgcagcagattcaacagatgtgtggtaggtgtggtggtacgggacaaattatcaaaaatgaatgcaaaacatgtcacggcaaaaaagttaccaaaaagaacaagttcttccacgttgacgttccaccaggcgcaccaagaaactacatggacacaagagtcggcgaggctgaaaaagggcctgactttgacgccggtgacttggtcatagaattcaaggaaaaggatactgagaacatgggttacagaagaagaggcgacaatctgtacagaacagaagttctttctgctgcggaagcgctatacggcggatggcaaagaacgatagaattccttgatgagaacaagcccgttaagttatctagacccgctcatgtagttgtctccaatggcgaagttgaagtcgtgaagggattcggcatgcccaagggtagcaagggttacggtgatttgtacatagactacgtcgttgtcatgccaaagactttcaaatctgggcaaaatatgctcaaagatgagttgtagacagataatcctacgtacgcacacatgcatatatagatagacaactggtcttctgcatccggtaataggcattggctttaatactaataaaagcaagaaaaaagcgacaccagtaaatttcagacatcttcgagaatttttttcgcgcgctttctatcaaaaaaaaatgaaaaataaataaataaacaaaggaaaataaacaacaacatatactgttcttatataacatagaacatctattgtttccgtgttttgctctttcctgcttttgttcgatcaaagatcacaggtctcaaagtcgtttagctagcgatgcaactatctaaaagtatactactggcagcattagctgctacaccatctctggtgaatgccatgctccccatccatatcaagaattataggttcattaagccatcctctgccacaaatagcgaatccgataacgaagttttttttgtgaaaggtgtcgattatcagcctggtgggtcgtctggttacgatgctgactctgatacagatattctttctgaccctgaagtgtgtgccagagacgcctacgctttccaacaacttggtgtcaacacagtgagaatttactccctgaaccctgacctaaatcatgacaagtgcatgactatcttcaacaatgctggtatctacgccattttggatgttaatagtggtaattacggggagagtttgaaccgtgctgacccatctggaacatatgactctttgtatttgtcaagagtcttcaaatttattgacgctttcaagaactaccctaacgtgctaggattcttttctggcaacgaagtcataaatgatcaaagcgactatgcaaaaattgatcctccatacatccgcgctgttcaaagagatatgaaacagtatatttcaaaacatgcgaacagaagcatcccagtcggatattctgctgctgacaatactgatttgaggttagcaaccttcaagtacttgcagtgtaattcgttggatggaaacaaagtcaatgatgatttggacatatctaaatctgatttctttggcctaaatacttatgaatggtgctctggcacttctagttgggaatcttctggctatgacaagttaaactcaactttcgaagatgctgttattccgttgatattttctgagtatggttgcaacaaaaatacaccaagaacttttgacgaagtctctgagggtttgtatggtggtttaaagaacgtcttctctggtgggttggtatacgaatacactgaagaagctaataattacggtttggttaagcttgatgatagcggttctttaacttataaggatgattttgttaatttagaatcacaattgaagaacgtttcattgccaacaacaaaagaaagcgaaatatcttctgactctatctacaagtgcgataacagtgccatcaccaatatttattctggctttggaacgaacaatttcactttgccttctcaaccagcagaaattgccaatatgattgaatacggtgttaatggcaccaacaccggtaagatattgactgattatgctgttccaactacttttaactatacaattaaaaacaataaagatgataccatttcagctactatttcatacgacaaagctaactcactgaacgaactagacgtcacagccacaacggtcgcaaagtcagcttccacatcacaatcatcttctcgctccttaacttcaagcaccagtccatcttcaagcactggctcatcttcaagcaccggttcatcttcagcttcaagcagctccaaaagtaaaggcgtcggaaatattgttaatgtttcctttagtcagtctggataccttgcattatttgcaggtctgatttctgctctactctgagctgctcatgtatttttttgaaacatccatggacttgttttcgttttcaaccgttttatttttttgtgttcttttatcttaacatatgtaaaacaatttatatgtttttaaatagtaaacttttcatcaaaaacgcttaggtatcacacccatcatccttcaccaggacaaccattgggtgcaaaaaataaaatcaaaaaatgtcgagtatggattcaaaaaccgctaaagataaaagaaaggagaatcagcataatcttttgttgttacttcagaatattatactaggtgttacaaatttactttggtaaaaaaaaaaaaaaaaattgcaaaaaaactactgaaaaataaacaactgagcagagaactaaagtatgcaaaaaagaggttaaacagaaaaaaaagtaaaaggcaagggcaaaataaaggtataaaggtaatcaatgtcttttatgatcgcggacttcttcaaaccatccggggatatcggaaccactcccgtacaactctctatcaggtacccgaatctcttccatacccaaggtatccttgagccatggatggttaaccaagccacctgcatcagctcttttccttgggtctagctgtaacataggcgacaaaaaatcagatatttccttggcttcgtccttagaaaacttatatttttcagttaaaacatcttctaagggccaaaatttcaatttcgagatatttcttaaaagccctcttgaattgaagaaagttcttgtatatttgccgttcctcaaaaggtatgatggtaattctcccaataactcgatgatttgtgcaatatggtcatcatccttagtgtaggaatgaccttcgtccggttcgaaaagaaaatctccggtaatcaattcaaaaattagacaagcagtagaccatatatctgcaccacaaccccaaggggcgcctagtaacacctctggtgatctgtattctcttgtctgtatagaattcgtgtaatgttcgtcataccaacaagcattacctaaatcagcaatcttgatctgaatcaaattttctggggagttgatatcggtactgacgtttgaatttgaatccatagtattagaaatatatggaccatttgtatcggagctttgtgatatattggaaatatcaaatgtagataaagagtctgccagctgctcttcatgcaaaggtgtgttcattatgtcctcgttattattgttgttactgttgttattgttgttatttttatttttactattatcattattgttgttatcattactgtcttcatttatgaacatcctggtcacagaatgtggtactgaatttaagaaactattgttgctattcttaatgcctatgccattattaatactgttattattgatggaagatggaatgttcctattcccagatacggaggaaaagctattgtgactactaccacaaaagtgcgccctcatttcaaagaaatttgatgaactaattggggaaggtaatggttgcgaccctgtgataattgtatgacgtctaggtcttctaaagcatctttttgacaagtccttctctatagaacgagatttggaatttgagcttgagccgcagggcatacttgtttggcattctgcccatttctcatcactgctatcgttcgcggtaatatcagaagaccgcgaaacgtgcctctgcaacctttttgcctctctcttctgtttatccagtgcctcgaccatttgaacgataccctcaacatctccaatctccatcaacacgttttctggtttaatatctgtgtgtataataccacaccgcctatgcatgtaatcaagaccaagcagtaactgcttcgatatttgcttgacataaatcaatggaatgcccctatgttcatacttctttatcaaagccagtaagttctcgccgaggacttcaaataccataaccacatggacgccattggggcccttatggttgaaatgatctagcaatttcaaaatatgattagcccccatggaatcctcctttgtattatcggcgtcattcactctttgcaaaagcttaatttcgtcttcagcagcttctgtgtaaactttgtcgccccgaacaatcttcatagcaacgtgagtgttgtttaccatatcctttgccaaccaaacggtggagaagtggccccatcccagctttcttactaaaatgtagcgtgcatccttatagggctcgcccttaaaggcagggtggtacccacccggcctgtaatctttcaaagactcttcgttcctttcgtcacatgatgagatagaggaatctgaatccaaatctgagtctgattgtggccccgaatccgattggatggacacatgcgattcaacgccgctatctggttttttcttaatgctctttgtagaaaaatcttctgtcttcgaggaagtatcctcttgtacagtaccgttggcactagaggatgacttggaagtctgcaaggccaaagacagtttagacttcgttggagcaggcgccttcttcatcatgttataatccctttgaaagaaattcttcttcgcttcctgcgagcttgttgcttcctcacatgaaatgctcgcatccgtactagtgtcagccaaatgagcgcttttagtcacaaacccaggatagttaattgatgaacccattaatgtctacacttcttctttactctatctcttcaacctcaaaagggggtgtctatttataccaaaaaacacaattatttctcagcgccaggtgatctaacaattttgaatcagttttccaatctctattaacttgccagctacaaatagatccctctatatcctgtgacttctctatagctctttcatagcccacactcattgtttattctctttcaaataaataacgacgataagatttagaaaaatagaaaaagaaattagaaaaaaatccggaaataatataggctcgtccgtaacgatttaatatcacgtggatagtgatataattatgaggtgttgccaaatagaacctttaattatgtttaacagcgaaaaaacaaggttgtcaagtagccgactcatttcttcgtgacgttggtgacaggaatatgctttcatcctctcgctcccctacaatggcttcggttcccgacattttgactcttttcatgccgtcatttctttttcttgcttgcaggaaatgaaaattttttttttctttggcgatgagcatcgagaaaaaatatttcttttttttatcattttttcagtttcattttcatttcacagttataaaacattagttgagttatagtttcggtcacggtagtctctaattagcttgcgttcgttgtagtttaacttccctgggtcatttggtaggtaatatctatattctaaaataaactaacgacatcaatattcacaatggctgccggtgaacaagtttctaacatgtttgacactatcttagtgttagactttggttctcaatactctcatttgattaccagaagattaagagagtttaacatctatgctgagatgttgccatgcactcagaagatctctgagttgggctggactccaaagggtgtcattctttctggtggtccatattccgtatacgctgaagacgctccacacgtagaccatgctatctttgatttgaacgttccaatcctgggtatctgttacggtatgcaagaattggcttggattaatggtaaacaagttggtcgtggtgacaagagagagtacggtcctgccactttgaaggtgattgacgattccaactctctattcaaaggtatgaacgactctactgtctggatgtctcacggtgataaattgcacggcttgccaactggttacaagaccattgccacctccgataactccccatactgtggtattgtccacgaaactaagccaatctatggtattcaattccacccagaagttacacattctacccaaggtaagactcttttgaaaaacttcgccgttgatttgtgtcacgctaagcaaaactggactatggaaaactttatcgacactgaaataaacagaatcagaaaactggtcggtccaactgctgaagtcattggtgctgtttccggtggtgttgattctactgttgcatccaaattgatgacagaagccatcggtgatagattccatgccatcttggtcgataacggtgttttgagattaaatgaagctgctaacgttaaaaagacccttgtcgaaggtttaggtatcaacttgatggttgtcgatgcttccgaagaatttttaagtaaattgaagggtgtcactgacccagaaaagaagagaaagattattggtaacacatttatccacgtctttgaaagagaagctgaaaaaattaagccaaaagatggtaaggagattcaattcctgttacaaggtactctttatccagatgtcatcgaatccatttctttcaaaggtccttctcaaaccattaaaactcatcacaacgtcggtggtttactagagaacatgaaattaaagctaattgaaccattgagagaactgttcaaagacgaagtcaggcatctaggtgaattattaggaatccctcatgatctagtctggagacaccctttccctggtccaggtattgctattcgtgttctaggtgaagttactaaggaacaagtcgaaatagcaagaaaagctgacaacatttacattgaagaaatcaagaaggccggcttatacaaccaaatttcccaagcctttgcctgtttgttgcccgttaaatccgttggtgttatgggtgaccaaagaacctatgatcaagttattgctttgagggccattgaaactactgatttcatgactgctgactggttcccattcgaacacagtttcttgaagaaagtcgcctcaagaattgtcaatgaagtcgatggggttgctagggtcacttacgatataacttccaaacctcctgcaactgttgaatgggaatgattcatttctattttaacattttctatatatatatatatataagcctagtacaaatataattcatcaacgttcaaatatttttaaagcatactttttgcacaataacagcaggagaaatgtaagtaggatgcgaagaagaaaaaacctattgtattatcttgtacataagtatgcaccttcgtctgcatacagctttctgaaatacgttattttaaaaaatcaaaattgactcaaatgcattagagtgatcaactctacaacttttaccatttatgttggtaatttcaacacgcggaaaatttaagtagcccttttttaaaggaatcaaatggacttcaaactcctttcttttctcttttattgcgcaacgtttctggccatgaattaaccattcattactgctcaaaatttcaaaaatatatcctccgtcatctataacatcttgcccccattgtccactaagattttccacaattacagtataggaaagggaattgcctatggtagctatagtatcgtgtagcgcatcgtggctagtttccatttgctcgaattgtacatgaaagaattgttcaaaacctggtagttgtaccggaacagtcaactgtttcggtaccagattcctcacatactcatccatatcagtattacatactgcaattcctctactcactttattcaagcagatcaatattttgtcaaggaccgctttttcaatgcataggttacgtatcttcgactttgttttattcaggtctattgaagtctttaacaatctaattatcctgttttctttgaatgcatcataatcgtatttcaactttttcaaaatttctaattcccaaaatgttttccacttttcaaacagaataaaccattcaacatcaccttcaataagcacggcgtctgtaataaagcaatctagctgttcttttaatgtgttgtatctaactttcagattaaagatgtcttttgaatcgaagttattattggctgtgatttcgtagcaattaatgaaactctcattcccatcgaaagtaattaacgcgggtgtagtagcgatgtagtcaccacgtatgttgtaatcatttcgtgtatctggtgctgataattctgaactatataaaattactggctcttccctgactgaagagtttagaagaaatttgaagaaaaatatatcctttttaaaaatatcttccactgaaacagacagttgtaaataacattgaatgcggaccttcttggtctcaccaaaggtgccttgatcattttttttggtgaaggatgttttaattattaagtcgaaggcggttatttggtccaacagatagtattctagcctaacgttctcgaatggagtattatatctcttccttgcctgaatttcatccatggaaaaactaacaggtaaatttttcatgtttccaatatttttttgcacctcaacctctacttgcaaagattctaaagcgtcagattgcacgcttttcaattcaagtgcatactctcccaagtttaaattatgcgcctgcttcaccagaaccttagtactttccttacaatatatttctggcactacaataaactcatcttgattctccggaaactcctttacaaaagtaatcccctcaacaatgatttcgaaagaaagcagagaaaattcaccgtacatgatatctctacactccaatattagtttattttcacctttcttcaaaagaaaatcactggctccaaaaactatcacgtctccccccatatttttcaaagataatctcattgtttttgtactgatatcctccggaaatccgtagcttttcaagttaacttcaatagcactaacattcgctcttgccagatgaactttagaattcaaagttacttcgaatagcccatctaaaggatacattagatgaatgttatttttcatttgtaaatccatgaactttttccaccaaatttccttgctatcgttatctttgcataacttaagtatattgagaaatgcattagttaaaacggccgatgcagaaactgattccccatcaatctgtaagacgtctaatttggggcagtggctcaaggaatcaatgaaaacttgcaatattttcaaaccaatgctattccagttcgtttgagtataatattcgtaacaggaaaggaaaagcgagactgcctcctcatatttctttccctgatagtaaagcaaacctatctcaatggataaaatatctactatcctttgacgcttcccttcacatttgttgaagagagaaagaatttctttggtgagagtaaggaagttttcttggaagacagtttcatcgacaaaagtttcttttaatagatcaaatttgtatttaacgtcactattagggtagtttttgtccattagtctataaccacttgtagccataacaccttgcacccagttgtcgcgcttcaacattaataactcagctttgatttcacacaagagaggatttgagacattctcaaattcaaaatatgacagcatcgaagttataaaatagtgcttaaattccaataatctcacagactttctatactctattgatatggattcaataaaattcttgattagttgaaatgctcctacaaaggcggtcaacgtctggtcctctagttttagaagtcttaaccttctaatgaaaaaatacttatgcaattgaaacttatcgagtgtaccttctattattatggagcccagtgattcatctgatttagaagatgattcaaaaggtacctgaagttttccatccggcatattcatgtttctacggagtatttcttttttgattttttgcaattccaggctggcatcttccaaaatattgaataccacatataactcgtacaatttttctcttgtcaaaagctgttcctcaaagttatttcctttttgtaaattggccaacgaatgttgcaaatgtgtcaatcgtttttgaaagatgctcagtacggaagccttaatcttttggctaaattggttccaaaactcctgcctttctttgggagatctataaaccgatcgaacttccaaagtttgtacatgcggaaagtctttgccaaatttctccattagggataccgatttgaataggttagagtccactacttcagaattggcatacagtaaaataattggtttataaatcattttttctcctgtcgatgaagatacagattccagatttggtagccactgtctcacaagaggccgtactttggccctgtattggtcgatagagatacagttcactatcaaaaatctgataaacggctgttcatcattagacttgtctgcctcccctctaccttctggaatcaattcaattggaagcctgttaaccgttcgtacagttccgtcaaatgccttccaatgtatattgtctaacggtaaaatctgctgaaactctggcctcagactctcaaataaatcaaacgggtcaaaatagctgacaggaaccgatccacaatatatttctttatccatctactatattagcatgtaaaagcaagttcactggctatttttattgcttttatgctcactttctttcaaaacttctaacttgcacttttcaccattttcatgttccgcgagctgttcttaagaagtgaaaacaaaggaatttaaaatgcgagaaagtctttagtcctattgacaagtatattgaacacgttgtaaattcaccaaggggttaagtacaagaaccaataaatctatactgtgaaaatatgtcaaaaaaaaaagaaacctttactccaagggcaaataaacttaaactgacgaccccaagaagaaaactgaaaatactgtcatctctccttgacgcggacgaggattccaaaatgaaagatcaacatgggtactcaagggtccacaatgataaatacagagtagcaaagcctactcagcactcgactttacatgaatctatttcctccaggcgaagcagtcatattcataataaatcccttcatgaagatagtgcgagggcattaagctgggtagattctctaattaatagggggaaaagtatacttactacactagaaaaggaagatgccttgtttgagcgtagtcttgaggaggaaagacaacgttttcagcttcatgactctttaatgaacaagtacacaggaaacagtaaatctcatcagcgactaatcgatctcaggaagagccaatacggaacggatacttctttccaaaataatgatgaaattcccttagatagtttcataagttctcccttaccggacgctgaggacgagtcgtcctcaaatatcgactccgataaggatgaagatctggaaggtaaacaatctttaatcaaagatttcgatcttgaaaatgatgaatacgagctctctgaagaagaaaagaatagtgacggccaaagtagtccttcaataatgatattatcagatgaagaatatgcagaggaaggagcactacaagatgtatcgaatgatgaatatgccgaagaggaggggcaagttgagagaaagaatatagggcaagaacaggcaaatgtagagaatgctacacaaattagttcttctgattccagtgaaggacagaattattcagagggagtagaaatggaattagaagacgacattgatgtggaaagcgatgctgaaaaagatgaaagtcagggtgcagaaggaacagaacattcggtagatttttcaaaatacatgcagcctagaacagataatactaagatccccgttatcgaaaaatatgaatctgatgagcacaaagtccatcaaagatattcagaagacggtgcatttgatttcggttcagtaaatatttcagttgacgatgagtccgaggatgaagaaagtcaagctgaaagttactcagcaaatgctgaaaatgtgtaccaccataatgaacatgaactggatgataaggaactaatagaagatatagaatcttcagatagtgaatcccaaagtgcacaagaaagcgaacaaggaagtgaagatgattttgaatataaaatgaaaaacgaaaaaagcacgtcagaagaaactgagaataccagcgaaagcagagaccaaggtttcgctaaagatgcttatactaagaacaaagtggaacaacaggaaaatgacgaagaacctgaaaaagatgacattatcagaagctctctagacaaaaattttcacggaaacaacaacaaaagtgaatactcggaaaatgttttggagaatgaaactgatcctgctatagtagaaagagaaaatcaaattaacgatgttgaaggttatgacgtaacaggaaaaagtgtcgaaagtgatttgcacgagcattcccctgataatttgtatgatctcgccgcaagggctatgcttcaattccaacaaagtagaaattcgaactgccctcaaaaagaggagcaggtatccgaatcttatttagggcactcaaatggaagcaacttatcgggcaggtctttagacgaatccgaagagcaaatacccctaaaggacttcacaggtgaaaacaataataatttaaaaacagaccgaggtgatctttcatcttctgttgaaatagaggttgaaaaagtttctgaaaagaaactggacggttctacagaaaaagaactggtaccactatccacagatactacgattaacaattcatcattaggaaatgaagacagtatctattattcactcgatgacgctgatgctatatcagagaatcttaccgatgttcctcttatggaaatcaaaacaactccgaaatatgaagtagtaatttctgaatctgtgtatagttctacttcttacgaagataacacagttgccatgccaccgcaagtggagtacacttcaccatttatgaatgacccattcaattcgttgaacgatgattacgaaaagaagcatgacctactgaaatcaacgttagcagcccttgccccagctttcaccaaaaaggatgcagaatttgtggaagctggagtgacgaaatcatgcttgacatctacatctgggcacacaaacatttttcacacaagtaaggaaactaaacaggtgagcgatttggatgaatctacggaaaacgttacttttgaaaatgaaaatacaggtgatgaaaataaaaatcaaagtaaaaattttccaggcgtggctaacagtactgacaagtcaactgaagataacacggatgaaaagtacttttcagcgattaattataccaacgttacaggagactcttcctgcgaggacataattgaaacggcttcaaatgtagaagaaaatttaagatactgtgaaaaggatatgaacgaagctgagatgtcttctggcgatgaatgcgtaaaacagaatgatgatggtagtaaaactcaaatttcgttttcaacagattcgccagacaattttcaagaaagcaacgacaacactgaattctcttctactaaatataaagtaagaaatagtgatcttgaagacgacgaatcactcaagaaggaacttacaaaagctgaagtagttgataagcttgatgaagaggaaagtgaggattcatatgaacaagattatgcggatccagaaccaggcaatgatgaaggcagtaatgaaaatatagttaaaggtacaaaaaaggatactctcggaatagtagaaccagaaaatgaaaaagttaataaggtgcacgaagaagaaacacttttcgaagccaatgtcagttcatccgtaaatgttcagaacaaagacatgcacaccgacgtcatcaatcaagaggcgcaagcgaattacgaagctggtgaaagaaaatactatatccagaatacagatacggaggaagcacacatttccattatcgaaagaatagatgagaatgcgattggaaataatatggagatcccagaaaggtcgtgcgtggaaaaaacgcacaacgaagtgctctttgaaagaagagcaactaccattgaaaacacaaaagccctggaaaataataccaatatgcatgatcaggttagccaagcttgctctgattcagaccgagaccaagactccacagctgaaaaaaatgttgagggatctgcaaaacataatttggacattcgggtgtccagttcggaaattgagtctgtggaaccattgaagccagaatctgatcgatcaaatattttttcatccccaattcgtgttattggagctgtagttaagggagtgggtaaggtagtcgacgtagctgaatcattcgtgaaaaaaattgatgttatggattctgagagtgatgataacgttgatattggtgattataatcaagacatttttaacaagtcgaattctaccgatgcatctgttaatatgaaaagtgtaagtagcaaagagagagacagcgatgaagatgaagctgtcatactcggaggagttaccgcagaagcacataatgacaatggtaataattctcgtgtgataaacatcgatcccacgacaaacggtgcttatgaagaggactccgaagtgtttcgacagcaagtaaaggacaaggaaaatttgcataagtcggaagagccgctagttgaaggtttacaatccgagcaacatttcgaaaagaaagaccacagcgagaatgaagaagaatttgataccatatatggagatataacatcagcaaatattcacagtaatgcccccgatgatattaagagacaacaactcctaaagaatctaagtgacctagagaattattctcagaggctcattgaagattccaggagaggaaaaaatcaagaagaatcagacgaagttaatacaagccgtgaacgggatctcacgtttgaaaagtccgttaatgagaaatatgctggagcaattgaagaagacactttttcggagttagatattagcattcaacaccccgaacatgaagaagacctggacctatcaaacaatcaggagaggtcaatagaagaactaaattcagagccagaagaagctgagttgtacgaattggaaatagagggccctacagagacagcagcttctagtaaaatgaatgatgatgaaaggcaacgcggaaatataccgtccacagatcttccatctgatcctccgtctgataaggaagaagtgacagattcttatccctattcaaattcggaaaatattaccgctgaaaagagtgcgccaacatcaccggaagtgtatgaaatattctcagacacgccaaatgaagtccctatggaaattaatgatgaaattcccgccaccacgcttgagaaacacgataaaaccaatgtaacatccgttttggatgatagatcagaacatttatctagccacgatgttgataatgagccacacgataattccattaacatcaaagtaaatgaaggtgaggagcccgaacatcaagcagtggatatacctgttaaagtagaagttaaagaagaacaggaggaaatgccttcaaaatctgtacttgaagaacagaaaccaagtatggaactaatcaatgataaaagttctccagaaaataataatgatgaggaaacaaaccgcgaaaaggacaaaactaaagcaaaaaagaaaagccgtaaaagaaactacaacagcagaagacggaaaagaaaaatcacagaaggcagttctgccgcatcaaatactaaaaggcgtagggggcacgagccaaaaagccgtggacagaatacgcatccaagtgttgacaaataatcaaattgtatacaggaatatgtagatagtaataattattgcgatgcgtttttctatacgagatctaaaaggaaaaaagttcggttttaaggcggagttaacgtcatgtcgaatggaaagaaagattatataaagaatggaaaaacaaaaaaggtgaaaaaacatcttggaaggcctcataataaatcaatcggctgcctcgagaaatgtcagagttgagagccttcagtgccccagggaaagcgttactagctggtggatatttagttttagatacaaaatatgaagcatttgtagtcggattatcggcaagaatgcatgctgtagcccatccttacggttcattgcaagggtctgataagtttgaagtgcgtgtgaaaagtaaacaatttaaagatggggagtggctgtaccatataagtcctaaaagtggcttcattcctgtttcgataggcggatctaagaaccctttcattgaaaaagttatcgctaacgtatttagctactttaaacctaacatggacgactactgcaatagaaacttgttcgttattgatattttctctgatgatgcctaccattctcaggaggatagcgttaccgaacatcgtggcaacagaagattgagttttcattcgcacagaattgaagaagttcccaaaacagggctgggctcctcggcaggtttagtcacagttttaactacagctttggcctccttttttgtatcggacctggaaaataatgtagacaaatatagagaagttattcataatttagcacaagttgctcattgtcaagctcagggtaaaattggaagcgggtttgatgtagcggcggcagcatatggatctatcagatatagaagattcccacccgcattaatctctaatttgccagatattggaagtgctacttacggcagtaaactggcgcatttggttgatgaagaagactggaatattacgattaaaagtaaccatttaccttcgggattaactttatggatgggcgatattaagaatggttcagaaacagtaaaactggtccagaaggtaaaaaattggtatgattcgcatatgccagaaagcttgaaaatatatacagaactcgatcatgcaaattctagatttatggatggactatctaaactagatcgcttacacgagactcatgacgattacagcgatcagatatttgagtctcttgagaggaatgactgtacctgtcaaaagtatcctgaaatcacagaagttagagatgcagttgccacaattagacgttcctttagaaaaataactaaagaatctggtgccgatatcgaacctcccgtacaaactagcttattggatgattgccagaccttaaaaggagttcttacttgcttaatacctggtgctggtggttatgacgccattgcagtgattactaagcaagatgttgatcttagggctcaaaccgctaatgacaaaagattttctaaggttcaatggctggatgtaactcaggctgactggggtgttaggaaagaaaaagatccggaaacttatcttgataaataacttaaggtagataatagtggtccatgtgacatctttataaatgtgaagtttgaagtgacagcgcttaacatctaaccattcatcttccgatagtacttgaaattgttcctttcggcggcatgataaaattcttttaatgggtacaagctatacatactaggatgaggatggtactgagaacgataaataaactttctagatatataactttatgtcatttaaatataaataaagtgcgtgttagcttgaaagtgtgcactcagatagtttggtagttggaggacaatcctctttcattcacgggcttgggcaaaatctgagatcgtatgtaaaatgttaaagttagtgaaaaaacgactgtgaggattaccagtgtaaggtttattgggaatggattcatgttgaaagtagtatgtgtccatttgtccagtaagttttgactcatgttgaaaataccacaaatgcaggacaataacccataaacagtaccaaatgtgtcaaatccaaaaacttttgaagaataatcagaaacaactgtgtaataaaatggtctgtacactaccagaagtactatacctattaagttccaagtgaatgaatttggaatcaagccaaaaacacctatagcggtagaagtggtgaacaatattgtgagagtggacaaagtatctgtatggtccaagagcagcccaataaatggtatggaaacagcaccgccaagtggaagtaacatatcaaaaatggaattcaattttagtgctaaatcaggatcatttaataagtattcttcttgtgttctgacggtagcaataaaatagtttatcctcagcatggcaacaagcgcaaataaaagcattaaataaaaccacggactctttatttgttcataagcggatttcccatgcaagactccgaatatgccgcctgactttttctgcaacttatcttcaacgtaagtttccaataccgatttccttctctgcggccttgatgggatactatcttcttcacgctcgattgcaatcaacgattgacgttcctgttcatcagggatgataccggagcctgtatcaccctcgatgagtcttccgttttcatctaaaccttccacagcgatcttagcaatgtgattgacagttttgtaggaagaatgaggcattatcgtgagttgacaggcaagaataaacactggaacaatcaaatatagggtgaaaaatctggaaacgttcaaggtaggaaaccagttttgatataacaacctatataacagaaacagcgcagatgacgaatcaaatgatcctgttagtagggccaatacggttcctgatctttgtgggaagctatttgccaattgaaaacatgaaatgaagacgaacggaccggcaactgccaaaagcgtgtaaccgacaagatatgggtcccaaagagacactagatgcttggcagaaataaaattaccgcttgctaggaacaagagacatgatcctattattccgcagacacgaggtccatacatatccaaaatcttaccgacaggaagggccatgatgtttgttacagtagcactgagagcaaatataaaatttaatttcagatcctgtgcagtacataataatctatcaccatccttaggatcacacaattcatggtatacaccttctgaaattaaaataggtttcaaagcagcaaatccaaagataataccagctgaaaaaagacaccagatacaagcacaggcaacctgtgcgtatctcaacgttcttgtactggtcattacagtctttactgccctaatactggcctaacgaggaataaaatcatttatagatgccattgttatcgttatcataatgaagcatcgtatcggtagttaagttaatttgacgtattattacccggaggatttaatcatgtataaatatgtatgtgaagattatgtgaagattacgtgctatatatacttgcctcaggtcaactgctggagccattgagccacttttctcacaaaccctcttgagttcggcacaaagtggcccccagagtgcattagtaaagtgcgagagtcttccgtacaagagttatataggccttgcactttggccggctctgtgatagtgtcaagttctccttgaacatgtagagatgggaccgatattggatgcaggtcgtactgttcttgatactgttgtggttggaacctgaaaccactgaccgccatgaaaaattctagcggcggctgttcttctgttgtaaggcccaacaaaccattgaaatccgttgctaggtatccagctacaccggctccttgactaaatcctacaatacctgcaaatggaccattttcaaggacataattgtgtaaatagtcgattgtcgtctgcggtatgaaatagccaccggtggaagggtcattctctagccacgcaagcacaccggtattctcaccatccccaggtgcatcagcaattacctcacccaagaaatcaggaacatcagctgggggaaattcattgggtgctgttggatagtagagtttatatcctaacttttccatttcggcgcgaaacccctttgtcttagaggcaaagtagtcacctgactgcgcaagcccatgtaacatcaatacattcttcgtcatggttacagctattaaatcttatagtcttgtagtattgcacattctttcttcacttataccttttttttcttctctattcttcctttttttgcttttctttgaatttttcaagtgaaaaaaaatcctcgattatagtgtgtaaaaagcatcaataatttatattgtatatgggctagaaagctgtcgtaatagcaaagggattatattagtggacctgattaattctaaaaagatattttacggataataataaaggttttcttttgagaccagttagtccatttctttcaactggctgtcataattttgaatactatttattgatcggatcaaaagggaaaactacagcttcggtcctcgtcgtcctacttgaaaccctgctttttttatttgttattaataattatgagcatttgtccacatatacagcaagtatttcagaatgaaaagtctaaagatggggttctaaaaacgtgcaatgctgccaggtatatattaaatcattccgtacccaaggaaaaattcttaaacaccatgaaatgtggtacatgccacgaaataaactctggtgcaactttcatgtgtctacaatgtggattttgtggatgttggaaccattcgcattttctctctcacagtaaacagattggtcacatatttggtatcaactcaaataatggccttttattttgcttcaaatgtgaggactatatagggaatatcgatctgattaacgatgctatcctagcgaagtattgggacgacgtgtgcacaaagaccatggttcctagcatggaaagaagagatgggctttctggcctgatcaacatgggatccacttgtttcatgagtagtattctccaatgtctaatccataacccttactttattaggcactcaatgagtcaaattcattctaataattgtaaagtgcgttctccagataaatgtttttcatgtgcactcgataaaattgttcatgaactttatggagcgctgaatacaaagcaagcttcttcgtcatctacatctactaatcggcaaaccggattcatatatcttttaacttgtgcctggaaaatcaatcaaaatctagcagggtattcacaacaagatgctcatgaattttggcagtttataattaaccaaatccaccaaagctatgttcttgatttgccaaatgccaaggaagtcagcagagcaaataataagcagtgtgaatgcatagtgcatactgtgtttgagggctccttggaaagttctattgtgtgtccaggctgtcaaaataattcaaagacaaccattgatccattcttggatctttctctggatatcaaggataagaaaaaactttatgaatgtcttgacagtttccataaaaaagaacagttgaaggatttcaactatcattgtggggagtgtaacagcactcaagatgcaataaagcaactaggcatacacaaattaccatcggttttggttttgcaattgaaaagattcgaacacctacttaatggaagtaacagaaaactagacgattttattgaatttccaacttatttaaatatgaaaaattactgttcaacgaaggaaaaagataagcattctgaaaatggcaaggttccagacattatttacgaattaatcggtattgtttcccacaaggggacggttaatgagggacattatattgcattttgtaaaatttctggagggcaatggtttaaattcaatgattccatggtctcctctatatctcaagaagaggttttaaaggaacaggcatatttattattctacaccattcgtcaagtaaattgattcagcaaatagcattcaacaataataataaaacaaaaaagaagaaaaagctatgcatattcctatcacagttaacgcttgcttccgttcttttttctatatcatcgtttccatcatgtttttctttaaattgaatactttcctatgctcttaatgagttgcgattgtgcatatactgtatttcaaaatcctttgtatctaactaaggaagaaaattactatgacgtttattcaggatttttttttttcattccttgctatacgaacaaaagagcaaaggctggaaaactaagtgagtttatatatagtaataattaaagaacatatcattatcatgaatttagaatgcaaatttgctcctctcaaaatggcataccttgttgttcgcgaaggcaagcccttggttataaataggatataatataatatagggatcaagtacaactattttcttttcttagcaaggagacttccaagaatatccgtctttggcgtccttgatgctcttccttttccccttctggaagcggttttggtgctcgcagcaggacgagtctttgtttttgtttttcgaccattaagtaaaccataactagcgtcctcttcgtcagtactgaccataattatgtcattctcatcaatatcaacatcatcttgagcatcgttattatcaccgagttcattttctgcatcggatatgacagttgagtctgaaaaagcaggaattttctttttcgttgcagttcgcactcgtttgggtttgctcgttggcttactgctttccgcttgactaatatgggttattcttgattcattatcaacatgtgattgggtaatgtctggagatccagttcttacttctctattactagaccggaaggaatctagcccattaccattgaatgcgaaatttgtctcatcattttctttagggggagtcggcctaacactgttagcacgcttaacctgttttataagcgctttcatttcctctgcatcatctgttctcagaaattcttcattcgtagataatattccaacttcgttcgatatttcatggctaataaattctttaagagctgttttctcatctttatctacaaacttctttactgcttcattcaaaccaacttctggtaataaagatagttgcattttgttcaagagatcattaaccaaagtttgaacttctagttcaccgccactttcgctgaaaagtttctcaacatctctatcactgatgcttgttccatttataccggatttttttgatctagttacaggtgacctttttttataaaactgcacaacgttattaccgttagcaacacgtcccacaaatcgattgctaaatctacgcgggttttcaacttggtaatctattggggattgtgtattggagggtgcactataatcaacacgtaatctgatcaatggtttcggtaattccgcaaccatgtcaccttcaccatcgtccgctaatttttgtttagtttcctcattagcgtcgcggatcatttcttcaacttgttcaataagatacttagacgtagcatctttatcgtgaggcctcaaatggggaacatcttgtaacgaaatggatttcattttgaatgtccgtatagtctcaagaggaataggtgtcatttttggtgcttctccatactttatgtcaaggataaagacatacttgggttgtgcctcagcctcacaaagtgaagtagctacagatgaacctggttgtaatacatcaaaatttttaattggattgtgtacgagattcggaatacactcatgttcatgaccccatatcaccatatccaggaaatctggcaagaactgttcaggtaaaaatgcagtattcgtgtgacctgtatgattttgatggacgcacattaaattaaaccattcaccttctcgcatagtcggtacttcaaaagtgacaccaccatccttaaaagttctaaataacctttcatcacgaacagcggctaatccgtacaatgctaacttagtggaccctttctgaaataataatggcacgacttttattttatcagattcgatgactttcccgaaatgatttattagaccagtcgcatgaagtatatccataggacacaacagtgagtcccccgacgcatcatcatgattacctgatatgccgaatacgggaatagaaatattaaagttggggtcctcatagttaacgttggtaaattcatcgtagtgaaaaacttgtgagggatcgctcaataattctaactcgcaaggcttgtcacccatgcaacataatctcaaagtcttcagtacttggtagagtgacttcttggaaggcttattcacgtgaaaaagatcaccggactgtacaaccatgtctacgttgttatttttggccagcatcatgacttcatggaaagttttccaagaatcatcgccagtaatgggatcattttcgttgtaacccacatgattatctgtagtaattaaaatccttattgtgtctggatcaggatagtccatagtcgagttttatcggatctgagcaggtacaacttgcgtcaattgtctgcattctcttaatgttgtttccacattgtcttccttacaagcgtaaagagtaatttaatatggctataatgtttgggttctattcgattggccatactatttaaaccttaagtcagtttggttgggtatatctatctatacgtttgtgtaattgcatatatattatttacaggcttgcttgtgaactctgactttgtttttgttagaatattagaaacgtgcatgcctacaatgagatttgtagatgcctttattttctcaatgcatttccaacatatgtttgagatccagctgtttcgagtgacggtcgaaatgattggctaattcctgaaagttcatgtttgatggatcgacttccatttcttttttgtccttgtaggttactttcacaagaggcttgactttattgtaatctgagataatttccgattgaatctgcgtgcccatgtttcgttgcgttggtggaatggcagcaagtactaacctagcaactttcgctgaaatcaatgatatgaccatatcatttgctgttagtatttgtgatagatcggttcgagcctacctcagcctagtttagccaaatctttaaatcatgatggccaaaggtaaggagaacgaataacagagcgaaaaaaaatacataccttccttgccaaagggattaaacctgacaattaccttactgaagtatttagttatcatggcgaagatataattaagctcgtttcttcttcacatctgttcatcctctatttgaggatccataagtttatctcttttatttcgccggtatattccgtagaatcgcgcaaaacggttcagggaagaatgaaatagctaaaaagtcttacatgtataaaaagtatacagatttacttagtttagctaggtttatccacggaagatatgatgaggtgacgcttggtttgttggaaagattaaagtgtctgcaattacagtattttgttttctggaagttgcatagacgatcagatcagccacgtcatcagccatcaatggggtagtatccttgtaaacattcttggcttgttcctcgttacctctgtatctaactagtgaaaattcagtctcgactagccctggtgcaattagaatgactctaattttagtgttgatgagctcctttctcaaactatcagtgaacgcccccacggcaaacttagaggcacaatagatagaacctgttgggtatgcgtctctgccagcgattgaacccaaatttacaatatctcctgaattcttggcttggaatatgggcagtacagcttgtgtgatattgattaaagccgtgacgttggtgtcaaacacgtcctggatatcctccgttgcgatctggcccacacggtcactgccaagagcctttccggcattgttcaccagaatgtcaatatccttgaactcttgtggcaagttttcaatgaagggcttgattttttctgcttgagtgatatccagctgggccacatgaacttttgcgtttggaaactcttgatcaatggtcttcttcaattcctcgagcttttctaatcttctagcagccaagatcagtttcatatcaccattggatgcctccaagtactctaatgcggtcgccttaccaataccagcagatgcacctgtaatgaggacagtcttcttagccaatctttctgcagcttttctaccttgggacattatcaaaatacgttctcaatgttctatttcccgcctttactagtgagcttgaacactttctatgcgccatgctgtttcatctatcctcctttcttcagctttttatatcgctccgataagaaaaatcggtgtcgtgccttaatatatatcaatgctatacgtcatagagtagagtcgtatagtgtataagagtaatatatagatgataaagagaacttactcatcaccctctgcaccaaatagcatcatcatatcgagatcgttctggtcgagtgtttcctctgcgggggcttcatcaagttcgcgcaccaccttgttctcttgtatgtgttcccgttcatgcacattatcctcgtcctcatcgttttcttcgtcatcctcctcgtcttcgtccacttcatcctcttcctcttcttcttcctcttcctcttcttcttcctcgacgttatttgcagtttctgcgtcagagcgatgttgatgttgtttctggacagaatcttcggtttgttgtaactgcttacgttttagttcagcctccttctcgagctttttaatgctatctatgaacctgcttttcaaaagaggattcgtggctttacttaatttatgcttggtatgggccagggtggtctctagttcgttcaattcgtccgcaagtaattcagtgtgctgtctgttttcgtctttttcgtcatcagattcactttccccaccagcagcttcaatgtcaccgtcgtcatcatcgtcatcatcttctccgcctgtgtcttgatccacctcatcaccgacttcctcttgttgttgctccttgtctccctcggcaccgctaccttcctcttcactttcaaaagcagcgcctaggtcaagatcctcctcttcttcttcttccattccttcttctccctcttcttctgcaccttgttttcctactgccgaagcaattgtgtgtatctcttctttctttaaagcaggtctagataaaggctctccaggctcctctttgaaattttcccaactagaaacacgctcttgcctcgcttgcagttcacttttatcaaccagatcatagctgacctcttctgcctgtttatcttgcttcaaaagcatatcaaccactttttctacatagtctatttcattagggtccattttccgtctaaatcgtctatttcgaacattgtacaaaggtggtgatattccatgtttgtagtcatagcccttcaaagctatttctttcaaatgtttagcctccatatcacttaaaggcgcaccattgtatccttttaagaaggtttctttattctcccaaatttcatcctctatgccttcaaaatgcttaacaaccagatcttctgtatcaggggcttctagggcatatacttcttcctcttcttgtataggtcttatgcatagtagcatttgtgatacgtcaaatgtcttcaggaggttttttctatcgacgctcttgttcacttctataactgtaggcaaatctactagaatggcaccatacattacatcgtttattgttacgacagcgtgtctctcgtttttccacttgatacttatcccagaataatcacctgattctaacgaattttttacaaactctaactgtatgtctggaagtatccttaatatcacaccactctctatgagagggtcatcttcaatatcagaggcttctgagtcgtacgcttccccaggaattctaataggtttgagacgtagctttggcgccttgtgtatcttcttaactggttcttcattttttttcaagtttaactttaacttcaatgaattcttcttctctttgccgtcagcactctctttctttttctttaggtttatctttaatttaggctttggtttgatatcttcatcagttacctttgtctttatgcgaattctctttagtttaggctcgccttctaatggttgatccttctctcctggtcctctgggttttttaattcttataacagccatatttacgtcgattattgcgactaatttgaatggtaacactgtctcttgtttatgtagttcttcctattcttctcgcttttattatttttgctagcaagttttgtcttgaaattttatttactgttctcatcggccgaataacagcgatattattgtatgatgataatagagatgaaactttacaaatgcggttactacgtcagtcaataccattctttgaagtaagaaggctcagcaactatgtctgttccaatccctggtattaaagatatctccaaacttaagttcttttatggtttcaaatatttatggaatccaacagtatacaataaaatctttgataagctggatttaactaaaacgtataaacatccagaagaattgaaagtacttgacctctaccctggtgttggtatacaatcagctattttttataataaatattgccccaggcaatattctttattagaaaaacgctcaagtctctacaagtttctgaatgcaaaattcgaagggtctccattgcaaattctaaaaagagatccatatgactggtcaacctactcgaatctaattgacgaagagcgaatatttgttcctgaagttcaatcctcagatcatattaatgataaatttctaaccgttgctaatgtgacgggggagggttctgaaggtcttataatgcagtggctgtcctgtattggaaacaagaactggttgtataggtttggtaaagtaaagatgttattatggatgccaagcacaacagctagaaaacttctagctaggccaggcatgcattctagatccaaatgttcagtagtaagggaggcatttacagatactaaactcattgccatatcagacgcaaatgaattgaagggatttgatagtcaatgcatagaagaatgggatcccattttatttagtgctgcggaaatatggcctacaaagggaaagccaattgcgttagtagaaatggacccaattgacttcgattttgacgtagataattgggattatgtcacgaggcacttaatgattttgaaaagaacacccttgaatactgtcatggactcgctgggacatggtggccaacaatattttaatagtagaatcactgacaaagatctgctaaaaaagtgtccgattgatttgacaaatgacgagtttatatatctaacgaaattattcatggagtggcctttcaaaccagatattttaatggattttgttgatatgtatcaaacagagcactctggttgaaaaaagtgcttttaaaatttacttcattatttaataaatatgtgattttagcgtgtgaatataaaaaatacatagaactcaatcttcgttaacacggaaccatcttgtaatcaagaagcgagaagcggaactaaaactttaagaaaaggagctctacgaaccgtcaaagctaaattgatcgatagaaattgcttcttgaaactttacattctatgtactttacaaatatactttacaaacttagccatttatattactttacagttaaaaatccatcaggaattattcgtctgctttttgagattcatggctagcgacatactcagtagctttagctttaacgtattcaatggtcttttcgtcaccttcagattcctcaaattgtaaccatttattaaagaaaaacttagcctgcttccttgttatttttttggttattattctctcaaataaatcttccaccttcttcttatcttttgccttcacttcctggtctacgtaaacgttccacaggtcaattctctttggcgcatcagcaaccaaaccttcgaataatgaccgacccctttctgggtcaccctttgcaaattctaattgagcaaacttgcggacaacctcgatatgattacgctttggtagggccttcaaagcattacctaaaatagtacgtgcctcttgctcttcattgtggctgatcaaaaaatcaccccacgatacccagatagaaactttctcgccgccaaatttcttagctgtagctttgaataattctgctgctttgtcgaacttttcacttatttcataaataccaagcagttttgtatgaatagtatatgagtccatatactgacaagccctgctaaacacttcttctaaagtttcttcggtaccaaaagtattttctaaattcagcattgcaatccaaatattcaacttctcggcttcttctctgaagttgatggtctttagcgcacgttctgcgagctctcgagccttctcgatctcactcagttgtagttggaaagccatatagttcatccacactacggacgaatttggattaccgataagtagacgttcaaaatcggcaacagattctggtgccctagtgttgatatcaatggtcttatcctgaacaacattttcctttcttctcttgtgcttgtgtttcttattttcagtaaagtcttcttgatcttggtcagactcttcttcttcttgcgcttgatccaaaatggaagcagtccaatcaaaaccagcactcaaggatagcccatccgaagatgtttcaggcttcctatcggcaacttcggtgttttggtctccgatatcagattcgctgtcggaatcgttgaagccagcatctgccatgacttcatcttcatcctccttttccagttgatccacagtagtagtggtggtggtagtagaagccaattcggcttctttagagaaatgagacgctttcaagctcaatgaaatttgttttttttctggatttgttttcaaaacaatagcttttactctgtccccaacaccaaacaaggcagaaagatcttcaggttttttgtccgcaatttcagtaatatgtgccaaaccagtaacattaacagtgttatctagtttgacgaaaacaccaaaatcagtgacgcttttaattgtaccctcgaaaacatcaccagccttaatgtctgaataggtctttagaacctttaaatcaccatttatttcggattctcttagggttagagaaatacgagaatcttcatcgcatgtaacgacttttcccaaaacgtattgcataggcttgtaaaacttcttccattccttcaagtaagaatcagatagtttactaacagggacaaaggcttcaactttcctactcaagtaaacaaaaatacctttgtcattcacattcttaacaataccatctacaatctcgccttgcttcaaatcttcatgagatttgatcgaacgagtttttgcagtagcaggacgaagggatagttcaattttcttattctgttcatcaacagataaaacggtagttggaatgacgttgttaattttgtcttcaaaagcttccttcaatgttagggagaaatcatttaacgcatccgtaataaaggaaataccagtcactttgttaccaaggtctaacaaaacatacttttcagctatttttagaacacgacctggcaattcatcaccaactttaattgtggacatatttatgtcaacatgactctttccaatggcattgacaaagccatgctcgcggtcaatagaggcaactttcacttggagggctgaacctaatgggaaaacagattcaatattttctgaaaaatttgaatcgttatcagctaaatctagtagagaaattctcgccttcaaaactggagaaattgttagccataggtggttacctgatgaattgttgacaaagccagttaactcttgcccaatgttgatttcctcaagactttttgtgtgcacttccttagattttaattctgatggtttcatggataattccaaaacgctagcctttgagattttgtgtgtaatcggcaagaacttatggctcttgacatcgtgattacctatgatttttaccttgatgacatcgtcttttttgtaattactcaacggctgtttcttatctgtaatttcttcatacgtgtcaaacacttcagcaatgtccactctgccatgcaaatttgccgctaaaataacattcaattgatttttcttgacgctcttgatttttgctttaacaatactaccaatagacaaatcgtcccagcttttgatagacgaatcaacaggatcttcgatattagattcaactttcttcttctcttctttgacctttggagcttttagagataataggaatttctggtttttgtcgtctgttcttaataaatagacggtaacggattggttaatataaaacgccttgctgatatcaatatccctactatcaacagcgtaacttggtaaaaccaacccaatgaacttaccgttaaatgcaacaaagagacccttatcagaaatggatttaatgtaagcgtgcattggtacatctttatttagatccttaacatcatcatatgttaatggaagagtctcctttttagcgtctttaatcagagaacttttgagggacatattgaaaacgcgggttcttgtatctttatcaattaccaaaccagtcagttcagtgccgattctgagctttttcaactgagccctattttgttcaattctggaatcagagagatgaccaacgtagatgacaccacgcaagccaacatcaggaatttcaacaataacagaatctttggttttttcgataacatggacagtaatgattgttctgcctggaacaatattttcaatggtatctttttgttgggcagcctgttcatttgaaactttgcatgtggcaataattctcctcctgtcagcatcgacgtcaagaagttttactattactgtttgaccgagtcttaaatgttcttctggtctcttcacaaagacttctgagatctcagaattaggtaaaaatcccgataaaccaccaaaaaaggaaatgatgcaaccatttggtttgaaaacttgaatagttgctaaagtcttttcatttttttctttgatatttttggcgttttcataagtggaaaccagtggtaattcgttgtcttcaatattaactaatgattttttcaaagtgacatgcacattacctcttgaattaactgatataactctacctttaaccttagaacctatcttgaacttcctttctggataaactagcctggtatctgaaatgtgtaatggtggaacagaagccttaaattgcccgttaaatatcttcaattcaatacctgaactagagacggaagttatttcacaacttggtaataattctccgattggaatatcatttgttcttagatactttaattttaggtattttggatcagtggacaattgataaatgtcatcaacagggctataaccaaggaccctggaacttaaattttctgaattttcaatttcaccaactcttgaagaatgtactttacctaatctatcatcatccaatgctaagtatagatattcggaatcacgccctttaatgctgcatgattcaaatgtgtagccgatagggaatgcatcaagaccttcagtagatctcaaagcgtcttctagttttaaaatgtgtggaaggtttgacaaaatcaagaccttgtcaccgcttttgttttctaaacaagcaataattcggcatctaatactagaaccaataacaaatttatgctttaaatcttcttcggaaaatgttcttaaatgtgatacgttgacaacaccggatactaacccaaaaactttaccggcaataccatttttagtgattgattcacacaataagtcgacgatttgaccagggataatggcatcaattgaggagatttgagtaattttgtttttcttgtccgaaaagtctgtatttacaacaattgatctgtcggattttttggtgatattacctaagaaaacagcccccggcaataatttttcaaaattgccaaaatccttcttagcaatgaaccctgtaaagcctggcagaccaacatctaaggtagcaccgtgatcctcgatggatttgaccgcgcattgaatagacgtggatttaaccaaatcttcatctgcgtatatgttgacggatgaaggttcgatggttaactctattctcttctttttggatttcttagttgatggttctaaagaggtattcttgatgacagagcatcttagccattgaccaatgtgaaagtaccttcttaaattaggtaattcattagatttatctaatttttcatcttcgtcgtcggacgattcgtattctgcatcttcaactttggattttttctcatcagcagcatcagtatcactatccatatcttcatccagatcttccaaaatcgaagtaaattcttctgagatatgtgttaggttcacataaccagaaattccgtctgtgaatgttatacataaatcttgtttagtgatagcagaaatctgaccaagcaaagaagagccattcttcaacgttttaaagttgacatgttcaattagtccagctctagcttcatcagagtttgctgatgaggcctcggaatctttagaagtggatttctttgttgtcttcttctttttcaagggtctacttgctggttcagatgctttgacactttcattaccaaataacacatcacttgcagcttcgttagcaacttgtttcagttctaaaggagtcaaagcagacgcaccaccccttggaaaagagacttcctcagtgttccttactaatgatgaggtagagggctgctttgtggagtcttccctcgaaagtggaaaatcttcatctctctttcttttggtggaagctaccatttttgcaacagtacaggtgtgttttttatattaaacggtccttgattcagactgtagtagtagatactaatagctttaaataaaaatgaatagacgaaccttactgagctttcttcagttgctgctaatgtatagaagggtttagctcatctcatcttaaaatttttcaaaatttttcggaatcagaaacgacttagatcactttgcacgcgggcattgaatgactggccaatgtagtgacaataaactctctaatggtgaaatatgtaccgcggcaacaagtaagtttacgtctactaataatttgttgaataaagtaagcccagaaacaagcatccatctggccagaataatgttttcctatatgtacttaccaattatgtagttgaaaaatcatacacaaataatagcactataaataacgagcaggatatttataaaagagtttaacaacagagttcaggattgaatattctcagtaactgcgtaatacatattgttgggatttacgttttttgccttaaaccctgtttaatatctgtttagcaaaatgaaaagcatatggaaacctcttacgcactggaattgatatgttttctattaattaggataaaccgctgaacaagaacctttttcatggcatatcaaactttttaacattggaaaattagagaataagctcaagagagagatgtactgaagtagttttttaccgccggatgaagtgtttcgcctgctgtttgtttcgaccctgtgtatatgaccatttaggtaaagccacttaatagccatcaaatattgatcgagttcatataaagctaaagagtaggaaatataccatcaatggtgagcacttatttttttttggatttagatgtgagacatactaaaaaaaagttgctatcaagcctataatttggctacgttgtcttccggtgtttttcaattgatttaagttacaacactcaaatctgggtaatttgatcttttttaataattattttagtgacatatagttcttagagttcgcagatttattttgtcattttttggatcggcgtcttataaaatcaagacataatacatccgcacatcgcgcatgtgtgggtgtatatgcccttttcacgatttttaagttgcgtctcaaaatagtttccgagttggaagcctgagtttttcaaaacaatataggaattaaaggtatacgtctttggatacatgttatttgaaatggggtagaactagcacaactgaaaccaagaaaacacagatcataactaaccgttcaagatgttgatgccaaagcaagaaagaaacaaaattcaccaatacttgtttcaaggtatgtttgcattttttaggtgaaatatgcagtgatatgctccgaaatggatagcaaagatgataaatgaaaatacaattaaattgaacttgaatatcattaaaagtggtagaaaaccgattgtttcaaaaagatctttgtggacaagtacggcagtgcatgaatccgaaagaaaagtgcaacctaagcagaattccattatttcacgcgtccatttttataatgtttgaacttttgagtccttatagaaatgctaatattatgatcaaagcgattatatcatttactttacagtttccggagtttccgtattattgcaaaaggaccacaaacaattgaaatcatgatatcgtaagaaatattattactaacaaggaagatcattgaattacgatcgcatatcgaaatagaaggtgttgtcgtcgctaagaaggatttcaaccaagctaagcacgaagaaattgataccaagaacttgtatgttatcaaggctttgcaatccttgacttctaagggttacgttaagactcaattctcatggcaatactactattacactttgactgaagaaggtgttgaatacttgagagaatacttgaacttgcctgaacacattgtcccaggtacctacattcaagaaagaaacccatcccaaagacctcaaagaagatactaagtgcgttgttacgtttaagtaaactattttctatttaatattagactattctttattttgttctctctcgtaatatatgtggttttatgcatcaaataagtttttatcactttatttccttttacaatgtgtattattgtaaaatactcacaatgtaatctattttttcaggatgtgttacgatgcagacatgttttgtgcatgctctttagcattgttgtgcattttagattgtcgtcgtttgtttctgtatgtggtgtacggattatgtgtaactgtattaattgttcaagattcattcataatattaactaatgatcccttcaagaacgcgccatatataaaatattcaaagttaaaccttccaaaaatcatagcgtttcatctataggcacagcaaatcatgtccctgagctcctggaggcaattccagcttttcgagaatattcccataagagatcctaattttggaggagattccctattgtactcggacccaacactttgcgcagctacaatagtagatcctcaaactctgatcatagctgtaaattcaaatattataaaagttgtcaaattaaatcaatcgcaagtaatacatgaatttcaatcttttcctcatgattttcaaatcactttcctgaaagtcatcaacggggaatttctcgtagcgttagctgaatccattggcaaaccttccctaataagagtatataaactagaaaaactgccaaatagagaacaactataccattcacaagtcgaactgaaaaacggtaataatacataccctatttcagttgtctccatatcaaatgacctttcctgtattgtggttggattcattaatgggaaaatcatccttattagaggtgacatttcaagagatagaggatctcaacaaaggattatatatgaagatccaagtaaagagccaataacagctttattcctcaataacgacgcaacggcttgttttgcggctacaacttcaagaatccttttatttaatacgactggtagaaatagagggcgcccaagtttggttttaaattcaaaaaatggcctggatctaaattgtggatcttttaatccggcaacaaacgaatttatatgttgcttaagcaactttatcgaatttttcagctctagtggaaaaaagcatcaattcgcatttgatctatcgctgagaaagaggatattttgtgtagataaagatcacattttgattgtgactgaggaaacaggtgtaccaactacatccataagtgttaatgaactgtcgcccacaataattaaccgaatattcatcattgatgctaaaaataaaatcatttctttgaattttgttgtttctagtgcaattattgatattttttcaacctctcagagcggtaaaaacatcacttatctgctaacttctgaaggagtaatgcataggataactccaaaatctttagaaaatcaaattaacatcatcatccaaaaggaactgtacccttttgctttacaattagcgaaacagcattcattatcaccgctagatgttcaggaaattcataaaaaatatggtgattatctctttaaaaagggactcaggaaggaagcaacagaccagtacatacaatgtctggacgttgtggaaactagtgaaatcatttcaaaatttggtgtcaaggaggttcctgacccagagagtatgaggaacttggctgactatctgtggtctttgatcaagaattctatttctcaacgcgatcatgttacccttttgttaattgttttaatcaaattgaaggatgttgaaggaattgatacttttatccagcatttcgatagaaaaggcatttggaatgaaggtgttgtgatggacgatatggatgatgtgacgtttttttattcagataacgatttttttgatttagatttaatcttagagcttatgaaagagtcagattttaagcgtctctcatacagacttgcaaagaagtattcaaaggattcattaattattgtggatattttattgaatctattgcataaccctgtaaaagccataaaatacataaaaagtttaccaattgatgaaaccctaagatgccttgtgacgtactcgaaaaaattactggaggagtcaccgaatgaaactaatgctttactgatagaagtatttacagggaagttcaaaccatccacttttgaagtggatctggaccggagagatacgacgggcgatttttctgaaaatattagaacagttttttacagttacaaaacattcttcaactacatgaactcaaatggtacatcagacgcaatgagcgagtcttcagaggcatcccacgaacatgaagagcctacttatcatccgccgaagccatccattgttttcagttcattcgttacaaaaccttttgaatttgttgttttcttagaagcctgtttggcatgttaccagcagtatgagggttttgacgaagataggcaagtaattttgactactttatatgacttatatttgaatttggcgcaaaatgatgtacccgagcgtatagacgactggcgttcaagagcaactggcgtattgcgtgagagcaataaattggtgtattctgccgcaagtaataatactagcaaaagggtggataactcaataatgctgttaatttcccatatggatcaaagtagtgcttcagcaaaagataagacgaaaattgacatagcttcatttgccaatgataaccccgagatggatttgctgagtacatttagggctatgacgttaaatgaagaaccaagtacttgtctcaaattcctagaaaaatatggcacagaggaacccaagctcttacaagtagcattgagttactttgtttctaataaactaatcttcaaggagatgggcggtaatgaagtactgaaagaaaaagtattgaggccaattatagagggggaaagaatgccactgttggatataattaaagcgctatcccgtacaaatgtagcccactttgggctgatacaagacatcattattgatcatgtcaaaaccgaagatacagaaatcaaaaggaacgaaaaactaattgaatcttacgataaagagttaaaggagaaaaacaagaagttgaagaacaccattaattcagatcaacctctccacgtacccctgaagaatcaaacgtgtttcatgtgtagactgacattggatattcctgtagttttttttaaatgtggtcacatttaccaccaacattgtctaaatgaggaagaagatactctagaaagcgagagaaagctctttaaatgtcccaaatgcttggtggacttagaaacctccaacaaactttttgaagctcaacacgaagtagttgaaaagaatgatcttttgaattttgcattaaacagtgaagaaggtagtagagaccgtttcaaagtcataacagagtttttaggtagaggtgccatcagttattctgacatcactatttaatgatggatcataacgatctattgtcgccgccgcgtcacaaatgcgccccgaacttgtcgcgaagttaatctgaaacatatatgttacctactgaaacagcgcatgttggaaaagacaaaggtgaagacgaagttgtatatttaagatagaccctttatacatccttttgaaaaaattattaatgtggcaaccgtcttttatttgacaaagtatcttttttctttgtgaaaccaattttaggttttcttgttatagtaagttcttaagaaaaagacaagaaaaccccttgcgatgtttaagacttcatataacttgtacgatttgaactatccgaaaaatgattcattaacgccaataagagactacaaaaatgactattttcataaaaatgatgacaaattaccagaaattgttagaaaacctacgagaaagttatcgaaacatgaaaacaaactcaacgataaaaaattcacgaataaacgaccagcaagtctggacttgcattctatagtggagagcctgagcaataaaaaaatttactctcctattaacacagagatatttcaaaatgtcgtgagactgaatttgagccctcagattcccaattctcctcacgagggatgcaaattttataaaatcgtacaggagttttacctctctgaagtggaatattacaataatttgttaaccgcaaataacgtatacagaaaggcattgaatagtgatccaagattcaagaataaacttgtcaagcttgattcaagtgacgagctattgctttttgggaacattgacactattgcgtcaatcagcaaaatactggtaacggcaataaaagacctacttttagccaagcaacgtgggaaaatgttggatgcgaatgaatggcaaaagatattcaccaaaaatgaggtacaacagcagctatattcaacttttgatatttcagaggcgttcgagcaacatttgttaagaatcaaatccacctacacaagctattttgttagccaccaaaaacaaatggaactatttactacattaaggatgaataagaatcatttttttaacaagtggtatgaatattgtttaaaagagagtggatgtataaagttagaggacatattgaaaagcccgatgaaaagactgactcagtggattgatactttggaaactttggaaagctgttacgaagatattctttcgccagaattgggcttgaaactaagcccgacaagaagaaaatattctttattttccaataagttagaaaccgaggtctccgagtataagagtaattccatgtataatttcagtttaaccccatcagagattatacaaagttatgatgaagatcagtttacacaccttttaaaacccccagacaaacaaaataaaaatatatgtaatgcatctcgacaagagagtaatttggataatagtagagttccttctcttctttctggatcatcgagttactactcagatgtatcagggctagaaattgtcactaatacttcaactgcctcagctgagatgataaatctaaaaatggatgaagaaacagaattttttacattggcagatcacatcagtaaattcaagaaagtaatgaaaggtttgttagaattaaaaaagaatttattgaaaaacgatctgtcaggcattattgatatcagtttaagaagaataaatgcatggaaaaaggtgatcgagtgcgaacgcccttctggtgcattttttgcgcacgataacttaatatcgaccatgtgttcttcgtacatagataaactgcatgaacaaaaaaatcaagtaacaattttgaaactcacagagctcgaaacagatgtgatgaacccacttgaaagaatcatagcccattgtactaccgttaaaagcaaactaaaagatttgcaagctttgaagaaagattacatgttatttttacaagaaaaaaaagcaaatgtgcgagatattaaacgtgacttgttgggaatgcatttccaaaacctgcaaaaccagatgaaaagggaattaccggtctttattactttgatccacgatactatcgaatgtatcttgttgaactatatcaaagtcttcttaaaatatttggaaatcattgctggtggaaaaaaatacctgcaaaaagatcttgaaaatatgtctcttaatgactctatagctaccggccaaattaaaaatcttgatattttgcagtgttattctaaatcacgatatatgacaaaacgcatggtaagaaaagattggcctttccctggagaccctagtggaagccgtgttgtcagaaaacttttcgaactttaacaaaagagtatatttagcttatagtttttagaatgttttgttttcttttttattaaagtagtactactgcgctggagcagtatatatgttgaactatagtcagtcacctataatttgtttgctggcgcgaaggagaaagaaaattttaattaattcatgaaaagccttaagaaaaagtttaagaggaaatgagcaaatagaaggcaaatagagggtgaaagcattatggccgacatcaataaatatattccgatggttgacgctattttgagcgtatccaaccccgatgaaataagcccaaaaagggtgaggaaagccctgcaaattctctattcagttaatttggattcacaaagaaagttaattaatgaattgattcttgagaggttcggcgatatacaagaaaacccaagagtcttaattccgaagaacgacctcattagtcgggatcaagaactatctttgaggttacagaaggaagaagaaagacccttgaggtctacgaggaaaaggaaaggtaaaagtgaaagtaaatctaaaaggaagaagaaaaagaatgatagtcctgattccaacagcatttccgtccgcaaagttctgttgtcagctcctttacaaaagtttctaggatctgaagaactgccacgaacgcaagtagtgaagatgatatggcagtatatcaaagagcatgatcttcaaaacccaaaagatcgtagagaaattctatgcgatgagaagatggaaccaatttttggcaaaaaaatgacgatgttttcaatgaataaactcttaactaagcacttgtttaatcccgatgaaattgtgaaacatgaagaggaacaaaagcaaacacccgaaaaagaaatcaaattggaaaacgaatctcttcccaatttaagcggttgatcttggctgtagcacttatacaaatttaatgattttttttcctctttgatgacatgtataaagcacactgcacctactgtattgtacttgaaacaggtaaattaacaattaatgtagcattagtaataaataatttcacttcacggcgttaaagaaatactatggcaaattcgatttgagaatttcgtcaaattctgatgatatcaattaatggcatattttttttattttttatctggagaaaaaaatgtaaaaatgacagcagcatcaacaatgaataaaagcaagtacaatagtcgtaaagatctatattaatttcatggcagcacaataatacacgttgtttaaattagttaaagtgtcactccttgcttatcgaaggaactatcgattcctaattatggcaaggcaagggaacttctacgcggttagaaagggcagggaaactgggatctataatacatggaatgaatgtaaaaaccaagttgatggttatggtggtgcaatttataaaaaatttaacagctacgagcaagcgaaatctttcctaggtcaaccaaatactacatcaaactatggaagttcaacgcatgctggagggcaagttagtaaacctcataccactcaaaagcgagttcatcgaaggaatcggccacttcattattcctccttgacatcgtcatcagcatgttcatctttaagctctgctaatacaaataccttttattcagtaaagagtaatgttccaaatatcgagagtaaaatctttaacaattggaaagactgtcaagcctatgtcaagcataaaaggggtataaccttcaagaagtttgaagaccaattagctgcggaaaacttcattagtggtatgagtgcgcatgattacaagctcatgaatatatccaaagaaagttttgaatctaagtataagctttctagcaataccatgtacaacaagtctatgaacgtttactgtgatggttcaagttttggaaacggcacgtcatcttcaagggcaggttatggtgcatattttgaaggagcgccagaggaaaatatttcagaacccttattatcgggagctcaaactaataatagagctgaaatcgaagcagtatcagaagctttgaagaaaatctgggaaaagttaactaatgaaaaggaaaaagtaaattatcaaatcaaaactgattcagagtacgtaaccaaattattaaatgacaggtatatgacgtatgataataaaaaacttgaagggctacctaattctgatttaattgttcctttggtgcagaggttcgttaaagttaaaaagtactatgagttgaataaagagtgcttcaaaaataatggtaaatttcagattgaatgggtaaaaggacacgatggtgatccaggaaatgaaatggcagattttctggcgaagaaaggagcatctagacgataatgctgttttttgcttggcttcttactggacctgttgtacctgtaatagaaatatatattttatatcttttgcatacatatacatacatcagctatttggttttttaacttacccgataactatctataagcgtgtcaccatgatatttgcctgaacctcgtccacagttgattgtgtttatttttacttttattcatagctatttgatttcagtttcagctaaacgttcagcaagatcatctacttgtacttctagcagttccttttcaagcctttccgtttcaatttcttcgagtttttcatcctcgtcctcgtcttcctcgtcctcgccttcctcatcttcactatcgacctcttcaaaatcgtcaacctctaaatcatcaaatttgctttggagcaaatctaaagcatcagaatcttcatctaatctgttaccatttatttctagcttttccaattcaggtaaatttcccttttccatagccggtaagaaggatacttcaatggtttcttgagccatttcattatattcgaatttcaagacatgcaaattggggaatttaacttcggtgaatactttaaagacttcatctgaaccagcagttttcaaaagacagtcgttcaaattcaattcaaataaactatccttccatgtaggcaaggccttagcaaggatcaaagaagcatgtttcgtgaaagtattgtcttgaagatccaagatttccaagtttttcaagtactgtaaaccgtaatgaattagcgtggcgacacctttaggcctaataccattttggtacagctttacgactttcaaaccttcggagtggcttttcaaacccagagctaagtagactgcggatccattctctaatctatttctaccacagataaaagtttccaaaaatggtttggaagcagctttcttattttgagcgagatgaaatagggccttaccaatcctttcaccagcaaaagggcccataccattgttacttaagatcaaatgtttgatattcacggcatgtgcaatgtaatcttctagtaactcgattgttcttagcccaaacgcattatcagaaaggttcacaatctccaagtgaggacatttcaacagaacaggcaataaaaacttcaacgaatcaacgacttcgtcaaccaacctcgaagtgtataagtcagcaaaatttacttcaaccaaagattccctgacctgtgtattttcagcgatgcatttagctaatgcttccgaagcttcagtaccgattgtattccctgaaaggtctaatttggtacaggttttcaaagctgccaattcttccaggtatggtttgatatcgtcactggttgttaacttgagtgccttcccagagatggagtaaacttgttcttcctcgtgctgaggaacgaagtgcaaggtagccatagctaaaaatctgtttcgaaagacagcctgttaaaatggcctatattcaccttttaccgtgatattatgcctttgatcaatatcttcctaataaatttttttccattaattgtcccacaacgtgcatagtgacatgcattccatgaccaaactaagagctttaaatcaaaagtagaatttgacattatgaaacaacacgacaacaagaaaagactagaggacttcacagaccattatgaacggcggaggcaagaatgttttgaataaaaactcagtgggctcagtatcagaagttggtccggactcaacacaagaggaaacgccacgagatgtccgtcttttgcatctgctcctcgcatcacagtcgattcatcaatatgaggaccaagtaccgctacaattgatggattttgcacataggtacacacaaggagtccttaaggacgcgttggtttacaacgactacgctggcagtggaaattctgccggcagtggattaggagtagaagacatacggcttgccattgcagcgagaacacaataccaatttaagcctacggcacctaaggagctcatgttacagttagctgcggaaagaaacaagaaggcattacctcaagtgatgggtacgtggggtgtcaggcttcccccagaaaaatattgtctcacagcgaaggagtgggaccttgaggacccaaagtctatgtgaatgcaccgcttatatatcataagtacactaaatcaagttcttccggaagatgcgtcatgtagaatgcataatagagtaatatacactaaataatgcgctagtcgtgtatcgtgatcatgttctctaatgttctttttcctgcctgccctttcctacatggaaagttagagaaatgagatctacacgataatgtagtaacaaatggacccttaaacatctcaattcatcttcttgagagcactttccgcgctgtattgatttttagaacgtgaaaaggataaactgaaaacttgaagtcctaaccatgttgtctcaaacctccataccggaagtgaaagaagacgtgataggctatgcgctacaccagaggagagccagagtgggacaattccaagacttgggtccgcctgatttaattactttgatcaaatcgttaccttcatcctcgagcacaacaactgctactgcctccgccaacgataacggagcaacttcaaacatcaatggacaagatcctacgaccatagttacggagttacattcccatgacaaattaaaggggcagatcggcactttcttttactgtatgggtatcgatacttcggatccaacttctattacaatctttgccaaaaagataaccgatcttttcttagacacgccccaaatttggtttggtaagaagaagcactttcacgtatcgaagatttctatcagttcttggaatgcgtttaggaaatatgatgttaacattatagttcacattccaggaactgtgcaaacctacattataaatagcgacggtgaacaatcgcaacttccctccgtggcagaagcgtcatctggccgcaactcacaggatttaaacgtcaacatgatttgggcggaaacgtttatgagtggtattgtacgtgacattatgattatgaaagataatcgtgcggatggagaatcccagaatttggtagaaacactaattttcaatccatttacctcgggtgagttggaagatgttgccaataactttattaaactgttccccttggtctatgaaaaaggtgtttatttagatgcacctactcacgttttaaatccctcgttaaccaataattatttagtggaaactttagtggaaatagttaggttaactaagagtttggaagcatgtcgtaaaatgctcaagaagttaatagaaattcatccagaagcagtaataatattaattcgtgtttattttgcgtgcgatttagagatagatgcagttgacctgatcaacgagcaactaaattccccctcttcgttcttagccgacgattcaaagactagccatatccagctaatcttcaaatccgaattattaagtattcaaagtgaattcttactggatgtcaagagagattacaagcttgctaaggaagtagccatggaggctgttaactgtgcaccaaacgaatttaaaacttggtatttattgactagaatatacattaaactaaacgatatgtcaaatgccttgctatcgttaaacgcctgccccatgtcacaggttaaggaaaaatacgttcttagaagaattgcgcctattacttcagatgaaaatcttcatctgccattaccattggatgcctcaattgaggagatttcgtcattgaaccccatggatgtccagttggagcaaaagtccgcagatccaaacctagtcaatctctctgcgtcaagtttaaagtctactttccaactagcctataaattattgacagaaattgtccaaataacaggatgggagcagctgttgaaatatagatcaaaaattttcgttatggaagacgagtaccaaggctccacttcttccattgatgaagcagaagttcgcggtaatgatatatccaaaatgagatcaaagaggctatgcgaaagatggttggataatctcttcatgttactatacgaagatttgaaaacttacaccgattggcaatcagagcaattgtattttgatgctcaaaacagtaaatatcacaaattaactgttgaatgggaattattcggcctttgtgcgaaaagactgggacatcttccagaagctgcgaaggctttccaaattgggctttcccaaagattttctccagtatgcgcaaagaatctattacagttttacattgacgagcataagcgtattaggagggattcagtctcagcaaactccgagttaacctcttctcaaatattgtcaagtatcaatgacatcgacagctcaatcatcgatctagtagtcaagatttgttgctggaatcatcgttggtacatcgagttctcaataatattaatagatgctctgagtgttgcagtacaagatatgggcattactaaagtacataatgaaattgcctctagattttctgacccagtagcccaattgattgacgataacattctaaattttctgaagaatttcacgaatgacactttcgataattagaaaaagatgaatacaatcaataaaaaggtgaaagaaatcaattaacaagaaacgggttatgtattttatgtatgatatcctggcattgtcatgtataggtcaccttcttggggaatttcccattttcaagttattctgcctctaatgcgataaccgtaatcttaaattgtttaatttctttttcacaatctgagccacgcccgaaaaaaaaacaatgtaatccgcgtaaagcgaaactgagtataacccaaaaatagaatgtaaattaatgaaaagcccatttctccaaaagatcagctttactcaaatatctaattaagtaattgactgtgtacattgtcctttatctcattttgaatcacctttattaatttttggttgttatataggacgaacaaattagaacgaaatcatatccagaacgcagatatgatcgtcaatattagtgcgaagatgatcttatcgatatgctttacgtttctgtcattttttaaagccactcatgccatggatttggatactactagcaaaacgtcaatttgtgatgcgacagcgttaattcaaggtggtatgctggattactatgagggtactagatacggtggtaccgttgggatgtttcagtcaccatactattggtggcatgcaggggaagcatttggtggcatgttggaaaattggtttctttgtgagaatgatacatatcaagaattactatacgatgcactattagcgcaaactggttccaattacgattatatcccgtccaaccaaacgatggttgaggggaatgatgaccaaggtatttggggtattactgttatgggtgctgtcgagagaaattttacagaccccggtgacggcaagccaggttggttggcaatggtacaagctgttttcaacaccatgtactcaagatgggattcagagcactgtggcggtggtctgagatggcaaattttcacttggaatagtggttataattataaaaatacagtttcaaatgcatgtttgttccagattgcggcgaggttgggcagatatactggtaacactacatatttggaggttgctgaacaggttttcgactggctagtggatgtcgggtatgtggttcttaacgatactgcaaatgtctttgatggtgctgaaattgatacaaattgcactgatattacaaaaattgaatggacttataatcacggtatcgtgcttggtggtcttgcatacatgtataatgctacaaatggaacaggtgaatgggagaccagtttgacaaaaattctaaatggtgctaaatcttatttcttcaaagatagtattatgtacgaaagcgcttgtcaagactatggcacctgtaacaccgatcaaagaacattcaaaagtattttttctcgtatgcttggtcttacaagtgtcatggctccctttactagggacacaattgatgatttgataaaaacaagtgctgaggccgctgcaaaatcatgtaatggtggtacagatgggcatacatgtggtttaaattggcagaaacaaaccaatgatggctactatggattaggtgagcaaatgagtgctctagaagttattcaaaatcttttaattcatgacaggccagctccatataaggaagataatggcggtacgtcaaaaggtgacgcgaatgccggtatgaactcatcgaccactaacgtgctacaaaacaatttaaacattaagaaaggtgatcgcgctggtgccgctatcatcacagcagtcatactgagtgtgctaactggtggggctgtgtggatgctgttttaaatgtgtcaaactaggctcaaaaaaattttattgtattctaatatttaggctatccttttctttcagtaaaaatgtttatgtgctacatacaaaacccttcatgatcaaaaactgattaaaatttagagaggaacaattgtttttaaaaaaaatactaaaaaacactcacgatgggggtcgaacccataatcttctgattagaagtcagacgcgttgccattacgccacgcgagctagtcatatgtttctttcgtctttttcatctgatgacattctagtggaacatttatggtaagataccgattccattttaaggatttctataccctcgaggagaacttctagtacatacataattttatagctttgaccaacaatggaatcccaaaaattatcaaattttttatcaaatattcaaatatatcaaatattctaatgttttataaacgttttatgaatgacatatatgcgataattatatggctaaagaaaatcaatgcaagttccatcatggttgtgtaaaaggaacgtttcagcttgtatctgagaattttcttttcttattcttttgtgagggatcttttaacacagattcactcctaggaatggcagctctttgtttggcgtaaaaatctaacatttttttgtcacgaagagcattttctgcagccctaatacccgcaattttgatatttctgcccacaccggtccctaaaactgttccatcacctactctgcactcaactatggaattaggatcaactgcagtgggtttttttacggtaacataatgtagacgtaatgaagcatagccaatcaaagagtaaagctgccttttagcattcatatcaagtttatccgtcttctccaaggcaacttgattacgggtagcctcctcaatgacaggtttggcaagctttcttaaccattttcttattttgggcaaattattccttggatcatcttccatcaagccgccaatgtaagcttcgaacacatctgcatacagttttagtttgccgttttgaaaattggaattttcatccttcaagtcaaaatttgtcttaagtttctcatggaaattgtacattattgaccattgtttgatctgttcgttgcttaccaaattcatccttaatgttgataactgaccctcgctgtaatcgggaaacttgttataaataattaatgtcataacagaatttaagatcgaatcgcctaggaattctagtctttcattatgtgcgttgatcatttctgatccagacaagtaaactttatcctttattgtggatttgtgaataaataccctggccctaatcgctaaatcttgaatctctggtaattttggaggccattttgttgccttgacgatatcaccagcctttgttgggtcatagctatcttctccttcgtcttcttcttcatcttccttttcatttaaattttcgtacacatttacatctattttctctcgcttttcccttttaacttgttctagcttctctaacttttccatatcagctttactgatttcttgcaatataggttgcttttgttcagtatcaaattcattttcataatcagtaatttctgtcaaaattgcgtcttttttaagatcatgtaaggtttttaattcagctgccagttttaattgataacgtgatagagaaggaagtatctgaacaggcactctatcttgattgttaacggcttcattgtaagctaccaaatttggtgaaagttcaattattttattgtaagactccaccaattttgtcacagcatgttctagttgaatcacctcaagatatttgtaatttgatatcttaaggttgcctttcaaaagcgtcttggtattgatattttcgcgctgctgtgaaccattttcgttatctagtttattatcattctgggttttctttttacctgctacttttgagcccattgttttgaaaagcttgtaaataggacagttttgctctcttctatatgcgcatttacttgcctcactttgatcgagcaggattctcctgagagtgactatatgacctgataatgagataaattttgcgatgagctcatgaaaaatttcagcatggtttagggccgcatttaaaaaagaaaaaaactcgtacgtgagaaatagtaccacatgtaaaattttgtaaaactgaagtacctatgcgatatttagtagttatttcaatacagtatatagttgcttctccgattcctcttcgtttctctcaagtttttcttctgcgcttgtcacttcggatatgtcttcctggaagtgatctaacttatgctctacttcatcatcgattttgtcatcttggcgcccattttccgcattcgcctgtgtatcctcttttgaattttcaaattcaggggtttcaaatgagatcaatgcgccaaaatagtttctaccctgtttcttggaccttgaatggtgattagggattatttttccgtaaacgtcgccttttaaattcgttatatcccaattcaagccggcaattttcagatcaggatatcccgtaggtaatccaatgtctttcatcttcatacaccatggtggtagttgaccttcgggtaaattcattatggcacgaagctcttggctaattctccccggtctcttatgatcaaccattcttttccagttcgtttcctcgaaaagattcctattttcataatagacgtcaccgaagcataacaaatggtcaggtttccagttggctcctatcttgaaaaacacatcgtgtaacttcttgtaatccaaatccaaggcgcccattttcggctgcactcttgctcttgaggcctcctttagtgacttttcatcttgaccatccagtccgctttgcggaagcgtcgatctcatttgttctatatttgtcttcttgataatgtcaggaagttcaaaaggtcttttacctaacagagaacggccagatagatattccttcttggactgccagtggcttggaacaggaatgacatttttggtgcacttaattgacgctagtaagcctggatatcttgcgtcacaatcgtaccattctataatttgaggatacggtacctggctttttaactgcgaaagtgaaggtttttcagtcttcctacgttttcttgccgatagatgctcctcaataccatccgagggtgtatcctccaattcatcttctgctgtatgctttctgttcataactgggtttttctcaacaataacgacatgattgttcttttcatctttcgtgatttccttcggcgtatcattctcttgcacttgaaatcgttgtaaaacgtctttgaactctttttctaacttcgcatccactaccttattcgtctttcctttgctgttagtcaccccaccctttttcttttgctcaagccttcttgcatcaatcatggcggcgatctcagccttattatttaccacagacgcattcttattttggttatttccggaacgcttcctacttttggttctagccatttcaccactatctttatgatctgatgctctgcctatagatatatactctgtatgctactgccttcttaatacctttctaaacaataccaatatactgtattggatttctatatggttgaaagttattattcttgcaattatagccctgtaatgaagctgcgtgattggacctgtgccctcttcttccattacttaccctatcacttttctttctcaagacctaggtcctgtcggcaaattccgctgcaataacgcgaagatcatgacttttttcactcagaaggcagagaatcacgattgataaagatcacgcaaaaaaaaaagatgattggctaaatgcatagggcgacaaacatgggcccttcttttgcactcatgttttagcttcctttgtcccattgtgtaaacttatgacaagatatcgcactctaaaaaaaaaaaagaaaaacgcattagcctcttgcatggatcttaccttctgtaacatttatatatctcgagaaatctacggacatttaaaaaacgctgtcaatacaatcttctagatattcggatttgaattttgcaaaaagtccgaagctgcccacctcaagtcattgtttcaactcgcttacggtatatatatctactttcattgagatataaacagcgctgatacaatctttttatataagtcttttgtacaaataaagctaggaaaagcccgacgtcattatagctatgccatctaccactaatactgctgcagcaaacgtaatagaaaaaaagccagtctcgttttctaatatcctattgggtgcctgtttaaacttgtcagaggtgactacattagggcaacctttggaggttgttaagaccacaatggctgcaaacagaaacttcacatttttagaatctgttaagcatgtctggtcaagaggtggtatcttgggttactaccaaggtttgattccatgggcatggatcgaagcctccactaaaggtgctgtgttgctgttcgtgtcagctgaggctgagtatcgtttcaaaagtttggggttgaacaactttgcctcaggtatattaggtggtgtcacgggtggtgtcactcaagcctacttaaccatggggttctgtacctgtatgaaaacggtggaaattacaagacataaatctgcctccgcaggtggtgtcccacaatcttcttggagtgtgttcaagaatatttataaaaaggaaggtattagaggtattaataagggtgttaatgctgttgctattagacaaatgaccaactggggttctcgttttggtttgtccagactagtggaagatggtatcagaaagatcaccgggaaaaccaataaagacgacaagttgaatccgttcgagaaaattggtgccagtgctttaggtggtggtttaagtgcttggaatcaaccaatcgaagtcattagagttgaaatgcaatctaagaaggaagatccaaacagaccaaaaaatttgactgttggtaagacatttaaatacatctatcaatcaaatggtctaaagggtctttaccgtggtgtcaccccaagaattggtttaggtatctggcaaactgtcttcatggttggttttggtgatatggcgaaggaatttgtcgccagaatgactggtgaaaccccagttgccaaacattagcgtgtattgtactataagttttttttaaaaaaattaattatttagcttagtcattttttttttttctgaggatattgctcttatgctggggtgcttcctatttgtctcaacttgttctaattgtactaaggttatcagctatttacttcatgcaaaccttaatatctatagattctttgaaaggaagccttacccatttacctctggccgttcatgaaatgttgaaattattaaattctacagaattgataatacataaaaataaactattaaagtatcagaaaaatattttatatcttaaaattcaaatatgcacagttcagtagaaagtggaaggtctcttgtaggagaaagtcttggtggatttttggactctgtgaggcaatgggaatttcaagtccttggtcaaaaattgcttaacgtattgtctcttgacgtcagcagtcttttcaatttcagcaaccttcaagatgtgaatagatctaaatctagctctgtgtctggcagccatgtcttggtataaggtttcgacggcagcaactctggagacgtctctgatttccttgtacatattgtgagtaccagatctggagtcgtatctaacccagacaccgaagttcttgaccttggttggatgagcttcgttgatttggttgatggaaacaatttcaccagaagccttcttaaccttgtgcaacttttgcaagaaataccagtaacgagacttggcaataacttcatttgaagcaaagattctcattctgaacaactttggttctggaacagattcagttggcaaacgacggccaataacttggtattctttaaagtgagccactgataaaataacaaggattttcatgaaaaatcacaaatttgaatgttagtatgaagtccatgtgacacatgagaaaagggaagcttttatggaggagttattatcacattcgcaaggtcaggtaatagccttttagacatttgaaagatccatgaaagtttaactcaggtgtttcgtcattgaaccaaaaagaacctatacacttcttttgcaatcgtatttctaggatggatgggatcatattattcagcatggtacaattaacgtcgttcatttcttttcggtcgtaacaaactcgctgttttccttgacatatttagagtgtaatcctagttgaactattttagtggtgatagtagcttaagttttaaacgcagtgtggtcattcatttcatgatcgctccgagcctagttctgcgatgtagatggcattactcttccatttttgtggcatagtttagtaggtatttactcactttttccgcactgtttttccttaaaagacttgaggaactatatagatgcttatgattgtccaaattcttcaacctcaatgtttaaaatgaaatttggcgataccttgccacggtcagattttggtacaggagggaacaagcaggcgcccggcttagagttgggctaagagcatcaaatgtgcgctggattctgcctcaatgcacttagtaaattgcagcagggtttagaggggaacgcttattgagaagcggtattcctgggctggtaccacaccgaagtgagcttaatttgtttcctgctctgcgcgcgctgaaaaaagttaactatttgagacataaaaacgctattctggatgtatgggggtattttatgtttgggttaaaagtctcaaaaaaaagatgaggaaggattgtggcacatattgcatacaaatttttaatggagatttatagctaaaagatagcgtattcatacattgaataacgcagttcttgagttaggaagaactgccttcttcctatacgtctaagaattaattatgtaaatagtatatagtttatgttctctgtagaaccatgggataaattcaccgacggcttcagccctttatatctttattacaggcaattggaagtattgcagtttacagcgtcatctacaatacaattagatgatgctgtagtagcaccataggcagtaggtgaacgcttttttctaccatgctcagtgtttccatggctgtcaaaggcttcttgagacgaagatggtgaaccacctgctatgatagaaaatcttctgcgaatatcctcattaacatctccagaaacaaattctggttgaacagttgcagaatgaataccgtgttgatggaatatttttcttatcagcttggcggagctcatgaatttatcaggtgcacagtctatttgaacgtggatagatgcaatatatattgattcagttaagttccagacgtggaagtcatggaccgctatcacgccaggtactgccaaaatctctctttgaatctgatcagcagaaattgtagaaggagtagcctgtagtaaaattcttgaagctctacgtgataagggcagagcggaagagaaaataataatggtgatgattaaagaaacgattggatccgagtaatatctccaagaatattcagttttccaaataaacaaagcagctgcaataacaccaatattacccagagcatcacctagtacatgtaagaagacaccatgcatattcaaagagcgatgacctggtttcttcgattcatggctgtggtcatgatcatcgtggttcaataagggttggctttcgtttgataatctgtttactactgattgtggcaacacttcaccaatttgccctgagggcccaggactcgaaatagcatcttcatcgatggccaaattatcgtttggaagagatgcatgagagtgggaatgagtcgcattagattctatgtccaaatcgttattcccgctttccacagagccatgagagtgtgagtgcagactatcgctgccatgatcgtggaacaaaaataaacctacgacattagaaattaaccctgctacaccaacgtataaaaccaaccttgggttttgaatttcttgaggttcaatcaatctttgtaaagcttcaatcataatagagaaacacagggcaataagaaaaacagcattgattaaagcacccaaaatttctgctcttttccatccataagtgtatttagcgtctggacccctgtttttggccacatccacagcccatagtgccactaaaagagagatgatatcattcaacatgtgaaatgaatcggcaatcaaggccaatgaatgtgacatataacctatggtaatttccaataggaaaaaaaccgtgtctaaggtcaaaagagagatgattctcaattctttaccggtgatcatgactctattagtttcctggtattcctgacggatatcgatagggaaaaattactgcgccaagccctttaaagtatcttgaatgttatattcttttatgaaactttgagctctgatgactttgcaatgaaaagttttagctgatgcagcaaccacctcattcctcaccttcaaggccatctgaagaaggaaaacagagggagggacgttatttttcgcaaacaaaaacggcattttttttcttttgaaaaatgaggttttccgagggtgtgtgggtctatgccaagaaatcatattagagtttttgtttctttaaggttgaccagcaaaaacaaaaaggagtcaccgtttatgacttccgttatatgacatatatattttcggcgtaggtagggaaagacaaatgcactcactacgctgcgtcatgaagagaaagtagcaagaattttttttgcttcctgggaagtaggctcagctagtaaaaagggttgtagaaaggaagtctggctgaacttagccagacgccttccccttagcagaatgaatactgtagtccggagatacatcaagagtccagaactcaacgcaaaagtttatctcatgggacctgcaccgatctgcaaaccgagataactttctttttatgtagtaaagatctcagtttttttttttttttttgaatctgtaaacctaccagtgccacggcggtagtttcttttttcaagtggaagtgctttagtagcagcgggtccgcaaagcattattgtttcttttttttgatttcttcttatttcttatttcttattctttttcttattctttttcttattctttttcttattctttttctttttctttttctttttctacatcatcttacttagctactcagtcgatttcatgggcgatgtatcggtgaataagagaacgatatttaatttctttttagctagttctctttttttcacctataaaaatgcaactactttcatatcatttcctttccctcaaacaggtgagataaagataggactcttctactaaacatatatattactgaacgtcccaatcgaatatcgagagaaaatggtactttgcaaattactgacaccatatttcttactgtcaattttgagtgtcggcgtgttcacggcgaccgccgcgccatcgcccagtattcaaatgacggaaaatacaaatcaagatcatcatgagcatgccaagcgtggaggaacgtgtgcgttccctaactacgatgggatggtcgcagtacaaaaaggtggatctaatggaggatgggctatgagccctgaccaagaatgttcctacggttcatggtgcccttacgcttgcaaaccaggtcaactaatggggcaatgggacccttcggctaccacatactcttatcctaaatgtcaaaatggaggtttgtactgtgattctaacggtaacttgcaaaagccaaacagtgataaagactattgttatgatgggaagggaaccgtaatagcgaaaaacaacgctaacagcggtgacgttgcattttgccagaccgtgcttccgggcaacgaagctatgctgatcccaaccttagtcggctctgggtcaaagcaaacgctggctgtgcctggtacagactactgggcctccagcgcgtcgcattactacgtaaatgctcccggtgtaagcgtagaggatgcatgccagtggggtagtagtgcaaatccacaggggaactgggccccatttgtagctggttccaacatggacgacaaccagaacacttttgtaaagattggatggaaccccgtctacctggaatcgtcatgtccgttcaagaacgttaagccttcattcggtattagaattacttgtgatgacgaatcacaatgtgaaggcctaccatgctccattgacccaagttctaatggagtcaacgaagtgacaagttctggcggtggttcttccggggctggtggtggaaacttttgtgttgtcaccgccagaaacggcgccaaggccaacatcgaagtttttgatgttggtagcggctcatcttctaaaggcaagagagaactgaatccgctagacgttattaccacaacggtcaccgagaccaagtacaagacagtcaccgtcactgccaaaacttagcgcggttttttctaccttcccttttttcatctttttgttatatatatatacagagacactcatgcgaattttcgcaaaacgaagaaaaaaacataaaattttcgtttgtatctacatgactatcctttaattattacctttctgtcaaatgttttatgggaatatatatgttaatatgagccaataactcactaaaaactcactgatttcgttccctctgtttagcttcctgctcgattctcttgatggtctgctctctcttaaagtcgatgaccctcttctccttgaagtacttgatccagctatgggcgcaattctcctcaaatttttcattttccaccttgcagtgcgactttatactcttgctattcttggggtccattgcgtccaagatgtctgccttgtccaaacactggaagaatgcgtccctggactcccagcacaactttctctgtgaacgggtattagggggttgtgattcctttttgccaccatcaaatgaaaataagcccatcgctatattactactattcctttctgtatattcgtgtatctatgttcctgcgcagcgctacaatagtacccgtctatgtatgtatgtatgtatgtatgtaggcgaatcttctcccccattctacaaagcagcacctaccaccgcagcaccgtttcacatgtccgtctcttttgttcagctcagctacaatcgtcaatcgcactttcttccgcgcgggcgagcccggttttgttggatttgctcaggtgccaatataccatcaaggaacggacagggacctgacaatacaataggccatttacatcacaatgcacagggacagaaatttatacacgataacaataccaactaaacaaaaatatctcccgagccgatgcttattccgcgggttcgatgccgaaataattgttgcatacgctttatccaacacgatggagcgtgttgggcgcttaaagaagagactcactaaactgttcggctttttggctgcgcgtctttgccgtttcccaacaaaaaacaatcatacttagtaacaagaaagacaaaagcgcaaaccgaaccgcccagctcaaccatcttcgccaagtagcggcaaacttatataagctccaacgatgtccccatcaattaagaaccctcgattgtcggcgatctatttttctattctgggtgtttctcggccttcgttcatctcgttctttctactcttagccctcatctttctcttctgcattcttttcacctcattaagaacattcgcggcgccgctttaccccaacaaaaacagcccatcttttgttctacctctttcagataaggctcaacagatagacaataactgatcattctttcttttgtttgcaacccctctgagttgacataaaagcgagaatacaaaagaaccagcattagtaacacatcatttttttctctgttcttcactatttcttgaaaaactaagaagtacgcatcaaaatgaccgaacaatattccgttgcagttggcgaagccgccaatgagcatgaaaccgctccaagaagaaatatcagggttaaagaccagcctttgattagacccataaactcctcagcatctacactgtacgaattcgccctggaatgttttaccaagggtggtaagagagacggtatggcatggagagatattatagatatacatgagacgaaaaaaaccatagtcaagagggtggatggtaaggataagcccatcgaaaaaacatggttgtactacgaactgactccctacataaccatgacatacgaggagatgatctgcgtaatgcacgacattggacgtgggctgataaagattggtgttaaacctaacggtgagaacaagttccacatctttgcctctacttctcacaagtggatgaaaacttttcttggttgcatgtcacaaggtattcctgtggtcaccgcgtacgacactttgggtgagagcggtttgattcactccatggtggaaacagattccgtcgccattttcacggacaaccagctgttgtccaaattagcagttcctttgaaaaccgccaagaacgtaaaattcgtcattcacaacgaacccatcgatccaagtgacaaaagacaaaatggtaagctttacaaggctgccaaggatgctgttgacaaaatcaaggaagttagaccggacataaaaatctacagtttcgatgaaattattgagataggtaaaaaggccaaggacgaggttgaattgcatttccccaagcctgaagatccagcttgtatcatgtacacttctggttccactggtacaccaaagggtgtggtattgacacattacaacattgtagctggtattggtggtgtgggccataacgttatcggatggattggcccaacagaccgtattatcgcattcttgccattggctcatatttttgaattaacctttgaattcgaagcgttctactggaatggtatcctagggtacgccaatgtcaagactttaaccccaacttctacacgtaattgccaaggtgacctgatggagtttaaacctaccgtaatggtgggtgtcgccgcagtttgggaaacagtgagaaaaggtatcctggccaagatcaacgaattgcccggttggtctcaaacgcttttctggactgtctatgctttgaaagagagaaatataccatgtagcggcttgctgagtgggttgatcttcaagagaatcagagaagcaaccggtggaaacttaaggtttattctgaacggtgggtctgcaatcagcatagacgcccaaaaattcctctccaaccttctatgtcctatgctcattggatatgggctaactgagggtgtggctaatgcctgtgtcctggagcctgaacattttgattacggtattgctggtgaccttgtcggaactattacagctaaattggtggatgtcgaagatttgggctattttgccaagaataatcaaggtgaattgctgtttaagggtgcacccatctgttctgaatactataagaatcctgaagaaactgctgcggcctttaccgatgatggctggttccgtaccggtgatatcgctgaatggacccccaagggacaagttaagatcattgatagaaagaaaaatttggttaagaccttaaatggtgagtacattgcattggaaaaattagaatccatttacagatcaaatccttacgtccaaaacatctgtgtctacgctgatgaaaacaaagttaagcctgtcggtattgtggtccctaacttaggacacttgtctaagctggctatcgaattaggtataatggtaccaggtgaagatgtcgaaagctatatccatgaaaagaagctacaggatgccgtttgcaaagatatgctgtcaactgccaaatctcaaggcttgaatggtattgaattattatgtggcattgttttctttgaagaagaatggactccagaaaatggccttgttacatccgcccaaaaattaaagagaagagatattctagcggctgtcaagccagatgtggaaagagtttataaagaaaacacttaaaggaagacatagttttttactttcccccctgcccttcataaacactacgtttcattttctaagagcatcaatttgcaaacacctgaactacttgcacaatacatagtttcttctcctacagatacagttaataattaataaataacattacacataaacatgtttaagtttcatttcagcaagacaagattgacattattaagcgtgatctaaactatgaatttctcccgggtatgaaactacattctactattgattttaatagatgagcgattaaacgggatatttgaatttatgacttctgtaaaccatcgaatgccccaacttttagtaatcaaacatgcaccgaaaacaaccatatcaatcaatgtcttgcttcattcttgatttctcatctctttctttccttcgtaatttcaccttctccctccgctccttttatcgaagaaacatcgtattacaattaacaacgcattgcactatagtacaccaagtttgaaaataaaaacctcgcccacgttcatttatgcaacaagaaaaaaactcccatcacagttagaaagcaatgaataaaagccatgcgtaataaatacattcagagaggatgacgataaaaaaagaaaagaaatcacgaggagagtaaaccaatataaaaagaacaaattcaaaaaattttcttataataaaccttaacatggagtttccgttaacacactatatggaagcgaaacgtgtgaatcaacagaatcaaccacagcatatcataaacctgaacatagacacgactgaaaaactcaaacgtgctataccgccaagcagaaaatccatttgctcctactttattttctacgtctccttgcaatctccgttccattttatcatcctccctcaaactgaacacacccctccaccaggattaattcatagcttccgtcatgctacctgaatattttagggtccggtcacttaaaaatgaacgcgttcatagcaaggcacatatatccaaagttaaaatgaacaaagtgcatcgcatagttgtatatgcaatacaatcaaatttcctcaaataaaaagaacaattgagagaatgaaaaaggaagaaaagagtgataatttgagaaaaaaatagctaaacaaaacgataaatgattttgattgaaatatttcggtgcagtccttttccgaaaattggggacattcaatagaatttcatcaatggttatccctcttttagtagctaaaaactgaaaacaaggcctgaactaaaaaccattcttctttcaagttcgatttttatcctgaaaaaatcctgaagagaaaaaatttccagaatatccgggtgatgggctggattggcaaggtatagggctggattgtataatttgtaagagagcacaataataaaaggaactttgtttaaaaaatgtagtacatttatatgaaatttatatgcgatagtctaccttctaaatggaatttcactacggcataatggacatgtattgttacccgatgatcgaaaccacttgtaaagacatgctccgtggaacttatttttacaagtcggacatgtcttcgaaggtagtttcctatccacggcatgtagtatagagtaacatatggcacattcctcgaaaccagaaaattgtaagtgcacatttttagtaaacaactccaacgaatccaaaacggatccattcatgcctgtaattacatgttgtgtagacattatccattgtttccatttttgttcacttataccaactctagagacgccattaacttggatatttgttaaagggtagttttttggtagtttgaaggaaatctccaacttttggtcgtcaatcaaatagcttgccttcacttcattagtaatattatttaatttaatagtcaaagcatcatcattagaagtcaggcggtccatcttagaattgatatcgtcaaattcatttttgatcaaaattggggagatgaactctgagacaaacttttcaatatcattttgtaatgtcctatcttttatatttaaccaccaaatactcgttagacaaccgacgttgttaaacaactgataaagtgtatggcccaaaagttttttacattcttcaaatatgtcttctttataaggagagaaattattgccgacaatgttgtattccgaaatttccttggtgtcgacctgtttccaaaactcagtatctcttaaatctatttgatctgttatgaaatcaaacattctattgattaaaccagcttcctttaattgttcaataaatatttgtctcatattataagacgtatctttgaagtacatcagtatcaagtgccaataccatagatatttaataaatgaatttttattctcgtattcaaggtattcttttggcacctcatcagtaactttttgtaataatttttgaggtagtttaaattttgagtttacatcattatcagatgcactaccatctacgtctgagccagtttgtttttgaatcctcagttcatactcaattataatatcctgctgtgtttttaccaccaaagaacccaacaaagtagttaataatcttgattgattaatattactaccgatatccttatcattcaatacaacctcgaatattcttttgtattgagattctaactttttgagttccattgaggaaatgaccttgtacaatttctggtagaagagtgtggatacttggttatttctttcttgattaaagttgagaaacatcagttcaatcaaattttcttgaatttcatcaccatattctgagatttcctcgccatttttggaaacgccttgcgacaatgtttcatataagttcaaacaggaagagcgaagttctaacaaatataaagtgtcatcaatttgacacatcgatagagagtctgccagcaacctttccgaaagttcaaaagctgttatgcccatatctctgactccttcaaacctcatcagtttggtgaaaaaatctagtagtaacaatctaacggtgctaaagctaggctcgtaggcaagatcactatccaaccattttagtattgaacggaatatcatgttcagtctctgcggtgctataggaacaaactgtttatctgcctgtgggatatccagcagattatttaaaagagctaacgacttgaattcttgatcgacaagttctacttctctaatcccaatcaattgagatgccagcaatgtccttaatttcgttatctcatcttttgagttggacctgttaaacatcaatagtaatatagcacataggagataatctttatcagtagatttttgatccctcacagttttcgtgacaaaactttcaaccgatgctaatagcccatttaatgtggtggatgaaacagtatcaatgctgttcaatagaaccttatataatactcttgaataataaaaaaagtagacagaattactttcagcaatatcaaaagtaagcatagcatcaccaccattagcaggctgaataacgtttccaacaatatcagaaaagttcaaatttactttgccatgtttgaaaaaggtatgcccaaaatcatagtaaagatcatttggttcctctgaaaggcaattataatcagtgacgagctcagaaactacagttataaatgcaacaatatggttattaacgcgctctggaagagcatcaagtagggcatctaagaatagagcatacctgatgagcttttgcatattttttaaattgataggcttatcatctgtaaggagcaaatgcgtgttagtacttaagctgctcactaaggatgacctataatcaattgctggcatatatctggcaaaaacttcgattgcgttagcgggaaaaaaaatctgagaagtatcgttgcagccattaattagctccacggcgtgtgtgacatatttttcttttgccccggggctgaaataaacctgagcatgttgcaaaatcacttgggccaacttattagcgatttcagaattccctttagccaactgtaatgacaacttgaatagtttctcattagtgtcttctgaaacttcatacaatgcacaagaaagaaaatcggtattcagcaataacgttgaaaaaaaagtttcatctaatttagacaaaacagcacaaaattgttcaacttggccattggcaactgcgcttcggtaaagtgtggtgatagtcctttgatttaaaaatttattattacctttaaatatttccccactgtcgtcaaacttataatttttcataaagtcttcaatgtacaattctaattctagggaatctgatttcattaattgttgataaatatcattgtccaactcattcattgtggctaaaattattgtctttggtaagttaaaagaaagcgcaacgataaaaaagtcttccaacgaagtaatcgcgtcagtattcattttgaaaaatttggagtttgagtactgtgccatgataccagcaaagttttgatatgttgattcttggaccaacgttggaatttcgtttataaatttccctatcttcccattcaagaaaatcatatctgaatctaaaaagtaattgagagcatcatatacaccgtcgtatttgttgaaaacatttgagggatctgtttcgattaattgcacaaaaaaatcgaataaacgactaattgcggattcgttattaggagaagtaaccaataaagcaaaaagattcttctcaaagctcacctttatttttcttatgtcttcgtctgaagtgaagtaatcttcaatctctctctcccatttatcgggtggaaagacgccactaagagtctggttcagttttgtgtactcagataaagatttcccgcaagacagagagttaaaaatctcactttccaccatttttttcactctttcttctgatgaatcctcagcgaacttcaaaaaatttgtccaaaactcattaagaacctcagcgctgtttctcgcagaaaagcccttttcattcagtctttgcaccgatttttgccaaaatggaagccattcaagataataatcaagaaaactgtgtcttttagtcgagctgtacaatgcaaacacagcattgaaaaatcctggcgatggtgaagtacgggaaaccgataaaaatttgagtactttttctttagaagatttatcgtatgaccatattgtcccatcttcatagtcatccaaggtagctaaaaggttcagtattgatgggagaacagggcatacttttagaatattctttgacgtaatatgagtcaacgatttcaatagttttttcaccgctaacttcattatatttttgtgggaaggcatgtaacctcttgtataaagaacatcaatcaatcgaagaactgtttcgtaggcatttgtattttgcccattttttaagttaagtagtttccagattgactcatcagaaagaatcaccttaagactggaagaattacgttctgagacgtctttgttatgaacaaaaagcttaatcagcagcaatacggcacttgctataactctgtggtatctaaactcagattcttctttactggagtaacgttcatcagaaatggtatcttcattctcgtttacaacaatctcctttactaaattcaatagttgttcttgaaaaacagcccataaggcgttaatttttgctgggtctttgttgaaacactctgttaattcattaagagaaggtttggaaacactataatcgagttcgcatgtaccgagaagtatcaaaggtataaaatcctttaaaaacttcgatattttcttccgaaggcttttgacaagcattatagtaatttgatgtgattgcagtctgatgaccttgtaatcactaattatcagtttagcatatatctgcgaccaacaaagaagaaaaatgtcattgaaaaagtactcattctggttaaagtcgctgatcaaattggaaagatccattaaagctttttcttttgtagtttcatctcttttcagaagagatttgaaaatgagtttcagctcgttcgagtacaaggagtttaaaagacttggatccggcaaaccatcaaagtagtttaaggatattctaacaccattatggccgagccctaaatctgtgttatactgttgaaatgtattgattccaccaaacgacattaagaaccaactattgcttgaactttttttgatggcttagcagatttgaactattaagaaggacttcttcagtattgtatatattgaagaaaaccatctgaagttgcaacatttgaatttttcctatgacgttttttttcctcgcttcatcaatatttttcagttttccatgttggggcataatctgggttaactcgaattgacaagtatatagtcaagctggaggtaagaagtacgtaacatttaaagagcattgtgacgatattctgttcttgattaactataattttaaatatgaagttacactaattgcaaagtagcaaaaaatttggacgagtccggaatcgaaccggagacctctcccatgctaagggagcgcgctaccgactacgccacacgcccatttcttattgtaatttctagccactgtaaaaagtgaaatcagtttaaaatggaagtgtctatcaaaacttactatccactatcaagtaattactcatgattgtcgtgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattgcagattcccttttatggattcctaaatcctcgaggagaacttctagtatatctacatacctaatattatagccttaatcacaatggaatcccaacaattacatcaaaatccacattctctacatgtcggaagaggaaccacctaccccctatagtctagcatccatcttattacatatacgacgtagaaatatggcataaaggtaaagatttaaaagctgccatcaaatttaatgggggtggaacgcacgacttgataatgcaataggataatgagtgacaacatataaagtggaacgagaaaccataatattattatgaagaatcatcgatccttttatggattcctatattttcgagtaaaacttaaggtatattcggtataagataatgttgtccaaattgtattgttatggaaatggtattcaacaactatctcaaaagtcacctatttcccgtgcttttcgcattctatcacctgtattattatattgcatgatatcaaaaagatgaatcattcagtgtaaatggcacacaaatgtgcaagtgccaagctattgagtggaataatggccttgttatttaatggtaagagccttctgaggccaatctgccttcacgtacacaaccaccttgttagtaacagtgataccaacatagtttggccgtgaggctaaccttagtggtttattgcaatactcaatactgttcttagacaattatccaaccatcgccattaaatgataaaaaaataaattgactgcttaattttgctgatacaatgcactatattatcggctgatgtaatggtattgttattcaacctcctctcggcattgcaacatactaatagccaccctagggtgtcattagcatgcctataccgaggcatacgaaagcaactagccatcaattccatcaccctgtcattcaactccgcttcatgatcaggacagtttgcacgttatcagataaactatgataccgctattattgaactctctatgatattctatgagcgtttctattaaaaagcttgagagaacagtaggttccacttgagctacatctgggttgatagtagggtctgacattgttactgactgacattcgcataatttggtaccggtacaagctttggcacatgttcgtgataccttcgtctggtttattcattggcgccagttctcccattttggacgattcttttcaaacaaggtcttaggattcgacgacgtgctagctatagcacaaggccaagaattaacccaaaaactgtatattgtctctgcctcaatgctatccgaatatcaagcccgcaaatatggacagataaatccagtctaccatatagtactctggattcttccggaatcaactgctgactttctatatatgtagccgcatctacgtgttcagatagtttttatcacgcaggttgccgtttatactttgttttcttggaagtatctcgagtaacagtgatgctcagtctcgtttagaagagtgtaccttcccgggttcctaggcgctgatgctggtaaattctagttggttcttgacatttttcaaataatcaaatcatctcatttgcgatagcaaatgtacaacgtgtgaaagtaaagaagttcatagtatatgggctgttcaaattcttgttcactgcgtttataaataatctttctggcaagttagacaaattaagagcaagagttgcataagagcagcatataaatacacgtcaatttaggcattcttgtgattattaagttcatcagagtgaattagaaattcattattttactattttttttttttcacccttaacagcaaggttgaactctataaggaaaagggatagatcgtgcggcacaccagaaaaaggggatcagtaaagtgatgcaacataaatacatatataagagagcataattgaccactgaactgcaacgcactctctgaaatctcaccttttggcgatgctaaaatgtttcaagatattacacgtcgctcttaacaatccaggctgaacaaaacaaggaataatgttacacaggcacggttctaagcagaagaacttcgagaatatcgctggaaaagttgtccacgaccttgcaggtctgcaattgctttctaacgacgttcaaaaatccgctgtccaaagtggtcatcaaggatcgaacaatatgagagatacttcgtctcagggcatggctaataagtattcagttccaaaaaagggactacctgctgatttgtcttaccaactgattcataatgaattaacacttgatggtaatccgcatttgaaccttgccagtttcgtgaacacttttaccactgatcaggcaaggaaattgattgatgaaaatttgaccaaaaatcttgctgacaatgatgaatatccgcaattaattgagctaactcagcgttgtatttctatgctagctcaattatggcacgctaatcccgatgaagaaccaataggctgtgccaccacaggttctagtgaggcaatcatgttgggtggactcgccatgaaaaaaagatgggaacacagaatgaagaatgctggtaaagatgcttccaagccgaacattataatgtcttctgcgtgccaagtggcattagagaagtttacgagatattttgaagtggaatgccgattggttccggtatcccacagaagccatcatatgcttgacccagagtcgttatgggattatgtagatgagaacactattggctgttttgtaattttaggaaccacctacactggccatttggaaaatgtagagaaagttgcagatgtcttgtcccaaattgaggccaagcatcctgattggagcaatactgatattccaatccatgcggatggcgcttcaggtgggtttattatcccatttggctttgaaaaagagcacatgaaagcttatggcatggaacgttgggggttcaaccatccgcgtgtggttagtatgaacactagtggtcataagtttggcttaaccactcccggtctgggttgggtgctatggagagatgaatccttactggctgatgaattgagattcaaactaaagtacctcggtggcgtggaagaaactttcggtttgaatttttcaagacctggatttcaagttgtccatcaatacttcaattttgtttctctaggccattcagggtatagaacacaattccaaaattctctatttgttgcaagagcgttttctttcgaattattgaattcgtcaaaattgcccggatgctttgaaattgttagcagtatccatgaaagcattgagaacgattccgcccctaagtcagttaaagactattgggaacacccccaggcttacaaaccaggtgtaccgctggtagccttcaaattgtccaagaaattccacgaagaatatccagaagtgccacaagcaatcctttcctctttactgagaggtaggggttggataataccaaattacccactaccaaaggcaacggatggatccgatgagaaggaggtattaagagtggttttcagatcggagatgaagttggatttagcacagttgttgatcgttgacatcgagagtatcttgacaaagttgattcatagttacgaaaaggtttgtcatcatatagaacttgcctctgagcaaactccagagcgcaagagttcgttcatctacgaaatgttgctggcattggcatctccacaagatgacatcccaacgccggatgaaatcgaaaagaaaaataagctaaaggaaacaacaacgagaaactatagaggaacatgttgagttgaaaaggtcatccaatataccgccccctatatgtatgtacctttaccttttatttaagtactagtgctgtttagttaggttatgtgaaggcacgggttttgtctttttttttttttttttttactattactttctttttcaagcttttaagcgccgaaatgatatttaagggaagatgactaaagggacagcgacgaggattcagcctggacagtgatagaaaagttatgcgggaatacgtatatatagttgtataaattgtggttatagaacatcgcagcgcctttaaatatattgtcttttatttcaatcttattccatctctctcttgcaaccacggcaaagctggagctatgtctgaaaaatcagctagcaataacaaagctgaattcaaaaggcagtcatcgccattcagagaaatcatctctgcggatcacccaatttataaacctgctaagggaaggtactggctgtatgtggcgctaccatgcccatgggcacaaagaaccttgatcaccagggccctgaaagggctagcgcctataatcgggtgcagtgtagcgcattggcacctggatgacaaaggctggcgattccttgaagaaggagatgggaaaaccaatgaaaggcactggtttgacattgcaggcggaattagctcagtaaatttaaataccagtactcctgtggctaacatacccaataacgcgcatcggttgttggtcgacggaacagatgaaccgcattacgggtacaagagactaagcgacttctatttcaaaacaaagccagactataagggaagattcaccgtacctgttctttgggacttggaaacatgcactatagtaaacaatgaaagcagtgatatcatcggaattatgaattccgctgcgtttgatgagtttgtcggcgaagaataccgtcaagtccgtctggtacctcggtctctagaggcacagattacagagttcaactcttgggtgtacgataaaatcaacaacggtgtatacaaggccggttttgcagaatgtgcagaggtatacgagagggaggtaacaagcctttttcaatatcttgacaaattggaaaatcttctggacaagaagtacacagatttggaggcggagtatggtaagaacaacaaggacaagatactagatcgctactttgccatcggagacactctgaccgaggcggacgtgagactctacccaacgatagtaaggttcgacgtggtataccatcaacacttcaaatgcaatctggccaccatcagagatgattattcccgtatacacacgtggctcaagaatatatactggcgccacgaagccttccagcgcacaacggactttacccacataaaactcggatatactcgctcgcagccacgggtcaacccgattgggatcaccccactggggcccaagcctgatatccgacctccatgaaatttttttttttctttcgattagcacgcacacacatcacatagactgcgtcataaaaatacactacggaaaaaccataaagagcaaagcgatacctacttggaaggaaaaggagcacgcttgtaagggggatgggggctaagaagtcattcactttcttttcccttcgcggtccggacccgggacccctcctctccccgcacgatttcttcctttcatatcttccttttattcctatcccgttgaagcaaccgcactatgactaaatggtgctggacatctccatggctgtgacttgtgtgtatctcacagtggtaacggcaccgtggctcggaaacggttccttcgtgacaattctagaacaggggctacagtctcgataatagaataataagcgcatttttgctagcgccgccgcggcgcccgtttcccaatagggaggcgcagtttatcggcggagctctacttcttcctatttgggtaagcccctttctgttttcggccagtggttgctgcaggctgcgccggagaacatagtgataagggatgtaactttcgatgagagaattagcaagcggaaaaaaactatggctagctgggagttgtttttcaatcatataaaagggagaaattgttgctcactatgtgacagtttctgggacgtcttaacttttattgcagaggactatcaaatcatacagatattgtcaaaaaaaaaaaagactaataataaaaaatgaagttatctcaagttgttgtttccgccgtcgccttcactggtttagtaagtgctgctaacagttctaacagctcaagctcaaagaatgctgcccaaccaattgccggtttaaacaacggtaaggttgcaggcgccgctggtgttgctctagctggtgctttggcctttttgatttaaatttagactttgtttggaatacattgaaagagaaagagtggttaatcgggtgtagaaagaacaatccaaagtcacctttattggcgatatgtgtcattgttaatccattggccacatttttccgatgattttctctcggtgtgcaatatagtaataagttttcaccttttccggtgaataatgaaaaaaaaaaaacgaatacaaaaaaaaaagtaatttctttcaagtttatatatataacaatataatattaagtaattttaatcgaaaattttttcctctaaagaacccaaaaataagcaactattgaatgaatatctaaaatgatcggaagaaacggtgtgcgcggcggagggaagcgaaaaattgggaaacggaagcaatcacttctgtattaacaattgtttaaagctggggtgactgaacctactacccgatttcatattatcattgttagttcctaattgctcgttcttaaacgatttccagatatcgttataaaatatgccgaacacagatggcgagtcattgtgctcgtccatgccaatactcagccccttcagcgaaacattggtcttagaacttgggtattggtgcctgtagtttttgacaaaacgctgaataaactcttgcttctgggacatattcagttcgtgccattttttaaaggggaaacatgcctccttatcgaagctgagcgaagaagaagaaacaggcgtgtatatcgtgcttaaaggtttgaacccaattcttgttctgatgtagcttacgaaaactttaccaaacattaacacttcacactcgatcttcttcgttttgctgcttatatggtacttgctgaacgacgcgatgatccttttgttttgttttctgaatgctcgtgtaccccactttccctattgttctcttgtttcgtgtccttgcttcctcggactgcgcatttcaacatgacacaaaaaaaaaagaaaagaaggaaaaaaatcatagtagaaactgaggaattttatactcgtcttatttagaatcggataggtcaaactctgtcaggggaatagagttctcttcgtcgtcaattattggggttaggtccttggcagttgtttcattgtttgccgcccttatccttattacccacaacgtggcacttatgatgattatcataccaatccacgaccagatatttggccaatgcttgtacagtgcaacgtcccagaaaaccgcatatagtagttgtgtgtatgtcatcaaagaccctcttccagcacgttctctttggatacccatagttaatagcagctggaagataaagccggacacacccagattaccaaacagtatccattgttttttggaatgtggtatctggaatttcattgaagggatagtgttaatcccaatgaaagacactatcgctgtgatcaaagaaaaataactcacactcattatagcgtgagccctcttaccaatataacgaataatgatgtagacgcaactcatccctaaaacaccccacaacccaaccaaagtggcaatcaatctcgattttgggtccgatgattctactatttgagaggaagagtcggtcaattcgggagttccaaataaaaatgaaggccttacaattaacaccacgcccagcaatgagatcagcgaaccgagcgcttccactttggtgaatctttccctcaggataacccacgacaggaatattgttagtgatggtgccaaaaaagtgatcaaaacggcatcactaatcgtcaagtacattaacgaataatacattccaaagacaccgaaaaatccagtgcaacctctcaatactaaccatttgcgtacttcaggtttaccaaatggtacatccgaaattgtgctcttattaatatacatgtatatcaatgtaccaatatatgttattaccattctaactaataagatttgcaatggcttgatctgtctatcattggcaatatcatcggggtcgttttctaagactttagtagacaccaccatggccgagttgaagaaatatgatactgtcaagagaacaagcccaatatttggtttcaaataatctttacttattctttgcagcgttgtttcgttgccatcgacgttaaagtcttcattgctgtttgactctttcggtgaaagtgatctcgtagtagacggtagttgcaaactcgtatcattcatttctttagaaactagtaggtgtgtattgttttctcttttcataaccttcggtactgatggattcattttcttatctctatctattttcttcaccacagcaacaacaaattcatgcctacgaaaacttaagaaggaaaaaaaaggaattttactgaaataagaaaaattctaaagtagatcaaagaacatctcgctttccaattccacatctttgtccaaaatatccaactaccattcgcaccattctgcgatctttggaagggcccttaggagccctatcccttaccgttagccggtatctttttaccaaattaaggtgcatttcctagttaggaaaatgcctcatgacggtatctggggtctctacgtcaagtaaatatatgtcaatatatcgatgtgtcggcagacttgctggcttgcgcgagttaatgaagtaatagaacaagctttctgtaatcatcccgtcacttatgcttttgtacatatcgtgtcatactgcgactgtctcaaggaaataccatgataaaatatctcttacaatcgaaaaatctagcacgtgggagggtaagcataaactacccagaaacgcatgtatggactgcatttgcttcctgaccaaaataagtattatcgtcatataaaaaacgtgcatagtatatgtaacatcaatgatgctgggcgttgtttgccattttgtatttactatggcagtgtattttgtaacgagcacgtgatttacagggcgcagaaatgttgaaaatttagaaaaaagtaagataagcaatatcagtggcaccattgagctagtctctaacagcggggtgagaagctatttttgataggagaataccttcaatatcatttttactatttatcatgcctttagaatctatatgggccgatgcccctgacgaagaaccaataaagaagcagaaaccaagtcacaagcggagtaataacaataaaaagaataataatagcaggtggagtaatgaatcaagttcaaacaataagaaaaaagattctgtaaacaaagtgaagaataacaaaggtaaccacgaaagtaaaacgaaaaataaaataaaggaaactcttcccagagaaaagaagccgcctcatagtcagggcaaaatatcgcctgtaagtgaatcattggcgataaatcctttctcccaaaaagcaacagagatatctcctccaccagtttcacctagcaagatgaaaactaccaaaacacaatccaaacaggataccgcttctaagatgaagttattaaaaaagaaaattgaagagcagagggaaatattgcaaaagactcatcacaagaatcaacagcaacaagtgttgatggattttctgaacgatgaagggagctccaactgggttgacgatgatgaagaggagcttatccttcaacgtttgaagacctctttgaaaatatgatccctcccatcacatggacacttttaagcacgttttgcttgaagagacattagtttacaccattataattgtttaataaatactagacatacttcaagtgagaaaatcaatcacacctttttcaatgattagcaaatctttattgccaggcctaactgaaacgatttattactgcgcaagaaaacaaagatggaaaaggctatgctagttcgattagttgtttccttattctttagaatattatatatgtatatataaataaatggctttcatcttatttcgaataaaaatgttttgggtgatgtgtattgagcatacacacttaatatcaaagaacaattataaagatgctatgaacggatgttatttttacctaactatgccttcttggctttgatacctctaatagcatttggaatgtatagaagtggtgtaacgacggctaccgcaaaaatagcataaaatggatacaggtataaagctgaccttggatgtctccaccatagaggtttagtggaagattggaagattttctgtagttgaataactttattagccattatttattattgttttgctttctgtacttgttggtttagaatcttatatcgagttctactattcatgggatgaataaataatatcatcttttatttctatccgccttttcaaacctgcccctaccaggccggatttctcggacgatgcgcggcgtagccaatcaagtactgcctttttttttttttgctgacactatatgtatacgtgcatataatcaaacaataaagcaattgtaagcgtcagcaattctagctgtactaagatcgtagtgattatatgcgcttatatttacatggtatgaagaataaaatttgaataaataaataaacgtactctttacgagtacaaatctcaaaactaaaagaaaaaaagggttacatcttgtttccaaatagcgtctatagaaatgtagggtataagttgatgcaaaggtttttagcggtgtgtatgacacacaaatatttacacgtgagagaaaggaaggtaaataactgaaaagattactcctcctcctttttattctcttcaaaaagcttcattttcctttcattttgctccaactttaatagtgaaatctcttcatcaaaccattcttttaagaaaagtgttaactttctcatattctcaagcccctggtatttatagtccacatatctaagtactaactcgtcaatgcgatcctttatctccttgttatcaatggaagcagcagttgaaatgtaagcaggccttttctcaaaatatttcataaagcctttgatttgtctaatgcaacctggagtaatcaggcttgccctatgattacaattccagtcttttaaaatcctactaaaccgttcgctttcatgcattcttgacgccaactttaaagatgtcatgtaatacatcatccactgtttgttatttgaagtatccaaattttttctagcttgtgaaattaggtaacatgcatatttgaaatcacgggtgtggaaacatatttgagtaagttgtaaatagttttgaactgaaagctccttttgatgtactcgttcaaattccttcagtttgaattccagttcttttaaatgttcagcagacaacttttcaaaagatctataattagaaatgatctcccatttcaaccataatatatcgacttttagtgggatatagcggaatctggtccttaatatcacatcaactacacgtgccaaaccagttaaagagtttctcaagcataatgccaaaacggaatacaaaaatgaaaattgaggcgcaatgccctccttcaaactattcgaaatcaccaattctgctccatatacatcattgtgagaaacttttttcttgaactcttcaaacctttcaaaatcaaccgcgttgaaaccagataacgaagagtcttctcctccattgatctttctcgtatggatatgggcattttcttgtaaaaatgtgtacacccaagtgagacatttgctgtattggctcctttttagagtcacaagtaggtcatttgtaatttcttttgccagcattggataaacatttacggcacatgaccataattgttgaataaatgcgggccgtaatcgcgttttaccatcagtggttttaactacactgcgataatatttgaaaagtccttcgaattgattggtgttgacaaaatacctagaaatgcacaaatgaaacgaaccgtctatgctaatatcattatctctctggattttttccaagattacttttaaattctcgaaattgttagtagagacgtacgcttgaaccactgacatatatagctcttttcgtgttgaaatattattattaagtctggtaataaatttatcaactctttccatcaatattgagtcatcaatgctttttgttctgtctcctttgatgcaatacagagaatgacaaaattcaatcaactcaaactgcacacttgatgtatatcccgtacttaaaacaacgggattggttaaaaaatcgtttagctcatctgtattagaaaaacgtaataacattctgtgtattatcgcgagggttttgaacgagggaaggttagttgaagaggattgctcatcaccacatttcactttcaaccagagataaaagatgtgtttcatactggacatatctagatatctttccatacatcggagaaactcaaaaagctgcttttcagttattggaaatgtatcaggattggtaattgcttgcgtgtaaaattccaccgctagttgagtgttattactccttatgaaagagtttaatcctaaagatatcatttgtggctttactttgcaatatttgatatattctgcaaataaagtttcacagacatcaaaatgatgtaaattatgctgtactaccaacataatttcgatgaactgaccatatgtgcctttatcagtgtggcttgctaataagggcgtgaattgctcatatgttgtgtatatttgtccaatatcgtagtcccttttcaaaaagtgaagagaatttattaagatcagtaattgctgtattgaaaacaaaaccttttggttagtggaaaggctaattattgtcatcaaaatatctggatctgcactttcgaatttttgcttccacaatattccaaaatctttgtctttcactatattatattgattcttaagaatatctaagctgctggggcttttggtaatggagtccatccaatcgagtttattccgagactcatacacaccgcttattgttgaagaatcttttagttgcgctttaacccaatcctcaatatcttccttatgcttttttttgatcaactcagttgagtaatatcgtactttaaagaaaacagtgtgcataaccttgtttgattctctgtgaagtaatctctttataccactggaggatataaatctccgttgtaacattaagttctcgtaagcaattgtttaaatttaataggtagtgataaaaaatttgacgatatcaaagttgtggtgtaattaatagaatacatgaaaagttatgatcaacataaaaatgctctataccagatagaattttataaaaaaggaagagaataaaacgataataaaaggaaagacaggttaaacgattggaatggggtcttcaagttacaaatctagaggaaagtgtagacctagtgcagcaattgtaaattttgaacctttctgtggggggaggggtttctcaaagtatcagatagtattatgcacggtaaataaagcctaacaacaagaagtccaaacaataaataacaaccgtttctgatccttggatcgtatacagaagcttgttcatttcagttttttcattgtctcttccttcggtatgcctacctttctgaaatatatggttattattcgaagaactcgtaaggtccgggtaataattatgaaatgcaatagtaaaatataattattactcaactggctgtatatatacgaactccttcaacaaatgtacataagaaatgtttatcacaactatcaagtttaatcataaatagtttcataagtgtgtaattctgggctcacgctaaagtatattcctgacaacatagtttggcgaaggtttggcaatatctttatcaagtagttcatgtaaggataaaaaaaatgcgatataatagtggctaagggctcaaatgaggattcgtcaaaataacattcataacttgcaaagtgatgaattctctcaaagccatggaaattccacgtcgtatcctcaggggcatactgtagtaaatccaaatcccagttcttctgaggatcaaacctcttagctagagattttccagtatatgctgcaaacactatcggtataatatccaagtatcttgcatccggggtcgaaaagtattgatgattcatgatgtacttatcaaataatggtaagtatttggagcagaacgcacatttgcagccgttccacaaaaggtcacacgcatacatttcatatgaggtgatggactgcaatacagttggagctattattgtttccaacgaagttagctttggtaaaaccttttcataaagttttttacggcgaagcaagttcccatcaacagtatcaatgcccttgccatttaaaggtgggtcatgtcgtatgcttaacaaacgcaaatctttactcacgtttggtaaatttaaaataaacttattaacgaccaagtcccatttctcgtccatgtaatggtacccttttttggtgaatgtcttttcaatgaaccccagacttgttaaggaaacaaggtttcctgttatatcttgaagaaagtcatcatcacattcacagtcgtccacctcacaagaaaattctaattcaagggctttaagattggataaattaactacatccttaaacgcgcgtgaagataatctcatagaagtagcactcccatcaccttgtttgtgaacatgattaagcttcaaacggcgcagattcttgaagcggaggttcagggaatcaaagtattcaaagacccttaggcttgagtacgcttcgtcctttatttctaactctcctccattaagttgcttcattaacattacacccacttcagggattattacgttttgcaaatccaacgattcaggtaattgccattttaagcttttgaagttttgccataatttgataccatcaaatccagtttcgccatatactactctcttctttaaacttgacaggcgataatactttgctgaacataactcaaacaaggtaggatccttgatgtcaagactttcaatcacgtccaagtcagtgatttcattgaccaatctttgtaacagttgcaatccttcttccctgttgtgaaacaaatcctcgtcaatagtcagctgttttatacattttaaatgcgatgtctccaacaacctttcaattctatcatataaaaatatgtcattcttgtcaccggttttcagaacagatctataaccacttacataagtttttcccccgtccaaaaaccatttgtttgttcttaaaacaggattcttagttatgtgaatattgctataaagacgagggattgcaatcatgtcatgcatttttttggatgttagacttaggcttaataaatcattttgattaagaaataaggaggcatgcgagaacactatgaatatatcttgatcttggaatgccatttgtcagtattacttttgttatatcatgtgagcacaactgtcgttttcacaatagttcaaattgactagagagttagtaaaggggtacaacttgcttttgtaatagggcacacctttaattttccatccatgaacatttttcaacaaaaaaagaggtggaaaaaattcaaaagaaaatgacaacggtaaagaaattaaatcaagttccatcattgtatttagaatagaaatcgacatgctttgtaataggttccacaatgaatctcgtcactaaatccacaagtaggttagagatgaatcagattatatgcaaagtatatatctgtacatattcattatttataattgggaataactgataattaggggatgaacagaatgtttagtcagaacattgataaaattctcataatcagaaggagaataatgttgaatcagttcctttaaaagcgttattcttgaaaatatttcagcattagagcaccagccgagtggggaatctttaaaatcctcggtgttgaagtgctccaatagagcactttttaggtgatgtatctggtctttgtaacactttgagatatcccttccagtcaattttatcatatttaatatatgcattgccttttgtagttcgttgatgaactggttatccttttctatagtaaatagacaattcttcgccgattcttcggcagcaaacatatcatattcatttagatattgaaacaactgtaaacacaactcttctaccacctcagaacttgtgaatacgtcaacaaacttttttgtgaatataagagcggtcacactggtgttcctgttatattcccagtctgcagtttgaataaagttcttattcaaataaaaagaagccttttctcttatttcagaatcatcgtcccataagaagttgtacagttgtaatagtattctggagttcttacaactttctggataagcagttaaacattctaaagatgccaatctaaaatcttttgaacaagaatcggcgaaaaatccttgtaacaagttccatacctggtgaaaggtttgcgaagacaatttagcacttagtgatgaaacggcagcaagttttgtatcttcactattatttgtttttaggagatcagtgcaggtcgtcagggataaagtattcttttttcttgagagaattttcactactaaagctttagccataggcagcaaatctggaaccctgagtaataattgtagttgttcaagaaattctgagtttcttgtagtttcccagtgaaagttagtattcatgtactgtagtgtactgagctgagcctcataaaatggagaatacaatcctaataagcaaatatcatcgagatatatactatcctcatattttaagagcatgtctaagatttgtgcaagatatagctgtttgctaccatccacaacatattcgttattttcagcaataaatgtgttccgcaaagtgctgatataatcttttaaaatagaatcaggtatgtcgcatgtttccaatatacagcaggtcaattttaagtaggcctttttagtgataaagcacttgttctctagtagaagcatccttttcttttcaagtatcctttgaatcaactccatatctctagttcctgaaaggtattgtggtactagttgttggagtgctagtaagtgtccatgtaactggttttgcttcgcgatagaagccaagtcaagtaattttcttatctcttcttcaaaattttccgacagcatatgcaatactctagaggccatatctctgatcttccagttctcatttgataaacattcataaacagaaacgttgaattcttttagaccagtatagccagctgtaggccgtaacctcagtagcacattaaggaccaagaaaatgctttcaatttgatatgattttctttcacttcccgaatattgagcaatagaactgtttagaatattcaaaagcagttgcctcaagccagaatatttggtaaagaataattttgcactaacgcttctgcccacttttccaaaaattctattttgcaaggaggtaaacagcatgatagaacagtttcttagagcccatatatcacagtcgaaattcaataaagctagttctaatgcctctgagacaaatgacgtacagtgtacagagagcttcggttcaacaaagattgcgtttatacaattaatagcattaacctgtggtaaatcaaactcatcttgatggggaggaattggtaaccttgcaacgagtagtaagttttcaaaagttttttgtaacaaaggtctccctttggtaacttctgcacttaagacggttgtgaccaagaaaggcaagcctcctgaccttcttgtaatatgttgagttttggattttaaagattttacactcttgcttaaaagttcttccagaatagcgggaaattcaagttgacaacgaatacaaaatgcctttagccccggtaaaacggcttggaaggcgccactatgacgaatagtagaaagctgaacaataaaaagatcgccgatactgtctaattgatctcttgttaaagggtatttttttaatattgtttcaagtaaatatgatgcttcttttatcgccctaaatgcgtgacttattataacttggtccggtacaccacaattagcatatttttcaggtagtattccatgggcagaatcatgacacactacatttctcgttgcttcccagctcttgagtacaagatttattaattttgagattatttttgaagtatcttgatggttttcttcagagttaaacttattcaaaatcaagcttagtgcagcaaagtgaggaccgattgaattttctgcacaaccaatgctgtcattttgcaaattttgtaccatctgcgctaatatatcaattgtctggtcaatgaagcttctttgagagcccatgactgtgaatatgaactcatatacggtagctccagcatcacctttctcatagtcacttaaaagagaggttgcagtccacttcaaagcatttgcgtctaaggtatccaaaaaaagacctctagattcatcagcgcttatcattataaatagcatttctttagataattcgcgcacgtcagcataattactaaccaaaaggtcaatgagcaaccttaaaaatgtgacatcctgtaaaattgggatagaaaaaggatattccctcttattttggttgtctaaaaatttttgtggagtagatttatcaacaccagacttgatcagaatgtgcataagttttaatgaggtcacgttcgcctgatataaagtaccaggggccaaattatattttataaaattgcatagccaaaccaaaaaggctctagcctcctcaacttgcgccaacttttccctctgttcgtccggaaatttctcagcctttttaagctttctggcatccctagctaaagagtatgcgcagtctctggttctaaatataaagtgtttcatcgaactgcaaaagtaatttctgcgttcaagttcagtgtccacgaagaacacatataggtactgttttatagttttgaagacgaagggacgaataggctttgacttttttgtcgaaaaggtcagtatttcaaatacctgaagtttatactcatcttgctctatgagtttgttaacagaatctacagtggtatatttattatcacaaaatggttcttcttcaatccccaattcttggccaatctttaaaagtgagagcaaaagtgatgggtctttgttagacatacattctaggaaaagtgtgaaggccgagtttggcatatttttgaataatggaatcataatatacagattaatggatttggtgtattgtttgtcgtgaatgtactttaaagcacaacttttccataattgtatccattcttgtacaaaagactcgttctttttgaaatgcttttcgtaaatgtttaacagcaaactaacaatgcatttacctaccgaatttgctagcaaatcagagttcattaatgaaaaagagttatcgatgaaatgaggctttttttctataatataataaaggtcaaaatcagaagaaagggcatcaatcaagtaatactgaacacgcaacgtagatggtacttctaatatttcattcatccaattaaataaaacatccttcaaggttgacataggatatgtgattttcaataagttcagtagtttactgaataaatctctcaaggcattcatcagtggggctccaccatcagcccaaaagtcaagaacatattcaaagataatatttgcattcgcttcagttaagagttgctcttttaccgccgataaaaattcttgagagtcaatttttttgcttgcaattatttgatggctccttagtaaacagatcgaaaaggtatctggaaaaattaaccttgtggactcatttaagttcggtaatccgtccttgatatactgtattaaatacctgaaatcatgctcaatctgagttaaaacagcatccttattttcattgttgatctttgctggattattagcaatcaagaattctttgacacggaaaagctcgatttcctgacttgaaaattgcacatccgtagtcattttttgaaactttcagtatgaagtaatgtgtacctcgggaagctcacaatagtattgtcattttcctgcgatgagcattttctggtaaaaatttattttaacttttcattttcttttcagtctaaaaaagtaaattttcgatggaaaaaacggaagcactcatgagtgacaataaacagcatcgaaagaaaaggtaataaattaaaaacgatgaatggataaaacgtattcgcaacgtgctctttgctcaaatttctcgtgcgagaaaatttttattacgtctccttaacgtccgcttgaaagaaaccctagaaggaagattaaacgacttcttgaggtatttcatttttattctttttttgatatctatatataagtatttcgatatagtaaaaagaaaaccctttcctatgatggactaaaaaatataattataaataaattatgaatagttgacgcattagaagatattgaggacacttgttcggcctaaattaaatgtcatcaatatcaagttcttcatcttcaccttcctcatcatcttcatcagcgttaccaaattcaaagttaacgtcttcatcagattcgaaaccaaagttgtctgtttcattaattttggcgttttcaggaagttcaccttggtttttcagtgttctggcttcatctaaattatatttgtggacaacatcacattggtcatcttggaaatctcttaaggaaacaagaataatatcaccttgtcccatccagactttctttcttaacttacctctaatatgggccattctcttattaccatcaaagcaactggcttcgactcttccattacccaacatcttggtgatttgagcatattcttggccttcttccttataaataagttcacgctttggaccgtcagagtcgttcttacctcttctaccttttttaccacctttagtgtttttcttacccatgatgaactttgctctatattacactagtgcttttgcaagtacaccttctacataagtaaaggtttctttcagcaaactaaaattgaagcttttttcaatttttcactattacttcttgcggcgaaaacaaaaatgaaaaaaaagtgaaaaatagcgttcgtgtataatgattattataagatctcattaacaatatgagaaataacccacattgttagttgaaacttgtttgtaatttatcgtgctgtatatacatatatacgtaaaaggaagatcgtacttttatatttataatcgctcgtaaaaactataactgaagaataagaaagagaacattttgaaagtacaggagggaaaatgatcgcttaggcggctgtcaagtcatgaaggatggtaaaaagttcattgacaccattgatatgttccttggcataagtggatcttgagctaccgtaaagaatggtgtaaccaaattttagattgttcttttcaacctcttgcttcactaatttaaataatggttcaataataggtgatgtcgaaccggaaacgcaaacgaaatctacctggttttggaaatgcttcttattattaccgacggacatcgaagaggatgttcttgatagagatattctgctattgtcagtaggactgacgccactgttgtaaaatttcatcaaaaactcagcggcggctaaggctagccccgtttgttgaacgaagacaatatccttatgcacataagcgtgaatatccctgtcatcaaataaggtgtttatgtgcgtaatggcttccccaataacagttgggactcgatcttgatcatcagcgttttctgtatggaatctgatcatagaatcagcgattttgtagtatgaaccaggtaacctctcgactttctcgtcaaagatctttgccacctctttcatccaatcaagctcttccacgatgttgtaccacgacccattaactcttacgtaggcaccattctccgctatcaatccgatgtttagaacaccattgtataagctttcgaatgtattctttgtaaatgaactcaaaacgtaaactatattatttgaactcaattcacttagcaaggatagcattctggacgttggaggttctgaaatcttgaagataaataaatgctttttggaggctttgtaatcagcacagaatttttctggagccaaattgaaaacagtagacgtttcttggttggactcccaagcattatttatgtattcgaagcactttgtaatccaattatccgaatcatgttcaataacagatttgaataattttttccacctacgccttttttcttctggagacatttctaaacttctcttgatactttgtgctacatgatttatatcccatgggtttattaagatggcaccttcctttaggacagaagaactaccagtgaattcagataataatagaggcgcatttttttcgaatgaactgacaatgaactcatgacatgttaaattcataccttctctcagcgcatccacaaggaaaacgtcagcttcacaattcaatgccaaatattgagcaaaatctaaatcttgatgcaaaaagaccactggttgagagatactgatgttcgaagacaaagaattgattctatcaacgacaaccataatttgacgttcgtactcaggatcggaactcttaccgatgcagatttggatcaaaacaactttttcgatgtattcagggttttctatcaaaaacctctcgtaggctaacatttttttctgaagacctctaattctgtcaaattgatcgcgacaaacaatcagttttttattacgccatctttctttaattaattggcgccattcaagtacagaaccatttctcaactgcgatgtcaaatggtaataatcaataccaattggcgcatacatcacggaaacaatattgcaatggtatttgacttcatcattagagacatccgcagcaagcaatctgttacaagtttgtaggaaatgtcttttgtattctttagtttgaaacccaacaaagtttgcaccaataataccttcaagaatcctttctctgttagcaaggcatctgaagacctcactacttggaaatgatacgtgtaagaaaaatccaatcttagctttaggcagtttctctctcaccatttgtgggacaagcatcaaatgataatcatggatccaaattgtgtcgccaggtttgtaaacggaaactatcctatcagaaaacttttgattcactttttgatagtagtcccaagaatggtcttcaaaagcctttgaatttggattatctggaatttgataatgtagagtgggccataaaatctgtttggcgtagttcttataagcacccttaaaagtaatatcgtccgtgaccactggaaaagaagaaaaatcctgttctaatttctttgaaatcttatggcaaacttcgtgaggaagttcgtcagtagggattcccattgtacctacccaggaaacaggttctttcactgtcttttcagcaactgcaatattaactgcatttttcaaggatccgttccctttgtcactgtcgactattgtccatggcaaatgtttgaatagctcatacgagtttctcattagagatgctcttaactttgcgttattggaatagccaccaaattttgggacgttgtatttcttagtagcatcggtctccaaatcagaatcaatgtcatcctcactatcagtgtcttcgataaagttatcctgaaattgctgtgagtacctgagattagaactcgaagaagcaatggaagagtctccagcggtgcttccggaaactcttttcatggaaggcaaggaggcttgctgttgaaactcttctctaacttttgcgacatctacaacagcaggatcgacatctggaacgcttttagagacgggagtgattacagcactcttggatgagcttctgaccctgggtggatgtgaatcaaatgacaaattgggatttttcataaggctggagctcaaatcgttgtggtgagccgatgaacgactagcagaaatagacgaagcagaagcttcctgggagggagaacagactctagcagacggagcagaaaagaattcctcgactgaaggccgctgggcagttgagccagaagaaactgggttattagctggcggaataccagagtttgctgcatgagtggcattggcagtcagctcttccaggaattgctctgaggaaagcatttccatctcattatgatagttaactcccgtagcaggagagcccacattggccctttgtaagggttcaccgttaatttgcgcctcctgaggtaagccaatataatgagagcttgccgaagttacagaactgcttctttcttgcttgttgttgctcaattcctggttgttgcagtctaccttgatcatacttgattcaaccagcttagcagtatccgagttggtgacatcagcctcgaattgaggggtatatggtaagaataaagaagcgacgataatagtcattgaggttgcccgtggttattagtctgtggttttttgaataggaagcaataaattataaagccaggacctgcaataacgtttgtactgttttattgtgataaaagatgaagcggaatagcaacggtacttaaaacttatgtcttagacttaatactattgaatgtttgctcgtccacttgatgctccctggagttgccgttgctgcgtgctgaaggggattaattaattccaggggcaccgcgcgaagcccaggaggacaattgattacgtagggaagaaagggcccttttagaagactggcaattgcaactctatcgaggttaggtgttacactacgctgttcattgaggaagtagatgaataaacttgttgatgcccactgtcatgttataaccgacccagacaacacattctgcggtgatgatggagggtcccagggtacgttgcgttgcgttatgtcatcaaacccatatgactggaacaatttgaaaaaattggctggcagaagcacaagtaaaaacgatatatgcgtgggatttggtgtgcatccttggtacagccacttattttatgtgggaagtcggcgcgacaaggtttctcactatcaagatgtactggagtataagaatgaagaacagttcgacagtttggttcaggtgcttcccgaacctctagatcttgaagagtatataaaaagagagtttaacgacactttggttagtgtgattggagaaatcggtcttgataagctcttcagacttcctgcaaatggtttctacatgcagaacgagaaggcaaggcttacgacagtgaaggtcaaactatcgcatcaagaaacagtattcaggcgattttggcgactggcaaggcacacaagcaagcccatctctatacacgatgtaaagtgccacgggaaactaaacgatatctgcaatgaagagctcttgacgtatcactctgtcaagatatgtttacattcgtacacaggctccaaggaaacgcttctgggccaatggctcaagaagtttcccccggatcgtatttttgtgagcctatccaaatggattaattttaaggacccagaagagggagatgccctggtcaggagcttgccctcaacttgcatacttactgaaaccgactatcctattgacaatccagatccgtcataccaaaaggcccttacagagcagctgcagtatttgaatgcacaaatcgcacgagcatgggacgagacactggatgcctcacaagccgctttgcgtgtatacgaaaactttcagaaatttatcaagtgaaacgcttttgaggtggcagcatagcactgtaatgagatatattaagtaggcttgctgtataccatttcttgctatgcatgtgttttagcaaggcaacgccgttccggaagggaaaaagcgctcttttttatatactgtgaaattttcagattttaacttagaaattatataaaagcggttgtgtatctattgtgataatgcaattcctttatagtttagcaaatcgaaggataggtatatactgagtagtaatggctaggccagttaatacaaacgctgaaacggaatcgagaggcagacccactcagggtggtggttacgcaagtaacaacaatggcagctgtaacaacaacaatggcagcaataataacaataataacaataataataataataataacagcaataacagcaataacaataacgggcctacctccagcgggagaaccaatgggaagcaaagactcacagctgcacaacagcagtacattaagaatctcatagagacacatatcaccgacaaccaccctgatctgcgccccaagagtcacccaatggatttcgaagagtatacggatgcgttcctgagaaggtataaagaccactttcaattggacgtaccggacaacctgacgctgcagggatacttattgggttccaaattgggcgcgaagacttattcatacaagaggaacacacaggggcagcacgataaaaggatacataagagagacctggccaacgtggtgagaaggcatttcgatgagcattccattaaagagacagattgcataccgcaatttatatacaaggtaaaaaaccagaagaagaaattcaagatggaatttcggggttgatcaaacgatgaggcagcccttttgtgtataagttatgtaaacttttaaggtggtaattgttaaaatggacagtaacacttgtttatttgctagtattccatttagtttaatgcctttttgtatacggtgcgggtagctgtcgcgccattttaaacgatctaatataactgaggtgggcctgtcattgatgcattgaatagacaactcatcaacctatttcttataaaaggcgccataaagcattacaatctacgatcgcgcaaacttttttcttttggccatggaggattcgagattgcttatcactttgattcttgtgtttggagttatatttctgaaaaaattcttccaaagtaatcagcatccctcagcacaacgcttatccgctacaggtgtaaacgcacacggacgtcctcagggctccacgcagaatgccttgagaaggactggtagagtcaatggaggtcaccccgtgactactcagatggtggaaacagtgcaaaatctagcccctaacttacatcctgagcaaattaggtatagtttggaaaacacaggctcagtcgaggaaacagtggaaaggtacttgcgtggtgatgaattcagctttccacctgggtttgagccctccagggcgccaatgggggccaatgcggctgttgataataacgctgctggtggcggagagtttaacgatcccagaaagaagaacatgatttgcgctgagaatctactcgataaattccatgtggatctcaatgaagatatgagtaacttaagctttaaggacttagacattgaagagagaaagagattgttggtttggcaagccagaaagaatttggagacaaaattgcaaagtgataaagatttgcaaagtttgctgacttgaacgcttaagtgcttgtcgggaacacgcaagtgtgcccataatgcgcataagtatatctttgtgtttacttatttaaaatgactaaataaataacccaaaaaaaggaagaaaaaaatgtaattattaagcattggaacacggtattgctgccaacttggcaaatcgcccgaaaaatgcctttattggtattgtattgtctaacggaacccagtgaatatcttccttgcagtttattagacgctctgttaccacttctaaatcttcaattcggtctcttttgtaaaaatgaccagtgactatatattctggaaagagagtgaaagtgtatctgtttggttcgggtgtggctttgaaataaacctccaatggctttcttctgttgtggtgggccgacgcgatgacggcaaggtctgtgacttggaagtgtacgatgcacttcccaggctgttccagataaaaaatttgtgaaatatgctgtactttcttctcagaatcaaacgtgcgagtgtcattgtttgaccataccttagcgatttcaagtgcagggatatctttaccgggttctgcgcacggtatatacaagggatgttcatacagcttgggtctgaacgttcttctccccttacgccgctttaagtacttgatgacctctattgataatagacgatgagatgccgtgcaaaggatataaccaatttgtcttggagtccgtcttaaatcaaacttttgtgaagtgctgagagcttggctattgttctttcgtaccatgtccatcaccatttcaagttcctgctctcttggcagcgatttggtgaatggtcgtacggggatcgcagaccatttcagacgtggtagatccaaagaatggaagaaagacttgaatgcatctatttggtgtattctatcatcatatatggacaactcccgcagagagggataatattctaagaaatcccgcatcaactcttttttatatttgctagtgtactcagaaattgctcttttttttaggcaaactgcattgaacctaaactcattttctgagcatttccaatggctccttgccgtctgtaaagcatgctcaatcaacttatggaacttactttcctctctgcccgttaaaacgatcgagatagtatccttggcagaatatgactcctccgccaatttaacgatatccgcattccacgaataccttctcggtttagtcttcgagatctcaatagcagcctgcagaaaccccggctcattccaccagcctccattcggtagcgtgctcgatgtcaacaaatttagtagctcacgtgtatacaattgctctgtaggacccggcgttgcaaataatgtattgtcgaagtcgtatatgtgcaatttcgtaatcgcatgctcaggaacctcaaagggcacggccaactcgcaagcgcaactattccattttctgagcacacggtgattgccacatctgctggacatctcccctttccttcgaaattcttcaaattcttccattatactcgtttgggttatgcagacaaacagcacatatgataattcattttttttcttccattatacgctatagtaatgtaagacctgatctacgggttcgtttcttctatttccgttacccgccgtgcaccacagcatcgctgcggttccgtctgcgtgagtcgttctgcgcgaatcacttcccgcagctgacatcacaggggcggcctttcctggctacgattttttagcgggaaaggcacaccctttcttctcctttcgggtataaagtttcttctgtgtggattctgtgggccagcttcggttttgaagttggaaaaaaattcttcatctttgtttttttatcgtggaaaaggaagaaaatacttgataaccaacagcaaagccgcatggcttggcactcgatcttgatgttgtcccgtgcctggttgtataatattattattaatggccatttcgtaatcaaatttcggtttgttgtttttttctatttctttttcatcttatatatattaattcgtttgccttttccgtttctttttgttttagtaatcataagtttacggcttagcagcaagggcaaagggacaaaatgaatagtactaatagtactaatagtactacaacagctaccagtacaaacacgtcaactcaacaagtcgttacttctttggtaagtaatggtactatttttggtgtttttgtcatagcgttcttgattttgcgtataaaactaaaaaggatttatgagcccaaatcctcattcaatctgattaatgaagaaaaaaagccagaaccgctaccgcagggcgtctggcaatggctgaagccgttattgaaaaaatcagacaattttgtcattcaacaagccggtctggatggatatttctttttgaggtaccttttcatcattgcaatttactgtgctgtttccatgagttatatattccctattttgttgtccattaacgccagtaacggtaaccatgaaagcggattgaatcaattggcctatcagaacgtcaagcaccgtggtagatattttgcacatgttttctgtggatggattttcttttgggggttcctttacattatttacagagaattgtatttttacacctctatgaagcaagctgtactagcgtcccctcgttatgctaaaaaactatcctcgagaaccgtgttattccagactgtccctaagcaatacttaagtgaagaagagttttctaagttgtttgatggtgtgaaaagagtctggatcgcaagaggttccggttcaattgaagcaatggtcaaagcaagggacaatatggccatacaattggaaggtgctgaaacaaaatacctgaaagcagcattgaaaaaaattaagaagttaaacaaaaaaagtccgcaattatctgtctctgataatattgctgaatatgtccctgacaagaaaagaccacatcataaaattaacaaggttgctaaattcttttttggtaaaaaagttgacaccatatcctacattaaggaggagttgcccaagttaaaccaaaaggtgaaggcattacaagaagatcatgaaaattcatcccctttcaactccgtttttgtggagtttgaatcccaatatcaggcccaagttgccgctcagatcaccacataccatgctcctcttttcatgacgcctgtgtatattggtattgagccatccgatgtcgtttggtttaatttgaggatgttctggtgggaaagattaggtagggaagtcagtgcggtttcagcaattgtcgcgctagtaatattatgggctttcccagtggcttttgttggtatgatctctaatattacttccttgactaatgaagttaaatggttaaagttcatctataaattaccaaaacaactattaggtttactgacatctctggccccaactgtggcattggccgttttaatgagtttcttgccgaaatttattaggggtatggctatcactcaaggtgctccatctaagcaaaatgtggaatatttcactcaacaagcttatttcgcctttcaagttatccaagtctttttagttaccactctatcctccgccgccacttccacagtaacggaaattgttaaagagcccacgaaggctatggatctactggcttctaatctgccaaaagcttctaattttttcatgtcatacgttattctacaaggtctgtccatttcatcaggtgctcttttgcaaattgttccactaatactcttttatgttttaggtgcctttttagatggtaccgttaggaagaaatggaatcgtttttgtgggctatccagtatgcagtgggggacagcttttccagtttatacaaacttggcagttattactttctcctactccatcatttctccgttgattttattatttgctgccgtcgcgtttttcctattgtatattgcatatttatacaatttgacttatgtctatcaggaatcacccgacgcaaggggtatttattatccaagagctcttttccaaactatagttggtatctacatcggtcagatatgtctattaggtctttttgccgttggtaaaggttggggcccaatcgttttacaggtaattggaatttgtgttaccgtccttattcatttacatttgagcgctgcatttgatcatttatcaaaggttatacccgttgataccatgaaaccgttagatggtgtatcagatacaccttctttcaaaaatatttataaaggcatagaaagtacaaaggtgaagaaaaatacttttggtgcaaatattgacatggacggaatcaaagaattacctgaatttccaataaagaaatatcacaagaggagtgaatcagtcactgagcaacaagttgaaaatagcatatttagtgaaaatacattcgaatatcaattcaacccagcaaatgaagccaatgcagatgggcacgctataaatgcagaaaatttaattgaggacgtgccattattagcagatggtgatacaatgaaaattcctccggctccatggtggaagagattcttaaaacctcacatttactactcctataaggctgtaaagagcagactgccagaaatatatggtttggttgatcctgatgaaagagtcaatgatttcgatatctctcatgcttacgattatccagctgttagtgcacaatgccccgaattgtggattcctcgcgatccttttggattttccaaattgttgatttcagacgtttctggcgttgttgaaatgaacgatgaaaatgctaccatcgatgagaatttgaaatttactctgcgtgacgtaccaccaccatataatgatgttaaagacgaagcaaatggtgaagcaaatggcgaatttgacacagctagtaaggaaaataatccatttgcggacccaaagtataaggaagaagagagtcgttcggcagtctaaaggttaaacattatcagaaattatctattcctatttgtttagctgttatcctctgatggttgaattgtaattttactaagaaaaggagaggaaaaggacgtgcatatattcttttaatacatttaaaatatgattctaatcatttcttatataatagtgtatagtctaatcattcatcgtgtatagtaaccctttttgtttttttttatgcaaagtttttttgtttttggcaatctatgaggtttgaatattggataaaaggaactccgcacagtaatacggagcagtcagctaatttaaccagcactaatagggagtacattcaattggaaactttgattcgcttgtatgcgtgaaaagcaaattcccttctagagaagttactgaaaaacatgaatttattacgaatgaatgctttaacaagcaaggctaggtcaatagaacggttaaaacaaacattgaatattttatccattcgtaatcatagacaattcagcaccattcaacaaggcagcaaatataccctcgggtttaagaaatacttgacattattaaatggagaggttggttcttttttccatgatgtccctttagatttgaatgaacatgaaaagaccgtaaatatgattgttgaagtaccaagatggacaactggaaaatttgaaatatccaaagaacttaggttcaatccgatcgttcaagatacgaagaatggcaagcttaggttcgtgaacaatatctttccctatcacggctatatacacaactatggtgctattccccaaacatgggaagatcccacaattgaacataaactggggaagtgtgacgtggctttgaaaggtgacaatgatcctcttgattgttgcgaaatcggttcggatgttttggaaatgggttccattaaaaaggtcaaggtattaggatcactcgctttaattgatgatggagaattggattggaaggtcatagtgatcgacgtaaatgatcctttatcctctaaaatagatgacttggaaaaaattgaggagtactttcctgggattctagatacgactagggagtggtttagaaagtataaagttccagcagggaagccattaaatagtttcgcctttcatgaacagtatcaaaattccaataaaaccatccaaactataaagaaatgtcacaattcgtggaaaaacctcatttcaggatcactccaggagaagtatgacaacctgcctaatacagaaagggctggtaatggtgtcacacttgaagatagtgttaaacccccttctcaaataccgcctgaggtgcaaaaatggtattacgtttaatatgaaaataataccttcgaagaaaatgtttagataaaggttccttgtatataattacgtaatctctgctctctcgaatgttggctgcttgatgtatgtgaacgtttggaaagaaacttgggtttatattcactgctaaaatgacatcctattagaagttcgtctttctccggttcggttagtctactcacctagaaacatcttgcgaaaatcgtcgttggacatctgctcttgtttgtcaggaatttttttctttacttgaagatttggtcctttttccatcatgtttatacaactaggtttgacgtgtttcatgctgtgattctgttgattgttataatatcttttcatgtcattaatagtacctgaacgtatcacctttccctgaaattgagatccatttagtatcattagcatttttgctgcaaacttactatctctaaatataataatggcgccattgaagtcgctaacgagaagtattttcctaatatctttttcattgatgtgtatttcttcctgaagaaattggcagattaagcttggtgacaccttatctgaaagtggaaataagcatattagtgtttctagttctttgctgttacgcgatgcgagaagtcttttgacttcgtttctttctaagaatggttttttatcagccaaggaaacggaaatttccctattacctaacaaacttctattcatttgaagtgccctttcagcagaatctttattttcaaaaaccataaatgcacaacagttattgaaactgtgctctttctgtccagcaggtatgttgattttttcaatggaaccaaatccctcaaaagattccctcagaaggttttcgtcgagcaattctgtacttaggtttcgtatcataatctctcgcccctctagtgtggcagaatcggtccgtttcgacttttccagcggattggaaactttagtaactaaagtataaccttctattttgagtccattcaatttttctacacaatatcttgcatcctctttagaagtaacatcgatgtaagcgaaccttctgcttgtattgaatcgtaaactgggaagccgtatactgagtgcaacaacgttaatatcttgcaatagatctctaatatttctttgagtataacttggggggaaattcgtcatccataatgtgcattctgttaaatgagatactataatttcattctgacctacaactttgtgtgttttggttattgcagcgagggctccatcatacctggcaaattcaatacgtgcaaaacgaaagttcttcttcagcgaatccgcaacatcaacgtgtataatgggcccacaatgtttgaagtacttatagactttgttttgattatagctcttaggcaaatttttgactaatacagttgttaattctctatttcttgttaaagcttcgttcgccttcttagaagttaatcctgcggctgctggtgatccttcatccaatggtcgttttgaatctggtctagcgtgatgtccatactccattatcacagattatgaagtgaatatgtgggcttgtttatcgctaatgattctcatataataaatataaagggttttcaatgttgtagtaaatctgccattttgaataagttcccgcctgaaaattttttagcgatgactttaaaaaagacattgatgcactctacaattcattgtcatgatgtacatagaaaattgaatgatacaagcggaaatattatcagaataaatcggacatggatagcaaagaatatctgatatcatatggttggaaagaaggagaagcgtttagagaaggtggtttgaaaagacccatactggtaaagcacaagagagataagaagggattgggtaatgctcctggcgggaatgatggcgaagcatggtgggaaaggctatttgatggacatctgaagaacctggatgtaagcactgattcgaataatggcagtattaaatttactccaaaatgaggcagttgctactgctgtatcgaaaagtagctcacctctatacaggtggtttgtaaagggagaagggctgaaaggaaccattactaatcttggtaaaaaggaggaagccagctttgttgtatctagtgcaagttcgagtaaagggaagaagagaagaaggcgtgatgaagatgataacaaggtcaagagaaaaaaattgaaaaaagataaaaagactagtaacgacagtgagagtaagaagaagaagaagaagaaaagcaagaaggagagtaaaaaaggaaagaaaagtaagcatagcagcgatgaaggtgataaatcgaagcataaaaaatccaaaaagtcaaaaaaacataaaaaggaagaaagttcagcaagaagagatagaaaggagcatatatgattatcatagtctaatatgtaaatatgtatccgtaaaagacattcttaaaagtttgaatttatgatctttttatttttgtatttagtctttgttttcgaacttttattaatattaaatttcagtaagtaaattaaaagaacatctttaaaagagtatatttattgttacatatgttgatcttaaaaggagatgaatatttcttaatggaaaaaggtaaaaaaaagattttctcattcatatgttcccattaggcagttctatgaggcagtcgtccaactcgtaatcagagatctcattctcatcctctaagtagccctttacctgaaaaaatgttcttttgtttagagcatcttccgtctcttcacgatttaagcgttgtagcttggatttgtcctttgatgtcaaccgtttatccttcaataacttttccacaggtatgaaatcttctcttgttttacttaatagctcctttaagtatgaactggtcttttttggctggtgatacttttttagaatttgtttgggcagtctgaattttctctttttatacttttctgggatatcgttatatagctctaatgatttcatgtagatatccgtcatatcctcgttcatttcacaacctcttgaaaccaagtcatgatatgtgtatttaattcgtcgattggcctgcatgggctcgtcgtctatctgattcgcccttatattattagaatgcttatcttgccttacatcgaattcgttctctttggctattttatcatgcaacccttcgaataagctgtccagtttaactaagatattccgggatatttcgtttggaatgttcaattcatccacatctagagttacatcatggtccaaggcagacttagagagaaatttttgccattgagcatccagctcaaccctcatcatatcagaggcgtgcattaaagccctatttgagatctcccccggctgtacgcttacatttgcaataccttccggtatatcttcatacaatttgtctacactagggtcaataattgtattgggattaggccagctcgtccagttatccttaatttgggtcttcacaaactggtttacttcataaaaatgttttttttcatttgccttatacaatagtcttttcaagaggtacgcagagtataaatgcaacgaaaggtcgactctgtgcgagtgttctagagaatctaataattcatttgcagatttcaaagtctctttatcagcggttgtagtggtaagctcagatcctcgtataatatcttcgataggagcatcgatctgagtttcaatttgactttcttcgtcaagatcactcatcaaaaccccacgtaatgtttgttctcaaatatatttcgtcgtcccgaaatcagcacagttttataatgcaactgttaaatgtctagagagaaaaaaccgccgacacatcaatattttcaccctttatggctaaacttgagtgtgattcttgcatctgagtaatcttcaaacacgaaaggcctttttgtttattttgtagaagaaaaatattttagtgaaaaattatggaaagtagtagaaatcctctcaagtgaagcatgacaaaaagaaaagtaagaaaccttaaaagacactaatagttgatgaattactatgcgagaactcacgtaactccaacaataaaaagctatttacgtatactgattaaaaaagaatacaagaaaaatttattctttcctatacaaacaatgataatcaaatggtccatgtcagttctatagttcatataccataggccttacggtagttttcaatcgctgatttttgctctggtgatagtctatttcccataaattgtaccacttgagtcagtgatacaatacttagcacaggaacgttgtatctctttgaaacagattgggtagcacttgttctttccggatcagattcatgaatcacttcttgcctatctaaagcaacaatacaacccactaccctaccttgagcaatactgattatctcaaatgcttcattgattgcagttcctgcagtcatgacatcgtcgataatcaacaccctcttgtcttcaagcgatgctccaacaataataccaccttcgccgtggtctttaactttctttctattaaaagcatattgaataccttgaaatttagtgcccccgatttctgctagtttaacgcatacaatagcagccaaagggatccctttgtaagcaggtccgaaaataacatcgaatttaagctccgattgaatgatagcagttgcatacgcggtggcaaggtttgccaacagctttccagaattgaacaaactaagattgaaaaaatatggcgactgcctgcctgaattcagcttgaatgacccaaatcttagtgctttgcattctaatcccagttcaaggaaagttttttgatattcctctaaacttgtagtagatgcagacattattggattatgttttattattcttgatggctctaggtctcgactattttgcgtgacacttccttagttcttaatctatataaaagagcctgtgatggccttttaccctagattaggaagcgaaggggcctttcccgaaaggttatgtatgactcccttgaaatgcatatgataattaaaaccaaaaaatgttatgtgattctgaaaggaaatgctgtcatgtgagtcaggtgtagagcaggttagaacagtttatattacatagtctgaaaggcacgtgagaaagtgccataccattagccgaatacgtgaaatgtctaaaaaaatacaagtgaaagaataaagtgctaaaaaaactatcaggctctcagaaggcaatttagccatatgtatacatatatatgtgtgtgtataaacctcatataaggggccccaatggtttatctaaaggatatcctattaggacttgtctgtcacacgcaaaacttcaaatgacataatgatgagcacttgtcaaataattgagtaacttcttcgatatctctggtatgtaaaaataagtatatcgagatgagcgattgtatctgtatagaggttggtttctttttcttacctttctctttttatttttttctcgcattggttcaaaaaaaaaaaatgatggtttaaatttcgtaaaatacgaaaaatgaagggaaggtcccacccggattcgaactggggttgttcggatcagaaccgaaagtgataaccactacactataggacctttttcttctgttgttagtgtacactaaaacttccggttttatggaacctttttaagaaagatggtccctattttaacaatatcgcaagcaatggatcttgtactggtacggaaaaccgtatatactaacaaatcttaggtttctacgtctgactaaagaaagaattgtgagtgaggtttatagtagaagctctcctcatgactttgggctatgtaaattgttgataattagaggtaaaaaatagtattaatgaagaaataattactgatcttcttatactaaataagagaggtatataaaacacacgccgattggtcatattaatcatgaccaatataatagtgattccggtagttactatacatttatgtgacgactcatattcctcatatatgtacctaccataacatgttcaactaataggtctttaacacagcttcagtattgtctgagcttctcgtttaacattccttctgcaataggtgcaatcacacttaaacgtatacgaggtgtacattaatatacgatgtaagcattagattgttaccatagcaactcatgtcactattaattactctcgttccaacataaatgcaattgatgatttgcgcaacgcagatacagattttactttattcttcgtgcctaaaatggaccaacgtttcacttactagccgttgtttactaagatatagttgtatacggtgtggaggatgataagatcattggaccaatataactatataaatgtcggcaccagtttaatggaacctcgaatgcaattactgataacggaatggattaagaaatgattaggtatgaggtactcttatagtatgtagaatttctgatttgcttatgtgttcatttattctcgagaagaacccttagtatattctgtgtcctaatattacaaaaagtcaatgagagtctagggactatcagataacttcactgtgctcatcttgattcctgttctaacgacagtaacacaggatacggttagtatttttttgccaacctgatctgtgaaagaaaaatgtacctgtcaattcggttcttttttgaggccgctttttcgtatagtcgtcatcgattggatattcgtttaagaaataacgtgcttgttcatcgatttcatctatgattccattccatgtgtatgtatatatacgtagttacatataataatataaataaagatttgaaataaatatgtcgcagaaaagaactttgctcaagatttcattgctcgtaatgttgtttttcctaggttgacaattttggacgaggctgaccaataattattcatatttcattttggacaatggggcatcggggcctaagtaggtgccaaaaacttcgtcccaaaaccaggatgtgacgccaaatcccagttggtagtttttataatgatgttccaggtgatattttttcaacttacgcatgaagggaggcaatttagagtggtgcaagaagaaatgacattcgtcataacagacataaccgaaaagaccgccagcaaaaccagcgtaagcccaataaagtggcagcagagcaaataccaacttgtaaaatggagcacaaaggatgacgaacagagtaggtggcataactaaacggtacttgtccatgggcaagtaatgatggcaaccatgtagtagaaaatgtgtggcgaatgcgatgttactttcaggtaaccaatcatcgaaatgaaataggaaacggtgaagaccgtattcaatcaaagtccaaacaaagacaccgacacagaacaagaaacatgcaaatagctggttcatgttcttcaaagcaacacccatgtggtacacaactacaggcaaccaagcaactggaacaacccaccaagctgttttagttaatggttccaagaaattaccaaatagcggggcagaccccttaccgtaatgtcttggtctatggatttggtcaacgtaaaaatctttcttgaaatcactacgcagaatctgcatcagcaaaggacggttcagatccaaaaatttatgctttttgtagtcgttactgtagtccgtagcaatacttagtttctcctcggcgggcaactcctttacaaaagtagtggagtcaaactcagtaccgtcagctgacaactgcacttcaaccttatggttcttgttagtcaacaatctcgctgcctcttcgtcagttgccaagtaaccaatcaaatattcgtcctcaaggatttcatacgcggagtcgctgtgttcatgcacatctgagtctttcatgatctcagtaatgtccttaccagcatagtccaagatggactcgtcaccaccagggtgttcgctcaaaaacctggtcacgtcataaatctttctgttttgataagtgacccagcagtcattggcagtattgtgttcttgtaccgtcttttttgaaaacagttccaaagtcttggaagtattagtcgacatcttcgtactagttttagcttaccaccgcttttagtgcctgccacgataacaatagaaaaaaaaactaatcaaagacaatagacacaatagcttctactatctaatacctctgttcttatacggttccaaattgaaaaaaaaattaactgcgaaaagatgtcacacgtcagtaaatccgcgcaaaaccccgttatatttccgacgtcgtgcggtagtttctgcgcggaacggccccgcggaataggcacattttcttccggccgcagaaagctctctttatcaaaagcaagactgttttcggctattgtattatgagaagtttggtgtttgtccaactttccctgttgtcctgggaaatattctgtggggaacgtagctttgtgagcatgaaagctatcttttcgtgtatgtacgtgtgatgtgtatatgtctatgtatgcagcgctgaagccttttcagggttgttgttgttgttgttgttgttgttctttgtcgtgggctacctgctccatgtacagagtgtgattaaccaagttcagataagcatacatgaagttacttagtaatacctgctcgcgcagtcccctcttcgaattgctcaatttcaagtgactcagccggtatatggccctttcgacgttaattggtagacggtggtcgaacatgataaccgtagacactgtcagcaaaggcagtgggaacccaaaggcactgtctgtgaattgaaccggggagtttggtttgtcaggttttttgacgtctgcaaatgtaagctttcttgggggcaatatggaggtatgtttcaatggtggtgccgctggagcctgagtttgagctgaagcttcaactggggctgaagtttggactggggctgaattttggactggggctgaagcttgaactgggactgaagtttggacttgttcttgagctggagcttgtagttgagctttttgctcatcggtattctccttttggacgtgtttggagtgttgttggttggaaatttctgtcgtattgctcctcttcttgttctttttctttgcctcctcttcttctctgtctctagagttacttttggtactacttacactaacggccggctgtagttggggcaagctctcggaatcgctttcctctttcttttctatctctattgcgccttccaattgtggttgtaatggtatctgctgctgcggctgagaatctttaagggtttttacgcttattttttgggaaccatgacggctgtgatggtgacggtgaggacgagggcgattgcgcaacacaatgggttcaaccggctcccttccacttttgttaccaagctttttgcttttcctcacgcgaacgtgcacggcatcgttatttggtattgatggtgacgatgatggtgacgacgagggtgatgatgatgcatcatgcttgtggtgtggctttcttctgaataggttcgcaaaagttttctcgattttctgtcttgtctgtgatgtggcggtggaagtacttgaattgttcatttcttctttatttgacacctccgtcttctcaccgccattaaatagagaaatataatgttttttggaattgtcgagctccattctttgtgaatccacgttttcttcattttcatcgtccccttggttttcttcgttatcgtcttctctgctcattttattgttcaaccatgtccatccgtttcttcgacgatgtcgcttcgtttctttgttgtcatccgttgcgcttggctttaccatgtctgttgttccctctcttaactctaagtcttgttctactgtgtcatttcgaaccttgacgggtacctcttcggcttctttctctattcccatttcttgttcccactcgccactagactgtctgtaatgattataaatgtcttgaaaatcaccaattgacccaggcgaactcatattctcagaatcctcatcttgctgtctaaaaggggatttgtgcggatctatttcgacctttattgtattcttggtcaattttagacgttcttcgtcgtcgtttttcatttcatccacactttgttctacttctttttcttgctcttgtgacctgattcgataagtgttgaatctactccttctcagtgacgatcgttcaggccatgtcatggtattattgatgggcatattggaggcaaattcaccatcatccaaagtattcgcttgtgaagttgaaaaaccaatatctccttcatcataatgcccttccggttgtggttgatcttttttatctgaatatgaaccagccatactaagagttctggctaatgtaatggcatcattgtcggttagtcctgcactatttgagatctttgtcagttcttcagttatatctcttaacgacactggtctctcttttattttggagattctttcttcgactttatttactgtttcagaggcactgtctcccttattatcgtcatcttcgttatcatcaaactctgtatatgacctccgcaatgttgaaggccttcgtattagtgacgcgtttccatgccttgacagccccctgttcaagttgatagtgttgttctccttattttcatatgattgtgattctttatcctccccattatcctcaatatcgttattttcattgctattcccatcattatcttcaccattgtcgcttagttgtatattttgtaaagtatcttgtacaagctctaggaaattatcaggcttaacgttagggtgttgattggcgggaacccataataagtttttctttaatacgttagcatttaatttcctggatggagagtgaacacctttttttatacctaagtagttaccttgtttagtcttattggaggattctatccctgagttacccctcccatgcaagttctctagcggagttggatcgctatatcgtgtgttattaacggtggttgtgtcacttggcattgacgcagaactggatgtcgtgccagaccatgatcgtctcccactagattccccaccgaattttatatctaattctggatcaataagtaaatccattgacccaatcgacaatctttttaggttttttacgctgcggatttcattgtcaagggactgtgcagcaatcaaaacttcagacttccgtttatccctttgactagcgatcgccttatcgcttgatgtagtacgcagcatgctctcgttatctctattggacattataaaagacagctaaattctcctttgaattgaaaatatgtaacccacaaaacaaaccaaaactaactaagaccttaaattctaggagaccaaataaaaaccttaaaaaaagaaaaacgtcgaaacctattagatgccaccttctctctactcttagatctgacaacttcaataccactgacacgaacgacttgttattgagtccgtaatacaaagtataggtactttatagtcctccaaattctttcaccaaaacaccaaaactcgattttttcactcttccgtaacaaaagcccggtcgctcgatagaattccataatagtagtgaaaaaaggttatagtacataggaaattttaaacggtatacaagtacgtaaaaaaggctaaagggttattctataaccaggagttcctaccagagtttgtaaggtatccttcagggatattaatccaaggaccagcagtgcgaagtagcacttattccagattgagaccaatttggaaatgcgtccagctttcttgtctactactgtgaaatgtaaattcaatcttgaaggaccaggaaaccccatgatattgcaaagggcatgcaggattatgcagcaccataggttcccgcctgttcttacgaatacaaacttggttaaccctccaaaaagtgttgtgtataaaatttggaagcatgttgtcagcagaatggaaacagttgtcatggagccttcctgtaattgctcataagcatggtgtgcgtgcgcaagtccaaaaaaaagcgatggttgccaaaataactgttgatagcttagttgcgaatgcggtattaggtttaagtacgtagtcaaaagcattgacgtgtaaaatatttcctcagttattggtgcaaatataaaattcctgaaactccaaatattcaggaattcatggtaaaaatcttcaagtatagagctctttggatttaataaatgatataatacaaaatctaaaacgggtccacaatataaggtcaataacatcgcaacacatttcgttaagtctttcacgaactggctgaattgccaagggtttggcaatgcagcgtaataacctgggataatacctaagcctaaaaatgcgtccttgaaacttatatgtgaagtggtactagataattgagattgtaaaaaaggcaccaaaaaaaggttggaaattagcataattgtaagtttttgcatgcgagatttaatcgttcgaggattatctcgtttagacccttctggttgtgaagttgcatatagcggtagcacataggatatggagatgtataggagcactagaaatgttgagaattgtagcattgctgttctggttctctctatgacagacagtcagtagtcaaagcatcaatttatttcgttttatttttcttgacaaagaaaattctatgttttgttcctgaaatctcgatattttagtaacttaaaataaaggtaataaaatcatcaaaggttttccatccagtggtccaaaaaaaaaaaaatacagaagcaacaaaagagcaccagaaaatgcattttaaaagaattttattaataatagggaatacaaaggacgcgataaataccttcatctataagcaaaccatacatatatctatatctataagaaaagtaacgagaattttttctaatgtttttttattttgtcacttgcctaacagaaatagggatatcaatcttcgctacgccaagatggttttcaaatttaatcattactcgaacgcaataaaacctacaacataggcagctttcaaaacttggaattaaagtttccttaatgtccttattaaattccaagttcacattaatgtctcgtttgtactgtaaaggagcaatcctaacccatttatgaacaatctggtctgtaaatttcagggaagtagacgagctaccgctaggtaaaaataaactactcttggatgaagaagttactggcgttaatgacgctgaactgggcgacgatgaactaccgttacctgtgtgcgatattgaatcctcagataatgcgtgctttgagtgttgttttagggtactgacctgttttttaaaaatgttggataagttgtgaacactaactttcaagttgcaaatgctttcgatatcgttaaacagctgtgaagtaataaaatctgtaaatttcagttcctttggcctacggtctcccctattcatattatataactcatttaattcaagaaaattcttgttgaacttggtttcatattcacaaatttttgaatggaaatcatcgtacaaagctttgatgcttgtcagcttctctttgttcatcaacagttcagaattgagttttattgggatagaattatcagatttagcagttatacatatcagttctgtggtaatcgattgaatttctggcggatcatgaggtaagctattatcggattctatgcaagtcaattgtaaatcaagtttttccaatggtttttttacgtcttccggaatcaactcagacaatctcacccaattttcttggtcgtgtttactcttagattcaaaaacattggtctttctcaataatgagggagcccaatatggtaggccctgttttggaattttcgcctttactagtattagccctgtcctttctttatttcccgttaaatcatgattattctttcccgcatttgaggaagaggacattgagctggaactgctgtttaaaaaatgagagaagttcagaaatgaggaggaattggatttgtttttcagtttatattttagttcactttcaacaaagggaccccaagctctggaagtatcggtattatgaccactatttccactgcggccattgtccaaatcgtggcccaacttcaaatcgttatagttgactaaatagttatttctgttcttaatgtgcagttggtccaatttcctctgcaaaatttcttgggagtctgattcaatagaatcatcaatggtaccactcaagtctgcaccgtgaatgtcgcggttcgttatgggttcttttttctctaatctctgaaagatttttctaagagcatccaacctttcctgcactagtttggtgatatcattcagctgactcatagtggttctttctccgacgacattggcgtcaaaaccaaaagggattactcttagattatattctctttccttcataatatacagtttagaggccttttgatctttaccgacaatccttgcatcaatagtgtaattgatcgaaaggttgtcatcagacatatcgttagttaagatgggggagccctttgtacctaaatgaccgcacccaagtaccctattgactttgataccggaatatttgcaattgttcctatatttatcaataccaaaactgggaggtaacaaacaatgagagaaatgctcctgcttacaagtgacatctagcaattgcagtggcaatttgaaaatgaagaatttcttgtacttgactccgggttccagaacccggctattgtttagcccaaatacagaaccatcgtagtcaacatctgcgggaatgaagtccacaccggaccccagtgctattttcgagtatgaccaagaagcgctcaagtctaccatccttaaaaaccgtttaatcgttcttttactctttactttatcaataatggaaatgtaagactctaaagtgacatagaacatttcaaactttaggtttgcttgagatttgttttcaatagtgataaaaccatgaatcaaatcccccgacgtatactctttcaaaatggactcctcctccggcttcacgtgtggtataggtgcatgcttcgtcgtcttgatggtgatttcgatgggtgtggacatttttggtaaagtgtacaatttgtcgatgaaaatgttgtctgtatcgttcaagtcatcaagtatgggaggtatatccagtgaatcttcatcgacagcggttgattgatgtgctgcaatactgtgatgttcggttcgaaggggaattaagttttctaaatttgatgttgacgaagaacgtgtggcacccaatgcgtcagtggacaatgattgatgtgagagatcagcgctcgagcccgcagcacctgttgcagtagaattattggcctcttggtatgaaggtgggaaatcatgcctatctggatcgacgttgccctgcggaatgtgcctatgcagggtattgtacatctcaaatgagggcagtacatcaacaacattgttgatatctccgtcggtcaaggaccttccggtctcgacgggggtcgcatttgcagttgatcttctcaaaggagaacgattacctccagcaggcgttccggtggaaggagcatgcgaatgagaatgtgctagttcgggacgtcttagtccaaggatccccgtagcagacgcgcttcttatccatgattttggagagtgtaacgacggtgacctcgaactgcctttaccaccctcttgtttctgcctaccacgcccccttgtgtttgcattaacgttcatagttgtcgaactatttgcggtaaaatcagatcgttgaggacgcagcaaaggcttcctcttcggtggaaaccccgaatcgttcaaatctttggccatttagcgtacgatatacctgttgacacacacgaacagtctcttttcgcccttgctaagagcttctttccataatcactatgcggctcttcattgcaatacttttatcattattaaaatagcctctgagagcgggtcacggcccgctgaagggaaagaacaatttaaagccagttttaagttcaatccaccgatggacgagaggcaaataagacggatcaaagacaccgaatcattctagcacgataatgtcgttgaatatacatatcaagtcaggacaagacaagtgggaagtaaatgtggcacctgaaagcacagtgttgcaattcaaggaggcgataaacaaagcgaacggtatcccggtggcaaatcagagattgatctactcgggtaagattttaaaggacgaccaaaccgtggagtcataccacattcaagacggtcacagcgtccatctggtcaagtcacaacccaaaccacaaaccgccagtgccgctggcgcaaataacgccaccgccaccggtgcagcagctggcactggcgccaccccgaacatgtcgtcaggtcaaagtgcaggcttcaatccgctggccgacttgaccagtgccagatacgctggatatttgaatatgccatctgcagacatgtttggcccggacggtggtgcattaaacaacgactcgaataaccaagacgagctgttgaggatgatggaaaaccccatcttccaatcgcaaatgaacgagatgttgagtaaccctcagatgttggactttatgatccagtccaacccgcaattgcaggccatgggtccacaagccaggcaaatgctacaaagtcccatgtttagacagatgctcaccaatcctgatatgattagacagagcatgcaattcgcaagaatgatggaccctaatgccggtatgggctctgcaggtggggctgcctctgccttccccgctcctggtggcgatgctccagaggaaggctccaacacgaacactacttcctcatccaacacagggaacaacgcagggactaatgcaggtaccaacgcaggcgctaacacagctgcaaacccatttgcgtctcttctgaaccctgcattaaacccctttgctaacgcgggaaacgctgcatccaccgggatgcccgccttcgatcctgcattgctagcgtctatgttccaaccccctgtacaagcatctcaagcagaagacaccagaccaccggaagaacgctatgaacatcaattaagacaactaaacgacatgggcttcttcgatttcgatagaaacgtcgcagccctcaggagaagcggtggctccgtccaaggcgctcttgattcactactgaacggcgatgtttaaataaacgtctagatgccgcaacctatatacttttaccctactctatcggcatatatttaatctacgtattacatgtatccatcaataatatcatcataatatctggacacttttggaagacgcgcccttgcgaaagaaaaaaaaaaattttcgtttcacacctacagtaataaacacataataacaacgagctaatcatcccaatcaatcaccccttccccctttaattagcagccagggtactgtatttagtcatatagcggtacttgcattgaccgcgaacgtgtaaacacaagcaaagcagattatgaccacacaaataaggtctccccaaggcttgccgtatccgattcagatcgataaactcattccaagcgtaggttcgtaccttcatgagggtgataggttgcttgtctataagttctggtatttggtggaaagggcctcagacactggtgacgatgataacgagcacgatgtttcccccggcggcagcgccggaagtaatggtgtctctccgccaaccaaacaactgcgtgaatccatagaattcttcgaaagtccctacgagggggacttgattagttggaatgtagacgtaggagatgaagtagccactgctaaccaagtgatttgcgaaataaaaaggccatgtaaccatgacatcgtgtatggcgggctatgtactcaatgcgggaaagaagtttctgcagatgccttcgatggtgtaccactagacgttgtcggggacgtggatttacagattagcgagacagaagccattagaacaggcaaggcattgaaggagcatttgcgacgggataagaaacttatcttagtggtggatttagatcaaaccatcatccattgtggcgtggaccctacgattgcagagtggaagaacgaccccaataatccgaattttgaaacattaagagacgtcaagagctttacgttggatgaggagttagtactcccacttatgtacatgaatgacgatggttctatgctgagaccgcctcccgtaagaaaatgttggtactacgtgaaggtaaggcccggtttaaaggaatttttcgctaaagtggcgcctctttttgaaatgcatatctacacaatggctacaagggcttatgccttgcaaattgccaaaatcgtggaccctacgggcgaattgtttggcgatagaattctgtcgcgtgatgaaaatgggtctctaacaactaaatcattagctaaacttttccccactgaccagtcaatggttgtagttattgacgacagaggtgatgtttggaattggtgtccaaacttgatcaaagttgttccttataacttcttcgttggtgtaggtgacattaattctaatttcttgcccaaacaatctacaggaatgctacaactagggaggaagacaagacagaagagccaagaatctcaggaactgctgacggatattatggataacgaaaaaaaactacaagaaaagatagataaagaagttaaacgccaagaagaaaaattgaaccatcaactggcgactgctgaggagcctcctgcgaacgaatccaaagaagagttgaccaagaaactagaatattcagcatctttagaagtccaacaacaaaatcgacccttggccaaactacaaaaacacctgcatgatcaaaaactactagttgatgacgatgatgaactatactacttaatgggtacgctatcaaacattcacaaaacttattatgatatgctctcacaacaaaatgagccagaaccaaatctgatggaaatcataccaagtttgaagcaaaaagtcttccaaaattgctattttgttttttcaggattaatacccctcgggaccgatattcaaaggtcggacatagtgatatggacgagtacatttggtgccacttccactccagatatagattacctgacgacacatttaatcaccaagaaccctagcacttataaagcgcgtctagcgaaaaagttcaacccacagattaaaattgttcacccagattggatatttgagtgtttggtaaattggaaaaaggtggatgaaaaaccctacacgttaatcgtggacagccccatctccgacgaggaattacaaaactttcaaacacaattacaaaaaagacaagaatatctggaggagacccaggaacaacagcatatgttgacatcacaagaaaatctaaatttattcgctgctggtacttcatggttaaacaatgacgacgatgaagatattccggacacagctagcgacgacgacgaagatgacgaccacgacgacgaaagtgatgacgaaaacaactcggaaggcattgacagaaagaggagcatcgaggacaatcatgatgatacatcacaaaagaagaccaaggcggaaccttctcaagatggtcctgtacaacataaaggagaaggggatgacaacgaagacagcgattcgcagttggaggaagagttgatggatatgctggatgattagcagctcagatgccgtatctttccacacattttcctcattggtctttgtacctataattgttcatattatatatacgtttgtaacaaatcgataaatagcaacaatatttttgcttattttgatatcctgaaatccttttttttttttttttttttttttttttttttttgatttcatttcgttttttttttttgaacattatatattgtattgttttctccctgtagcgagaactaattgattctttctcctttccccctaaatactcaacagtactctcgagccattagctgctgcaatttcaaaaaatgttgcaaggaattttagaaaccgtaccatctgacttgaaagatccgatatcattatggtttaagcaagaccgcaacccaaaaactatagaagaggtcaccgctctctgcaaaaaatccgactggaatgagttacacaaaagatttgattctagaattcagtttggcactgctggtttaagatcgcaaatgcaagctggctttagcaggatgaatactttagtagtcatacaagcgtctcagggattggcaacttatgtaagacaacagtttccagacaatttggtagctgttgtgggacacgatcatagattccattctaaggagttcgctagagctactgctgctgcatttcttttaaaaggatttaaggtacattatttgaatcctgaccacgaatttgttcatacccctttagttccctttgcagtggataagctaaaggcctccgttggcgtaatgataacagcaagtcacaacccaaaaatggataatggatataaagtatactattccaatggatgccaaatcattccacctcacgatcatgccatctctgattccattgacgcaaatttagaaccatgggccaatgtgtgggatttcgacgatgttctaaataaggctctcaaacaagggaaattgatgtattccagagaagaaatgctgaagttatatttagaggaggtttctaaaaatctggtagaaatcaacccattaaagcttgaagtaaaagccaaaccttggttcgtttacactccaatgcatggggttggatttgacattttcagcaccatcgtaaaaaaaacactgtgcctggtagaaggtaaggattacctatgtgttcctgaacaacaaaatccagatccttctttcccaactgttggatttcctaaccctgaagaaaaaggtgctttagacattggtataaacttggctgaaaaacatgacattgacttacttgttgccaacgaccctgacgctgatagattctctgttgctgttaaagatatgcagtcaggcgaatggcgacaactaacaggtaacgaaatcggttttctttttgcattttatgaatatcagaaatataaaagtatggacaaagaatttcagcacgttcatccgttggctatgttaaattcaacagtgtcttcacaaatgataaaaaaaatggcagaaatagaagggttccattatgaggatacattaacaggatttaagtggatcggaaatcgtgccatactcttggaaaagaaaggctattacgttccttttggattcgaggaagcaataggctacatgtttccagcaatggagcatgataaggatggtatcagtgcatccattgtcttcttgcaagcctactgtaagtggaaaatagaccacaatttggacccgctaaatgtcttagaaaatggcttcaaaaaatatggcgtgttcaaagagtacaatggctattatgtcgttccaaatccaactgttacaaaagatatatttgactacatcaggaatgtctacactcctgagggcgcgtcatatccttcatctattggtgaagaaatcgaagtactttactatcgagatttaaccactggttaccaatcggataccataaatcataaacctactctacccgtcgatcctacatcacaaatgataacagtatctgctagaccaagtaacggtagtgagaatgagcatatccgcttcactattcgcgggtccggaacagaaccaaaacttaaagtatatattgaagcttgcgcaaatgaagaacaaagagcctctttcttggcgaaattgacttggaatgtgctgagacgtgaatggtttagaccagatgaaatgaatatagttacaaaattttgatactattttaacctatacattaagaccaagcgacttaaagaatgccattatatttgttgtttgtacctacacttatatcaatatacatttaactagtttatgcctccaaacttctatcttcagattttctgtgtcgattccaaaggttttcaagcatgtaagtcacactaatcacaacaccaagagaagcgagcccaactcccagatatacagctgctcggtaacctttcaacaaatcattgccgcttttattaatttggtgttcaacagtgcctcccatacctaaacatagagacgctgaataattaataacggtgtttactaatgatccagccataccttgatactgcattggaagcccgtcactcaatataatggatgatgccgggaaggacaggtccataccaaaacataagatagcctgcatcgcaaagttcaacttccaatagctttgttccactggcaatacactaaacattatggaaccagcgtcaaatgccattagtgaaaaacatagtagtagagctggtcctaatctcttgatagaaaaggcaacgaagaatgcagccatggatccgaaaattacgaaaacgaaatacgtacctccggtccaaacaggactgtaatgcctcaaatttagttggaaggaaacataatagaatgtccaaataccaaacgacccccatcccaggaataccgccaataatatcataatcatatgacggttcttcgtcattgcacgtggtagaagaggaacctctgcgtatttactttcgtaaacaaaaaaagcaaccaagaatatcacagatattatcaaaagaacaatgatataaggtttgtcccagccaactattggtgcttgattccagacaaagttgaaaagaatcagcccgataatggcaagcgcggacccagtccaatccatcgaaagcccatgaatatttgtgggaacgttgtttgggatggagtaccatgccattaataaacttagaaacgttgcaataccaaaggcataaaatacccaaggccactgattggggtcttcagtgacaattaaccccccgaataatccaccaaacatgccgcctgttggagcacatgcgccgatgaaactaataacaatgttcttcctgaatgaaccgaccttataaacatgaccaacaagccccataatatttggtaaaataaacgcaattccaactccttggaacgcacggctcgtaatgaaaaacgcgtcgctattagagtatttggagagaccagaaattatagaccaaacgattacgatgacataaccaacgatcaacattttcttcaatccataaatatctcctaacctcccactaataaggatgaacgacccagcagccaagggaaaagatgccatcaaccatgcctgattgtttgcttctgaattaaaggatttcgaaagaacgttcattatacagagagcgtgtgtttggcccgcttgattcaataactgtgccaacatgcatgtcgctatgaacattaattctttcccaaaggaactgaagtaagtggggtcctgccatggtgagtcattggtcacttgagttgatttggttgaagaaacaattgttgtcacctcttcatcttctgtggaaaccactactttatcttttgctttcactgtaattttctcatctatctcagagtccgtgccctgcacgctcgttttctttttgaagattgaaaacatttccaatcagatctttgagttgtatgtttggtgtgcttagattggtttccagaactagccatggttaaaagatctatttccattgccttatatacctatttttgtccaagccaaatgtctctgagtatttcctcgaaaaactgatatgaaagaaaatttagttcgtaaccatggcaatactatagcataatcttcgtcatgccattgttatctcataaataaaactcctataacaaagcaaaaaaagtttacgcgttctacggacatttgtgtaggaaaaataaagattttacttaatcaatatacgagccacgtttttggcgtcgcattgtcggcgctatttatgcgcacccctgttgccttctcttcccttccgtgcagcctccgcgctgtcagatggtcctccggtaacgtaaccatgggaactagcaaaaaaatttcctaatctgaaatgtagttccattaataaatctgaggaacatgggcgctgcatcaagatgtgttttggcgtcgtctttgttatcttttcttttttccaacaataaatttggctgttcataaggtgaacgaaagctacggcaattgccctattaagaaattatacgtaagaatgttatttgtttcatgaatatttagaggattccgttttgaatatattacactatgaaataaagaattatttggcgttttgccattggaataaatcagatacattatctgtgttggaacttccgccaccagaactttttgatcgatctgtattgtaacgatttttctgaggccgtcttggaccacggtgggacgccgagggccctgaagaggtccttctcatttgaaacagtgtagaaggtgtatccaactggttgccagttgcactctttgagttctcttgagaactactgtcaccttttgaatcattgcccgatgaaagagatctttgattgctggtatttctcgtacttacggaggataccatcccttgacttaaaattgagtcggtaggattcaatacttctctggcattcatgcgtgaccgatccaagtcatcgttaaatgtcgtatctaggatgatgctgtttttacttcgatttgacgtagtagacgtcgtgttggtatttgagatatcgggcgtatccactaataaaggagccaacccaagtgatgcatctacaatgtaatcatagtcgaccccagaataattgacatttgtcatgaaattgttaaaattacctaaatcgttgaaatcacagttgtccattccatgctttgtacttccaaggatactgccttggctggtattactgccagttgaaggtggtttgaagttggcacctgcatttgtaacggcttttttatttgttcccggatccgctgacgcggagttctgatcattttggtataaaaagttgttaatactaatattcgagaaagaattatcgttgttcagcaatctcattagctttgttaggctgtagttactcttgttgttgaaagagagattattcttttccatattcgtactttttcctttctgatgaaattggttgttttttgaattctcagggttttgcttaataacgggttctaattgttccggtttagagtccatattatccttcattagatctaaattacttggtagactgaatatcgcatccatgtgcataggcttattctcaatcgtgttttgacctatattggagttaccggtctgtaagaatggtgccatatttaaaaagcttaagttctctatattggcatccgtggcatctgtagaagctctgttacacacatccacgttgccattattagtattcgtacaattcggtccttcaggatgggtgaacagcgcagtaaggtctgtattactaaacgaaaatggaaacagattgctggtggacatgttttttttggtatcattctggaaattatgtgcgttctcccccttggatataccgccatcttttgcatttcgttttgcatctttttcatactttaatctcttattaccattagttgtatttgtcattggagagtgacccgcttcagaattattgttattattactatcgtttccataaagatactcgtgttctgggttttctcttttgacattaggtgttctttgtctattttccaggctgttcttcgattgagagccaaataatggttttaaggatgtggttgtggccggtggtaaccccatcaatctattgtagtaattcaatttcttttccaagaatttatccagtctttcaaccttaacattaggtgctttcaacaacaggttgatgctcatgtcaaacagtttcagcgtgtgccaagaggcaattccaggtaaatccaaaagcctatcgttttcgatatctttgatggtgtcgaggagaagatttttattatctaagaataacgcaccacctttggtatattccaaagaacctctagcacagagcaaagaaaatctgattaacgttcttgatacattcaatggcaaaggtaaatacatggaattaatggcctggaaaatcgtaagcgttgcattggtagcttgttgtaaaatgatatatgaggatgatgtccttatagcaggagaagtcatatcaacatctaatatcatgtggtcctggttggttgcgcctttagagtcgttgttgaacattgactgtttcttctttgtggcattatcaacattcttaggcaaaggtttggttgcaataaccggtaaatgtatcatagatttggccaagaaataaaacagcaatagaatcttcttttcaaataatattatgtctttcttatcaaatttggtctcagtatttctttgattggttgctctaatctcgtctaaattcacagttccgtttacagttatttgaaagtagtacatttcgggaagttgatttctccagttatccagtgcgttttcatgtactaatgcaacttcagaagttatacgttcatccatcattcctctcttaaaaatcgagtctagaatgttacctaatattttcgcaaatctgattatctgcaatgaaaagcttgaaacttgaccttgcagttgaatctttttagcttttttatctgctttttcattttccatagataactgatccttatactcaacatcagaaattggtaatgcacattcaatatcaaaatccttaagtaaacgaggaacaccaagttgcaatgaggcaaaaacgtcaacgtaataaattgcccaaaacagtaatctcctctcgctttgctcaaatttttgtagaactgggttagagtgtacacttaatacggcactaggacatctgtgaagtctcaattgttgtgccatagaaacaatacggcctcttaccccatagattgccgaaatatcacccacgtttaaataataaaaggatgccaaagataacaattgtaaggatggtaatgaagttgtggacatatttaaaaaataaggatttttaggaattattagggaaagctgatgataatatgccatcaatctagcatatttggccttcggattcttcggtacagtgtattttattttttccattttaatcttaacgagtaaccccatttgtaacatcatcagaagctttagggcaaatatttcatgattagtggtgactgtacttttagtagtgttattcgtctccaaattttctgtagataaatgcttcacgacttcaacaaaattgttgaaatatattaagaagtggtcattgtttagaattggtacctgattagaccaaaatttgaaaaaaaggtgtaaaagctctttaatttcagtgagggaaagtagttcatcatcctgatcattagccggcttttctgattgctttgaaaacgagttaatgttaaatttcaaagaaattaaaaactttttcaaatcgacaaactcggagaggtttgtgctttgaaaccttttcacaaaagccgaatcatcatcaagttttttatcttcatctttctcctttaacttggttgatgttgaaggtgctagaagccgtggtgctggcaatctatttttcaatgaagataataatgaaaccgtatacaaacattgctttgagttgaaaccaaatatttgtcttatcctagttaaaagctgaggaataaacagaatttcttcagtagatcttgggatggataaagaaactaaagttgccaattgagtgctacgttgatgagtcgtcattgattttaatgcctttaccgcaggaagaccaggtgcctcgtcctgttcaaaagatatagcggttggatcgtttaaactcgtagaagtaggcttgacgtgtaaatgatttgtacaggaaacgccgtcacaaagatggtctttgtgtggcggtggaggtggtgcccccaatggactcattgcagaaccgctattatcaccatccattttgccattttgtagctgcttattaaccgtttgatttaataaatagatatttgtagaagacagattcaatggagcatctttcaaatcatgtttgaaattgccatttatggtattatccgttgatgtctgtggtcgcgactgtgaaacaaggcttatttgctgttctttgatatcacacaaagctagcaaacgcttattctctgcctccagttcgcgtactctttcttccaggctttctgtgtacccttttggatacgctttcctcagtaatttatcgcttattctgcattcaaatccgacagcagcacactgcgaacactgtggtctttttccatcgcaccttgttttcttagatcgacacctgtcacaagcttgagctatcctgtaaataggtgtagataaaggagtcggagaagctgtcttgatcattgcttccttcacgttcttggaaaaatgagggtttgcctccgaacttgaagttctattagatatgctaggaccgctaagcgcttgtgaacccagagttctaatgactctgggttccaaaccttgtcgatcagaattattatttgccataattttgtgtcttgtcttttactcaacttgtaaattctctttagggtgttgtaactgtttatgaagaaataaataccgtaatgaattattaaattattaaattcttcgtctttttacaatatcacaggtttaaaggggagtttaacaaaatctactattttacggctgttttctttttttgagtgtcactgaccaatcatgctttcgtaccccacaaaatatcagccccgccgctccatgcatgtctcggttatcgcttaatacgaatataatcactgagaacctcggcggcaaaaatatttaccaataggcaaattaaacaccgaaaaaaagaagtttcaagtagaagattatcccgaataccaaaaaattgcacgagaaagaatgtctttttatgatttattgcttataatactcaattactctggttttctccgttcctgttacgcacataaactctctctgtctctgatatcacaactcatatcgcgaataaacaccggatagaaagaagtgagaggagctacgataactgaatatactctttcatcaaaagtaatgtgctaataaaaagaaatgttgcaccatcttaacagatgtaaaaatgttctgcagaaggaaagttgtgtaatcatacacattcaatagtataagtcgtatcacaatctgatgataaaagttgttacctcttttaactgcctctgatccttttcacattcagtaatttctcgtagatgtatatgtgcgaatgtgtcaatgtgtttgtatgaaataaactagtagccgggtaacaagtactcctaaattcccgcttcgccgtttctatctcattggagtcgtcccttctagaaggtttactagttacgttaacgtcatagaaaaaggaaaatcgacgctgcgcttttatttataatcttgcattgccctccttatttatcgaattgttaagtgtagataggtgacgctagagccgtatattagattctttcaaaccctgaagaaaagttaaatgaagatgttgaggcgtacaaaggtaaatttttcaaaattgctttacaagattactaaactagcaatagtactgacgatcctatatatttattttacgcccaaaatcgtctcccgaaacaatgcatcattgcagcatatttttcctcataaatatggcgattatgaaatcaatttggtcatagcgcaccctgacgacgaagttatgtttttttcccccataatttctcaactgaattcgtactttccgagaaccgtcccatttaacataatctgcttatcaaagggcaacgccgaaggtcttggcgaaaccagggtaagagaattaaatgagtcggccgctttattgctacacaatgaaagagcagtctccgtacaggtgatggatttccaggatggtatggacgaaatatgggatattgattctataacttcttctctttcacaaaagatagatataaagaatcataacttgaaccagattatcgttacctttgattcatatggtgtatcaaatcatatcaaccacaaaagctgttatgctgccgttaaaaagttggtggatgattatgctcaacctaagaccaaaagaaatgaacaaccacctcatgtcactgcgctttatttgagaagctacaagaacaacatcgttttaaagtacaactcctttatttgggaaatcctaaaaatactttacgacctgatttctccattccgtagaataattcaggcgcttccgcctaacacagccgccgaaaaagacaagctttcacttatgaatacacatgcacaatacgtactagcgtttgccactatgctaaatgctcacgaatcccaagttgtgtggtttagatacggatggtggatattttccagatttgtcttcgttaatgaatttgatgtttatacatattagactctacactgtagatatatatataaaaaagtcccatattatttacatcctatagaataagaatatggagaaaaataaatgctaattctacttacacttttcttaccaaaggctacctataatcataccatcatcttcatcgtcatcgaaactatctagccgcactttctccctttcctttttgttctcaatcttgtttttcattttcttacttcttagaaacatacgattcgcacaaaaaatattcaaatctttggtcatttttctatcaaaaccataactatcaatgaattcccttaccgctgaaaatctacctctatttacaagctccttaataatacatttttggtatttgataatgatattgttaacttttccagcattttctgctctcgttctttcgatccccggtttgaaactccttaaaacatcaattccaagcgggaaattgcctgttttcttcatgatatcgtacagttgtctcaacgtctcataatcaactgaaggccttagccgcttagatgcataccactgcttcattaaatgccaacatctaacaacagaagtggctttcttgtcgtttgctggtgtccaagcaaaatgacttagctgaaacagccttctccaaaatagcgcatccaatttcacgtccggatagtgctttatgaatgaatccaaaatacttaggcctctgtgaagatcgtggtcattaaagtagaatgacactaagattgaaacgagtattttggaactaggatagcaccctcggtgcttaattactacgtgactaggaaactcttggggtgatatttgccatatatgttcaatacaccgttccaatatttgggtttggcctaggtgtccaaaggattgaattaaagtggacaacaaatcctcggaattcaaaagctttttctcctgcagagcaagatcagcaatctttaataatgtttggtgatccatggctttgtaagtagaagaaagacgaattgacgtatttttcgcacctagtcgaaccatttttcttaaaaaaccttgtttttgctcactattatctggtattttccaataaggcgccaaagcgccacaacgcagttgtaaaaagtgaactattgtgctaatatctgcatttttcggagacagtaatatatcaggatttctatcaagaataaagcttaaaattttttgagccttacctaattgaccgagctctataaagttcttgatcataagatttgcatcaaatatttcacatgcatctagtttcgtattccgtaagttaacttggtttctcttggcatcaactttttctgcatataaggaaaaaagtttgaaccaaaattctgaatatttagcgtttatgtctctacagattctcctaatttgaaaccgttgtgtgtatagtttgctcaaaagaaaagacaggtcctctaaagacagaacatccttcggttcagggtccacggttttcgcgaataagtaacttatactcttggaaaattcggattcatccattccactcgagctgataattcgttttaatgtgtgaacatctataggtataccttttgcctcgaatttgtcataagcgctcccattattttcatcttttgatcgatcaattgcacataccgtgtgagttgaataggattttttgattaaaatatcatttatgacagccctacccattacatacgttcttcggggatagacagaatgacatattgtgctattcggcagtacaccaaattcacgcagcgatttcactgatacagtgcagagcctcttcgtgtaaaacctcagaacactgtaggatggatgtttaaccagtctatttatccacattaatcataaatttaggtagtggactgttaacgaaggagagcttcgttaatttgttcttgattttacatattcttttcattagccaatgtctgaagggctctttttcaatgaaccttttctgttcaggataaacggtaacccgctctttttctaataaaaactgacgttatttgatattaaaatatacagtgacattgcgagtaaacatctcagtattgcctaactcactacattaaaaagctattgacgctgttcagtgttgctcttgaagggttaacgttgcgtcctttcaagtgggaaatcaattttgtcaagtgttttcttacaataagcttactgatgtccggtaactccgacgtaagcatccattcttcagtatatttggtacaaaggatacttaagatgacaccgattgacatatcagtacctgtattgcagcatattagcattggctttattttttcatctcgatttgtaaacaacgattgaatttctccatggattctagggaatgtggatcgtaaagcttttgaacttttcttgtctccgctttgcaacttgtatattgaaataaacggatctgtcccactttcttcttcatcgtctgtatcttcagcaacagtcaccgaattactgaaaattataactttaccatattctgacttcaatttctgtttcaaattcttattgatggttaagcctgaactcacttttcctagagatatctcattcgtaattttatcaatgtttccaaagacttcatccaagcttcctttatcttgtatataacactgatttctcagctttgcagcagccaaatccatgatgtaatcatgtaactggtcgtctgaataacttgcgtcgcctaggtattctatatgggcccaaaacatatttgaatccaaaccaaaagaccagagctcgtgatcgtcggctgcaccctgcacataagtgaagccgtatcttttatccataccatcttgtgcttgatagcttaccgtgcacaaaataatgggtattatgttttggtcttcaggtgtttcccaggcttcatactcctgtacttcacccgtgaagtaatcaacagaatggtctagaagtgaagaaccagggtgaacccatatgggccgcaataacttacccataaacagttcgttcaatttcttagaatctataatattcaatttttgtagtttagcaactagttcgggtatttttcgcttaatcatgtcatattctgatttgggaactgtctcaggtggaagatacagtaccttatcgatggcaacatttttttctgtttcctgaagcattaacgtatttaatacagcacaccatatggggacagtcttactcaaagcatctgggatttttttacctcttctagtactatcgacaattataatacctttattatctcgaatggtctctaacaaatgaaagttcaatcttcgggtgctaaagtcccattggttgacatgcccgtctgtgctcttaaagtaactggtctgtttgaaacttgatggattacagtaccatagcccacatctttcattgggtatcagtggataatggggaaatatagggataactcgatcttgcaaaaatttattgtctaaaagaatactctgaagtcgattccttacggacttgttttcctttctgatgtctttatttatctgagatagcgaaagataaatattttcatccatcacggatatactaaactgtactctggatctatatctctttgatagcctcgataccatccatcaagagatcaaaattttcaagcatgctttttttttcctgcatatgaacaatgaataatgggcccagtcacagttaagcagtaataagaacaaagcacataaacatacaacgcatatatgaagagcaatagagtggtgggatgattttagaagttcatttttgatgaagatgataagattatgtaatagcggctatgctaagctcccttcgggcatggaaatcaacaaaaaagttgtaaccgtacataatatgacgggaaatgcaacaagctttccaagaagtaatggaaggcatagctaaaggactatctggctcggccataagtttgaaatttgtgtatacaggtataggaaacccttatacctacctaaatcgtcgaagctactgatatattgcgtatagtcgatatgcccaatgtaattcatatttcatactcttctcttgtacagattaagggcacctgttttattcttagaatatactacaacctgcctactaattaacaatgatactattaacggtgcaaaaccggatgctcaaatttaaagtgattactcagttataaacacgcctggtgtgaaattaacgaccattaataagaataaatattactggcatattataatatgcggtggaaaaacataaaataaggattgagaaatagttatcaagtataatggaagctgaagtgcaaggattgataatgtaataggataatgaaacatataaacggaatgaggaataatcgtaattttattatgtagaaatatagattccattttgagatttctatcctcgaggagaacttctaatatattctgtgtacataatattatatagccttgatcaacaatgcaatcccaacaattatcaaattattcacccaatattcagtataatccatatttatagaatatataggataattatcatcccctcaatcaagttgatattccgttttgacaacaggtcacttctgcaaggttgcttatattaaaattgtgaataagcatgatattagacggactcataattgaatggttatcagttaattgactctcggtagccaagttggtttaaggcgcaagactgtaatttaccactacgaaatcttgagatcgggcgttcgactcgcccccgggagatatttttttacttttgattaccttaatttttgaagattctcaatttcatgtattagggattgctttaaggtagctaccaaatgacattctctgtattactgttctagttttcaacagtaaagctatgatttgttaagtgactctaagcctgattttaaaacgggaatattatgcgctcagtcactaatgcatttggcaatagtggagaacttaacgatcaagtggatgaaacaggttataggaagtttgatatccatgaaggaattttgttttgcattgaactatcagagacaatgtttaaagagtcctctgatctagagtataaatcaccattgttggaaattctggaatcactagatgagctaatgtcacaattggtcataacaagacctgggacagctattggttgctatttttattactgtaacagagaggatgccaaggaaggtatctatgaactttttccattaagggatataaatgctacatttatgaagaaattgaacgatcttttagaagatttatcatcggggagaataagcctatacgactattttatgtttcaacaaactgggagtgaaaagcaagtgcgcttatctgtattattcacattcatgcttgacacttttttggaagagattccgggtcaaaagcaattaagcaacaagagagtgttcttattcactgacattgataaaccacaagaggcgcaagatatcgatgaacgggcaagattgagaaggcttacaattgatttatttgataacaaagtgaattttgcaactttttttattggctatgccgataaaccatttgacaacgagttttattcggacatactgcagttgggttcacatacaaatgagaatactggtttggattctgaatttgatggtccaagtacaaagcctatagatgctaaatacatcaagtccagaatcctaaggaaaaaggaggtaaagaggataatgtttcaatgtccattaatcttggatgagaaaacaaattttatagtcggagtcaagggttacactatgtatacccatgaaaaagctggagtcaggtataaacttgtttatgagcatgaagatatcagacaagaagcatattcaaaaagaaaatttttaaatcctataacaggagaagacgttactggtaaaactgtcaaggtttatccttatggtgacctcgatatcaatctatcagatagtcaagatcagatagtaatggaggcttatactcaaaaagatgcgtttttgaagattattgggttccgttcatcgagcaaatcgatacactatttcaataacatagacaaaagttcgtttatcgtaccagatgaagcaaaatatgaaggttcgataagaaccttggcttctttattaaaaattttgagaaaaaaagataaaattgcaatattatgggggaagcttaaatcaaattcacatccttcactatatacgttatcaccctcaagcgtgaaggactacaacgaaggattttatctctacagggttccattcctagacgaaattcgaaaatttcctagtttactatcctatgatgatggctctgaacataaactagattatgataacatgaaaaaagtaactcaaagtataatgggatactttaacttgagggatggatataacccatccgatttcaaaaacccactattacaaaaacattacaaagttttacatgattacctgttgcaaattgaaaccacttttgacgaaaatgagacacctaatactaaaaaagacagaatgatgcgtgaggacgattctttaaggaaactatattatatacgaaataaaattttagaatctgagaagtcagaagatccaatcatccaaaggctaaataaatatgttaaaatctggaatatgttctacaaaaaatttaacgatgataacatttcgataaaagaagaaaagaagccctttgataaaaagccgaaattcaatatataaagacgattgaaatccttcatatctataacgttacatacaatatttggtagggtagggtatttgatgtaatatttattattaagaacttttgtcgtgctaaacgttgtactgtacaactattagcaagatatttatgcacgacagtaatctatagttgtaactctaaatcacacaccatagacaaatgatcacttgcatattctccaacatgtggttgtccatgctttgtcatttcattaccgggcggcattctcaaaaaacctctgcatttaactttattttctttttcaaaatcgccaagggtttccacttcctgacaattactttgtgggtcccatttctttacataaaatagatagtctaataaaccacgccaagtgtttgcccaatttgaaatttcaggctcacctctatcattatcaagacctgcattttctggatgaacattcttatacccaacagagtatagtgaaatagccctcatatccaatgagttatggagttgtgccattttatctacgagttcagactgttcttcattagcatgaaatttttcaggaacggggctctcaggttgatctttaccatatttttcaatattcccgccttcttcgtcatctgcaccttcttcgccatcacggaccttggaaaacttatatgaagtgctgcacccaatgacggtctttgccctgtttctatagtgcactggtttggatgtcatagataaatatggtgtgtcgaacggctgggaattaaaatcaccacagaaaaaaggaaaccaatgagataaatccccatcattttcgttctgtaaaacattcacacgatgcatgaattccttcatcttttttaaaacaatatagcattgtcttgttcgttcataagtaccaaatggatgccaaaatagatgcgtagtgccgatcaagataccgcattttttagacgattttttacccaaattcgacagtactttctcagaaaacttcaaggctaagactaatcccacgttgtttgtcgttgttctagtggaaatgctttctgaactttctttatcatagtcgattagcattttgtcaacctggtgaaataattctctcctccacattatcgcgacaccatggttttttgtagcatttctataatattgtccatcgtatcccaatttactgaattcatctttccaaaagctttgaaactgaatatgatcaatctcttgcaaacaaatgacatcggaattataatatttaaactcgtttaagagaactttagaacgcctgtaccattttaaagcgtcaccactatccgggaacagctttctgcggattagagcttgcgccaagcaattataagtcattagcttgaatctaaatccagttactggctctgcctcatgtagagataggaaaggtcttctgataaaatgcagctctggcgggcagtccggatcaacaccttgagccaacattgcatctcttttagcctttctcataacttccctttcggcacgaaccttagcgatatgttctggggtcactatgggcttcgattttttacctttcttgcccttctttttatgttgaagtaacgaatcatcattggtttgatgttttgcatcttttacagatttattaatttctacttcttggtcgggcgcaacatctggggcaaccactttgacttctttgtcttgtgtcatatttacttaatactcttaactacaattaagaagctataaggagactacaatctcatcttcttgcaacactacttttcctttcctcttgctttagtgcaaccattttttgaaaaatgaatggtctttctgcacgaaatatctctcgaagagcttttctagatattaaggataaagtatatcatcccaaaagttaggtgatggaatcaatattgatggaccagctaaaacacgttgaaagcagatatcaggaatggtgttttacaaagtcacgttgagtaggtcgcttatcggtgtgccacacacaacgaagagcattgtcaaaagtttgggtttaggtaaaagagggtccatagtctacaaaaaagtaaacccggccatagctggctccctagctaaagtaaaagagttagtcaaagtagaagtaacagaacatgaattaacaccatcgcagcaacgagagttgagaaagtcaaaccctgggtttatagtggagaagagaaccatcgactgaaacagcgaaaataaggcaactggatttcctttcttcttgatattcctgacttatatatgtatatagtattattttttcctgcataggcacatatgttaatagtaatttatgcaatttttgatacaaagaaatcaatacactatctcgatttcatattttatgtatgtatatatttacaagaagaaaattatgcatggtctattgaattttatatttggaaaaagagtccctttttatagcttttccaactctaacattccttctaaacagtcaatttttgaaattttacaattcttcacgatatctccaatcatcggataatgcatagaacttggatgcaattttaatgttcctctagcgaacgataagtctggaaaaacacatccagtaaatccgttctgcggtactgatgttaccattacatcgaaagtcctttctggctctagtttggttagcttttttaaataattcagtgtccagtacgtcgacgaattacggctagccctttttaaaatatccgctcgagattgaattggccagatcaaactgtcgatttgtgtttgattaaaacatagaggctttttctgcaaatgacggtgaatttgtagatgatttatcaagtctggaaaacgacgaagaggggatgttactgtcaaatattgtttagctccaatcatttcatgtctaaaaggtcgacctgtataaaaactcgagttcaacaatgaagaaagcttaacgatatcttttagcttgggaaaaattcctttttttgtacttgttatcatagaatcatactgttgttgtgctacttcgcccagtggtaactgtttataacatctgaacacaccaccgattttgttctccgcaaaatatctacccgttaaagtattcgccaagatcatcatttctgaaaccaaaatggtagacagcgtctcctcttgatccgaaaatgttacctcagtcagttctccttctgaatcggcgtttagcatcactaggcccttattaaagccctccccgaaaataacagcattactgttttttatacgttgttctctcaataatttggaaatcatggacaaactttccaaatcctttttgacaggtgatgcttcgctattgggtgtaccgagtatcctgtcaacatcttcataagtggcctttgggaagttggacacaatgcctttccggattttaaaactgtcatacataatttcaattgattttccactgcatttagaagtgattttaacatcaacagagaaggatatagttttcgtcctttgtccttgtttccccaaatctgataagtgacaaatagattgaggtaacataggaacaaccgtatctggtaaatatgtggtaaatgatcttttcaaggcaacatttaggatatctgtacttataccctcaatatcaacattagtgctttccggaaacatagaagttggatccgcaatatgaatatataaagtgtacagtccatctctaccatagtttttcaccgacacgccgtcatcaatctcatgcgcagtttcagagtctatacaaaaaaccctaagatcgccaaaatcgtacctatcgtcatcagtgccggattttttccattgcaattcttctatattagttaagtcgtagagtttttgttgccatttcactaacttcgaggaagcaggtaatgctaaatccatgttaagtaacaatggattgggtattgagttgggtgttatctcattgattaaatcttgacatatatctcttgtgatgtcacaatccttatagcgttctatctttctgaatatttttgagatcaaagctactataattccgttattgtgaaaattcccagcagcaaaatctttcaataattggatcacagaaggatataaagctgatatatcgcgatatttcctttcattcaccaattttacaaacttattgacctctctataactgttggcttctagcttctctatcacctgcgcataatataaatgttgtgattttaagggaataatcgttactgatataggcgacagcaacgctgtattcagatggatttccccccaaaggttcgattcctgttgttgcataatcgcccagtacgtggaaacaaaggtaggtgaatttattggtatatcgtttacagtgtgatagttattaactaaactagttaagtaatttattccatttttatcgtccaaggctttatttaaatccaatttctgaactaatccgactagggtaaaaaaaggaatctgccatggacccatataattttgtaatgatctgtggagtaactgtaattttttggtagtaatgggcaaatctttccaggccaactttgaaatttgggctggatacctacttgttattagctgccttgctacaataggcaaaatattcgtttggttagaaaagttcttaacggttccaattggcaaatgtttgtgatggctctcaggctgtataagtgaatggattccagcaggtaatttgtgaggaatcctcaataacacccggtttttggtcgcaaagcacatagttccatcaatagtaacaaaagtgtatcgaggatccatagtgctacttggaagacttacacacatcgccaattcattgggtctcatttttaaaagaacaaagtcaccaacatttaagggactttccattagctgaacaggttgaaattccattgggtttggagctttcagttttgttattaattgaaaatctgaatttattaacttgtaaagcggaatttttggttttgttaaagacctccaggagtttacgtaccaatcttcggaaggtttaacatacctatctttataacgttggttaaattcctgtttaatttgaggcagttgttttaattcaatatcaggctctaatccttttgttcgttgcagaaagtctttgtttattgattctatatctttctccggtccaaccgaacggtctacaactgtctctgtagcttgatcattatctagctctcgtgtgtgatctagttctacttttgcttgctgcttactcttacttcgctgtcgtttgcctctggtagttactctgaagcaaggtgtgtaggaatgaaagctccttgcaattagaagaacatgtactttccgcctaactaccatcacctgtctttatttattccgctgacagatatgcacaaccaattatcgtctcttgaaagctttttagacgtgattgctgttatttggcacgttgttagtatttaagcttattcgggtttgcattgatatttgcccgagcagaaatctccttctcgatgagttagaactgaaacatctcttcaattacttatacataataaacatagaaagccaggacctgtcatcatgagtcatccgattcaatttgtaaacgctaataatagcgataagagccaccaattaggcggtcaatattctattcctcaggatttgagggaaaacctgcagaaagaagctgcacgtattggtgagaacgaaaaagatgtgctacaggaaaaaatggaaactaggacagtgcaaaatcgagaggattcataccacaaaagaaggtttgatatgaagtttgagccggattccgatacacaaactgttacgtcttcagaaaatacccaagacgctgtcgtgccaaggaaaagaaaatctcgttgggatgtaaaagggtacgagccacctgatgaatcttcaacagcggtcaaagaaaactctgatagtgctttggttaatgtagaaggaatccatgatttgatgttttttaaaccttctgaccataaatatttcgccgacgttatatccaaaaaacccatagatgagttaaataaggatgaaaagaaagaaagaaccctgtcgatgttacttctgaaaataaaaaatggcaatacagcgagtaggaggacttctatgcggattttaaccgataaagctgttacatttggtccagaaatgatatttaaccgcttattgcccatattactagacagaagtttggaagaccaggaaagacatctaatgatcaagaccatagatcgcgtcctttaccagctaggagatttaacaaaaccttacgttcacaaaatacttgtagtagctgccccattgctaatagatgaagatccaatggttcgttcaacaggccaggagataatcaccaatctgtctacagtcgctggcctaaaaaccattctaacagtaatgagacctgatattgagaatgaggatgagtatgttagaaatgtaacttcaagagcggcggctgtggtggcaaaagcccttggtgttaatcaattgcttcctttcatcaatgcagcatgccactcacggaagtcttggaaagcaaggcatactggcataaaaattgtgcagcaaataggtatacttttgggaataggtgtcttgaatcatcttactgggctgatgagttgtatcaaagactgcctaatggatgatcacgttccggtgcgaattgttacagcacatactttatcaacactagcagaaaattcttatccatatggtatcgaagttttcaacgttgtactggagccattatggaagggtataagaagtcatcgtggtaaagtgctatcttcttttttaaaagctgttggatctatgatcccattgatggacccagagtatgccggttattataccacagaagcaatgagaataattagacgtgaattcgactctcccgatgatgaaatgaaaaagaccattcttttagtattacaaaaatgtagcgctgtagaatccataacgccaaaatttctgagagaagaaatcgcgccagaattctttcaaaaattttgggtcagacgagtggcattggatagaccattaaacaaagttgttacatatactactgttacattagcaaagaaattaggttgttcttataccattgataaattattaacaccattgagagatgaagctgagccgttcagaacaatggctgtccatgctgttactagaacagtaaacttattagggacagcagatttagatgagagattagaaacgaggcttattgatgcgctcttgatagcatttcaagaacaaacaaatagtgattctataatctttaaagggtttggggcagtgacggtgtcacttgacatccgtatgaaaccgtttttagcacccattgtgagtacgattttaaatcatttaaagcataaaactcccttggttcgtcaacatgcagcagatctatgtgccatactaataccagtcatcaagaactgtcacgaattcgaaatgttgaataaattgaacattatattgtatgaatccttaggcgaagtatatccagaggtattaggttctataatcaacgctatgtactgtattactagcgtaatggatttggataaactacaacctcctattaatcaaattttaccaaccttaactccaattttaagaaacaagcatagaaaagtcgaagtaaacactatcaaatttgttggacttattggtaaattagcacctacctatgcacctcctaaagaatggatgagaatatgttttgaactattagaacttttgaaaagtacaaataaagaaataagaagatcagcaaatgccacgtttggattcattgctgaagcaattggacctcacgatgttcttgttgcgttattgaacaatttaaaggttcaagaacgtcagttacgtgtatgcacggctgttgctatcggtatcgttgctaaagtgtgtggtccttacaacgtgctgccagtaatcatgaatgaatacacaacaccagagactaatgttcaaaacggtgttctcaaggccatgtcattcatgtttgagtacattggtaacatgtctaaggattacatatacttcataacaccattattagaagatgcactcaccgatagggatttagttcatcgtcagacagcgtcgaacgtaataacccacttagctttaaactgttcaggtacaggtcacgaagatgccttcattcatttaatgaatcttctaatacccaatatttttgaaacttcaccacatgctattatgcgtattttagaaggtttggaggcactgagtcaagctcttggccctggactattcatgaactacatatgggcaggattgttccatccagcgaagaatgtaaggaaagcattttggagggtgtataataacatgtacgtaatgtaccaggacgccatggtacctttttaccccgttacaccagacaacaatgaagaatatatagaagaactggatttagttctgtgaatatatatagagcatataaataaccacaacttgtaagaatattttacttgacacacctatatcatcacgtcacgatgccttcatagattatgatgaaatataaacagaacctgctattggaaaaaaaagggcaggaaaaaattttgtgaaagtgagtaaaagaaagatgaagagcgagacatggataataagaaatagatgtcactaatggacaattggaagactgatatggaaagttacgatgaaggaggcctagttgctaatccgaacttcgaggttctggccactttcaggtacgaccctggttttgcacgccagtcagcgtcaaagaaagagatctttgaaactccagaccctcgattaggtttgagagacgaagatattaggcagcagataattaatgaggattactcaagttatttacgagtaagggaggttaattccggcggtgaccttctcgaaaatattcagcatcctgatgcttggaagcatgattgcaagaccattgtgtgccagcgtgtagaagatatgctacaagtcatttatgaacgattttttttattagatgaacaataccaaagaataagaatagcattatcatactttaaaattgacttcagcacgtctctgaatgatttattgaagttattggttgaaaacttgattaattgtaaagaaggaaattcagagtatcacgaaaaaattcaaaaaatgatcaacgaaaggcaatgctataaaatgcgggtacttgtctctaagacaggagatatacgaattgaggcaattccaatgcctatggagcctatcctaaaattaacaaccgattatgacagtgtttccacatacttcatcaaaacgatgctcaatggatttttaattgatagcacaataaattgggatgttgttgtttcatctgaaccattgaacgcatcagctttcaccagttttaaaaccacttcaagagatcattacgctagggcgagagttcgcatgcaaactgctataaataacttaagaggttcagaacctacttcttctgtctcgcaatgcgaaattttattttccaacaaatctggcctgctgatggaaggttcaataacaaacgtggctgtaattcaaaaagatcctaacggttctaaaaagtatgtgacaccaagattagcaactggatgtttgtgcggaacaatgcgtcattatttattgcggctcggccttattgaagagggagatatagatataggaagccttaccgttggcaacgaagttttgcttttcaatggcgtcatgggatgcataaagggaacagtgaagacaaaatattgagcagacgacagattttcatatcaatgaagtttttttacaatagtttacaaatcatgattttacatactcaaatatgtgcaggttgatacagacaacgtacgtagaagacaacaaacagaaaacagcggtttatacatttatttaaatgacatacagtggagaagcagagaaaggaaaaggagtgcgatgagaacagaagatgaatacttcggttgtgttggttccacgtacacattaatagcattaaaaattgatcctctgaaattacttatgagttttacgtcttttggtatttggcgtttttccactggcaccaattgtaatgttaacctttggagggactggaaaaccgtaagactttgctactttggctaaatccagcttatcgatttgatagacagttttcaaagagtgggaagcgtacgcttgtaaataagatctataaccatccttggctgtttgatgtagataatagttggatttaattaatttttctaattgtgattgaacgtttgcaattttgttttccgggaattcgtactcatttaatgggaccttggaagcctttagatatcttaaaaaccctaattcattaggtgttaaaaacattaaagatttacccttacctttagtgcctcttgcggttcttccgactctatgaatataatctcttggatcatcaggagggtcgaattgaatgatccagtccacagcagggatatctagccctctagctgcgacatctgtacaaatcaagatacctctttccgcattacagaattcgaaaaatgtatttgttctcttttgttgtttttgcttaccgtgtaattcgaggactggcaaatcaatatagttcaataattcagcgtaatatttcacagagttacaagatgataaaaatacaataattttctttttttgatttcttttcaagaaagaaaataacaacaaaaatctcttatcactgtcacataccacatagccttgttctaatccatctgcggtggagttgtcggtttcaggaacgacattaatgaaaagagggcccggtctcagcgagattctagccaaatcctcaactttggtcgtttgtgtagctgaaaataacatggattgcctatcttcgtttggcaagatcttaattatctgcctcatttcatcttcaaacccaatttctaagattctgtccgcttcatcgataatcaaagccttcaagttcttgaatacaaatccttttgtattttgtaagtgatccaataatcttccaggggtagcaatcaacatgttaacacctttcatcaatttttcggcttcctgtcttctatttgcaccaccaatgacaataccaaatgtctgtgaatggaattccattaactctcttgccactccaaaaatctgtaaagccaactctcttgtaggcgtaatgacaattataccggtaccatttcttggtttgaatttcaaagaatgcaatagttcaatagcagggatgagaaacgctagagttttaccagaacctgtcttggcagcaccaagaacatccctaccggccaaaagaggtgggatagtccttgcctgaacagaagtcatagtggtaaatcccatcttttcaatggcctttaaagttggctgtgataactttagttcttcgaacttttccacacaagtagtttgttctccctcaggtgcggcattgttttgttttgaagtgctcttttcatctactacaggttcttctgtagattcagaatctctagaacgtttatttgacggggtagccatacttctcctgttaatattgctcagcttatctaattattatagtatacagttatccaatagctatgtactcaagtaccgtgtatacactataaaatctcatctcatcgctaaagctaatattgaaaaaaaaaaaaaaaaaaaaaggaaaaggcaaataaaaaattttcaattcgggtaacgaagaatcgactctcgccgggtaaacaattcttagtcgtcatacactcctctttacgttaagaaaatagaagtagcagcgctttgtaaagcattaaagcgtcatggattgcaaaatacacataatatatcacttgtgatagtgagaaatggaatgaagtggtttaagatgctcttttaccaataaacatattgcgcctatcaaatcattttccacccctgttaactgatacagatatagccttacatataacttttgcactccctaaaattaccatggctgttcaccgcctgctatcatccatgtttttacatacatctattaggtttgccatcttagccgccgaagctatcgttgccggtacaggcgctccttgaataaccccctcccccccacgctattcttcaaattccgatttcagcttctctttgtttttccttttttggcacctcggaaaaacctccacgtgttaggttattccgccgattccacgggtggggtgctaccaagactcctgaaaaagaaactgtatgacgaaaagaaaaaaaaaaagctgcttgaattccaacaccgctttcttgttctgacaatagaaagggggattcctaaaaaaagaaaaagagggcggggtttatcatgtactcagaatatgaaaacgtgtcgaacggggatgacttcttctgcttctttacttctttctatttagagtgacagtttttttatttgttttgctaacttgtttatttattaatttcttgtttgctccttcagttacctaccacgactgtctcagccaaaccgcgatattttcatacaattgacattacaacagttcaaaaagaaaaatacacatccaggatatgactacagctagttcttctgcttcccagctacaacagcgcctgccggaagaaaaaccttggccgcaactgagtggcagcaatgcagacgctcaaaccttcaaatgtaaatacgtaaccaaccacaactccttgggcgatgggaattttagcgtcgtgaaagaatgtatgaatatacacacaaaggatttgtacgcgatgaagcttattaagaaacaaactgtcaagaacaaaattcaacttattcaaagagagttcgaccttttgaggtcaataagcgagaaaatcagagatatggaaaaaaagaatgaacattctttggacatttttgaggggcatcaccatattttacaacttttcgactattttgagacggcagataacattgtcctgatcactcagctgtgtcagaagggagatttgtatgaaaaaattgttgaaaatcagtgtttagacctcgaaactcaagttacctcgtactgcgcctgtttggtgagcgttctcgagtttttgcattctcaaggtattgttcatagagacttgaaagcagaaaacgtcttattcagattgagagtgaacgaaaacgaaaaaaacctacagggtgaacaccacggagatttcaaatacgatctcttggcacacgacctagttctcgccgattttggtcttgctgctgaatataacacaagtaaggtaaactcgttaaaggagtttgttggaaccatctcgtatattgctccagaaatcgtcaagtgcaaaggtgtcggtgaaatgactcctgatcaagttggcaaactagacaagtatggttgtccggtggatatatgggcccttggtgtactgacatatttcatggccttcggctatacgccctttgactgtaccacagacgacgaaactctggaatgtatttcaaaatgtgactattacgtcgacgaacaaatgatgcacgaccctaaatacgaacaattttggaattttgttcaatgctgttttactattgacccggccgttaggcgttctgctaagaatttgaaacagcatccctttattaaggattattttgctacttcaaattctttgaatactaaggacacgccgaatttctcctttcatccaacaataagaagggtatcttctacagcgtccatgcacacattgaggtctccttccaaatcaagaaagacaactactctagcgtatttaaatatggatggcgggtcctctgaaacttccaccgccttcagcagcaagatggatttgcctgacctttacgttgatagaaccattaattctcgtgaaagatcattgaatagaattcgagacactctgaagaaaacattatccatgacatctcttaagcctgcaggcacattcgactatcttcacgctaacaaaaacggtacttctttatcatcatccaagtcaggcctcgtgaaaaagaattctacttttgtcttggaccctaagccaccaaagaatagcttgatgaacggttgtttcagcaccactccagaatcgcgctcaaatttcaatacccccaaaaccttatcgaggcaaggttcctctactagcgtgaagaaatatgtcaatgaagttgacttacttttaaccccacgtacggcctcgatgagcagcaatgataccacagccattaacgattatgatactactaacgataagaatcctgcaagaaaacacgcagcttcattccaggtgaatgttgatgattctgatggtgatgaaaccatgcagatatagtgttgaatgataattcaccttttttttctttctttttttttttacctgggacgacattctaactaatgaaatttacgattaattattcttttttttttttttcaagaaataaatataactgtaacatatatatattaattatgggggatcacaaagaaaaatagtaactttaagaatcaaataataatgtgttgcgcttcttagtactcatccggcatttacggtttccatggtatggtttatttttcgtgcatagtattacccgtcgtgttcttttcggacattggaaagttgtccatcccaaacacttaagatgagttaaaaggcgttggcgtttgccttctccgtgtgattgatttacagttcagcccagtgatcatttagcttacccatcatcgcgtaaaatgtggctcacagaggctcaaagtatgtttttaatattttagatgctctttgcttctccgagagacgttagttccttttttactaacaacttacttttcactagaatttggtgtggccttcactttcggcggttttctcttctttttgtttggtatatttactttttttgatcgtgccctattggccttgggcaatattttgtttttaattggagtattcttaataatcggttcacaaaagacatatattttttttaccaggccaaacaaaaggcgcggttcactatttttcctagttggtgccttcttaatactgttgaaatggacatttttgggctttataattgaatctctaggtattataggtctctttggtgatttttttggcgtcatcgtacaatttttgagatcaatgcccataattggtcccatactttctcacccagcaatcgctccaatagtagataaattagcgggagttagggttctgccagtataatggtaaaattttgtatgtgaatatcatagattaattttttcgaactttctataggtataaagtaaaaataataatatttacatgattaacgttgtcctcacaaatttatgatattgactcgacaaaatctaacacagtggaatcatcaccatattgacctactacctgtaagccaatcggggtcttctcttttaaaggcattgataaacttggtagtccagccaatgacattgggacagtaaagacatcgtttatatacgagttagccggagatttggcttcctcttcttcgaagtcccttatggatccaggaagcttggacgatgtgggaactatcagtagatctaggccgtctggatttcccttagaattagttaaaacatttggaaatctgaagatcccgtcaaattcatcgatcaaattaactcgtagcttttctgccttaataaaattgttcttaaatgcatctgaacaaagattataattacctagaatgattctattcttaacttctgttccgaatttggacctagtaggtgcgaataaaataccgtcttttatatcgagttctgaatctctgtatccatatctgataccatcataccttgataaattggaagccgcttcagcgggtgatagcgtataataaatcggtaaacagttttttacagatggaatggatacagggtatatttcaagccctaaatttatcagcttttctagtaaggataaatataatctgtggaacccaatgggcatactttcatggctaaattcctttacaattcctacctttaaaggtctcctaacctttttattcccttctatcaattcacgcaattccacacttaaggaagtgggatctttcatgtcatatttatcgagcgtatgaaatacttttcgcaagacgtttatctttttgctaagtatgccaacagtgtctaaagattgagaatacgctattacgccaaatcttgacaaccgtccataggacggcttgaatcctaaaacagatccatagcatgcggggagcctaacggagccaccagtatctgttcccaaggcaaaatcgactagatcgcaagcaacgcttgcagcggctccagacgatgaacctcccatgatcttcttgtcctcatgaggatataaagggttaattacgggccctcttattgaatgtactcccccagaacccattccaaattcatctaaatttgtcttgcctaagatatgcactcctgcctgttttaatagtttcactactgttgcatcgaagggagacttgaaattctcaagtatatgtgaggcacatgtggttggaaaatcttttgtaactatattatccttgatactggcaacgcaacctgtcaatgtttcttttgtaccttttttatttgtgattgaataaggagatggattgatactagtgaaaatattatattttgattgaaaactagataatctttcgattgattcttttaaggagcgtttcagtggcatttttgtataatcaaagttaggactccaattgaggggccatctttccagcacaaataatagtgtttacaagtatagatgtactattacttttttgggagccaatgcatttcaaaaaaaaaaagaagagcagataagtcatgaggctaagaaagataaagaaatctactggttgatgaacgtcatagatttaagtgatcctgccatcaatgtggattatgatagcttgattggcattgacaatgaggaatctcaagaaatttttgaaaatgaagtgaaggaagatggacaacaagaagagcaggaagaagcatcttcaagaaaagatgggctcatcgttgaaccagggagagatgttgagagtttgagaagggctattcgagatcagttgcttttcaagatacatagacaaaaccaatcagactgtgcagatgcgagaaagttgagtaacgatgaagaagatgaaagtcggcaacagaaattagaaagaataagagaagaattggaggagttgaaaatagaaaatttaacatctgaaatgcaaactgaaatcaaggaattgtgcgaaattcaatcaaaattggcgacggaatcatctagtagattgacaaatttgaggaagaagcttctcgaaacatatgaaggccaagataccgtcatattgccaaacataattcttgatacgagtaatatcaaaagattgcaaaagttagatcagaaaatatccctaatggaacgttttgttggcataccagaagctttggaggcagaagaagataggaaatcggttcatagtaaagtcaatgaactatatagaagtattcaacttttacaaggcgatgataaggcggaaggaaagctgcaaaagttccgggatagactcgtagaactgaacgaggaatttgaaaactcattgttaggcaagaaaatacaacaggacttgaggttgaaagatgacaccgtgagcaagcttgttatgcccgaaaacaaagtaaaggagataaatagtatgtattccatgttcaagcaatatcaagattcactaccactgttggcggagaggatgaaaagtctcaataaaatgaacaacagggtgatcgaggtgtacgaaaccacgaaagggctggattcacaaataaccagcatccaagaacaaggaaaagtttggctaaaggctttaaatgagctggataaaaaattcgatgaacaagaggttaaaattcgcgaaaatatggagcagatcaggcgtaaaattgataccctcgaagacgaagctctacagagaaatagcaaataaaaggcggagaaataattttataaaccaatttaatttcattcttcattttttcgtctccatatgacaaaaaaattgaaaatatgtgtgtgtatgtatatataataatagtaataataacaatatgaaatatgaaatatccaaaataagagcggaaaacagaaattatcataaaaaagaaaaaaataaagtctctaaagggtatcaagcgcttatttcttcttcattctaccaaacaatcccttcttcttcttcttttgcttttcctcagtctgtacgtgttgttgtggctgatacactgcttgttcaccatacatttgactggaagcaccacccacttgctgtggcataccgttcgcatcgtaagtcacagcagcaccaaacacagggaaatcaggtcttacgcggaacccgtaagttggagtctccaactgttgggcccagaccgggtctccggagacagcatactcgaaacttcttatagtgtccaaaggtctttcgtctcttgccctagttggattcgatatatctgcctgtgtgatgggttgaccgaaaacatcacacagaacatgaccttcttcgttggaaaaataagattgtctgttcatgttgtcgtggaaggtatcagcagcttgttcaaaaggttgggcttcctgcacagcgtctagaataggatcagcaacggaagcagtacgcatcttcaatcttgccttgtcatcttcagaaatcttgacatctgaggcacggttcgctccgtcatgatcactcgtgttactgatactggatttctttctaaaatgcatcatattgccttggtgtgctgttttaaccttgtttgatgtttgctgtgtctcttgtgttagttctctgcctagtgaaaccgaaaatgctcaagaaagcgtaccacgaaagtactcctttcttttctattaataaataaacaaataaataatacaggttgctttgcctcgatggtaaaaggaaagaaaatttcggatccgaaaatttttagcgcattctctgggcgccgtgcaccacgtcaatttgacagagatgatgttacgattatttgtattattgtataaatatttatatatatatgtgcgtgtgcatatactggctttctatttttatttattagattcttggcaacaggcaaggatggactgcttgacactttcgcaagcatttttgagttcctctggggacatggcggcgttacagcagattttcaagctagggacaattggtagcgtctcctgttttaaaacaatagtgtttcttgtgatgagaacgttgtagttaataagagcatgatctactatggactgcagaaatttttcctcctcttcgtatggctcaatgaatttgtttgtctgggacttcttttgcaaagctgacatggtttcgaatagctgttcgcaggtgtatccgaacttgcgagacctatatgcgggagtcagttgcagatgtaggacagcagacactggagaggacgtgacgattacgtatgaacgcaaggagtcgtcagatgcaaaggaatcatgcaaagatttggatagtttttgcagcgtctggacggcgtcgttgttggagtccatcaatttcaagactttggagacggatgtgacggtgtaagccggcaaacaggcagaaaaacaatatgcattggaaccaatacgctggtgcaaacacataacactgtcacccaggacaaaaccaccggtggaccccaacgcggtggccatggacccaacggtaatgtcaatggcagttgcgcgatccatgttgaagtgctctgacaacccacggcccgtagcgccaagaacaccaatggagaaggtttcgtcaacaaatagtctgaacttgtacttgttcttcagcttagtcaactcaggcaacggagctaaatcgcccgagttgtggaaaataccctcagtgacgataaattttcttggaatggcgggcagtttctcaagtttctcctgttcggtcaactcgtttaataaacattctagcgaattcatatcgttgtggttgaagtagtagactgtggatctgcttagttgcagagcattttgcactggtaatgacacctggtcgtctgccacgataacatcaccacgctttgtgaaagcaggcagaacagagggtgcggcacaaaagtcttgcccgtacagaacggaaccttgggtgccaaagaactgtgctaaatcatattccaacgtgtaatgaacgtcctggttaccgtagaacccggcgggaccacaggcgcccacaccgtaattcttgatagtggtcttgaccacttctttcacgggctccgtagcggacaattgcaaaaagttgttcgaggccaaattgaaaacattggtatacttctcctgcaggttgtttctggtgatagtaatatggttctgaatgggcatttccatggtgacgggtgttttggccaccctccacgattgctcatcggtggcagaagggtcgactagaggctcgggctcccagtcctcaattagcgcgtcaatctcctggggcgataggttgggcttctgtgcttgaagactctttttctgttgtggcttggacaagtaatagatgatcccgtataaaataagccctatctcaaccgtggtcctgtatggatcgtcatgatgcgatttcttgatgtacgaaacgatgaattggcctcccgggatttgagtcaacaccagattgaagtagtaccataggtacgatgaggtggtaacaataaatgccggaatcggtattgatttgggtaaaacctctgggatgtgtgccattgctttttttttttgggtgggaaggaagaaaaaaggataaataaccctacacgagcaaaatgtgtatattggaggccaggcagaaggttagagcgctcttatactgtgctactcgatgatgttgaaaagaattttttttatttttccttttctttttcttaagtactatattttctcaatcttactttcgttcactacagttaaccgcagcaatatgcccctataaaaaagaatgagtgaaaaatttgttagcagagaagcaagaaggaaagaaggaaaaaaaaaagaaaccgtgtaagaaatcatggcgcctcaaaaaaaaaaaaatacgcgaaatcgatttccgtatatgatgatacatatgttaggtctcttatggtagtttttagggtctgtcctgttttttgaaggcattggttagggtctagtaagtaactcgtataaagagatgtacttttatacggtatgtgtggcggttatttccagtgttttttttcccttattttgtgggttcatggaaatagtacatattgaccttctgcacaagaagccatattgacagagcagtatgtgaggacctttcttctacacaatgtaacagtcaatggttgtagtcaataccacgacctttacgtgcagttttagagcgaaacttcggttttttgagacttacctcgtgtttgtgtctccctgggaatggagccgcgccacccttgtctattatgtatagtcttatttaatcatagcgatgttggtcatccagtacacttcggtagcaaccttcgtttgtgattgtcttggtaattgcttccaacaactttatccatcattgagacaggggccatatcacccgcggggtctcaaagaaggggcccactaataaaagcacgagataagaatgccagcaaaaaagctccgaaataattcttttcgtcttccctcctagtcttaacaagacaagagagagagagagaaagaatactcactagagattgtttcttttctactcaacttaaagtatacatacgctatgaaagcattcaccagtttactatgtggactaggcctgtccactacactcgctaaggccatctcattgcaaagaccgttgggtctagataaggacgttttgctgcaagctgcggaaaaatttggtttggacctcgacctggatcatctcttgaaggagttggactccaatgtattggacgcttgggcccaaatagagcatttgtacccaaaccaggttatgagccttgaaacttccactaagccaaaattccctgaagcaatcaaaacgaagaaagactgggactttgtggtcaagaatgacgcaattgaaaactatcagcttcgtgtcaacaagattaaggaccctaaaatcctgggcattgacccaaatgtcacacagtacacgggttacttggatgtggaagacgaggacaagcatttcttcttttggacttttgaaagtagaaacgatcctgcaaaggatccggtcatcctttggttgaacgggggtccaggttgttcttcactaaccgggctgttctttgaattaggaccctcatccattggacctgatttgaaacccatcgggaacccttactcttggaacagcaatgccaccgtgatcttccttgaccagcctgtcaacgttgggttctcgtattccgggtcctcaggtgtttccaacactgtcgccgctggtaaggatgtctataacttcttggagttgttcttcgatcagttccctgaatacgtcaacaagggccaagatttccacatcgctggggaatcctacgccggccattacatccctgtttttgcctctgaaattttgtctcacaaggacagaaacttcaacttaacctccgtcttgatcggaaatggcctcactgacccattgactcagtataactattacgaaccaatggcctgtggtgaaggtggcgaaccatctgttttgccctcggaggaatgctctgctatggaagactctttggaacgttgtttgggcttgatcgagtcgtgctatgactcgcaatccgtctggtcctgtgttccagctaccatttattgtaataacgcccaattggctccttaccaacgtaccggcagaaacgtttacgatatcaggaaggattgtgaaggtggcaatttgtgctacccaacgttacaagatatcgacgactacttaaaccaggactacgtcaaagaagctgtcggtgcggaggttgaccactacgaatcctgtaacttcgatatcaacagaaatttcctgtttgcgggtgattggatgaagccttaccacaccgccgtaacagatcttttgaatcaagacctacccattctggtatatgcaggcgataaagatttcatctgtaactggttgggtaataaggcgtggacggatgtcttgccatggaagtacgacgaagaatttgcaagccaaaaagtacgtaactggactgcttctatcaccgacgaggtcgctggtgaagtcaaatcctacaagcacttcacctatttgagagtcttcaatggtggccacatggttccatttgacgtccctgaaaacgccttaagtatggttaacgaatggatccacggtggtttctccttataaagcgtgtatgtgtaggcataccgtttttattatcagctacgatcgaaatatatacgtttttatctatgttacgttatatattgtagtcttaaccatttgtaagttttgcttcttttcttttattcatttcataacatcatactgttttacgtaataccatccttaactttttccaccgaaggggaggaagaactaaattctagaaaaatgaaaccattaaaaaaaaagaaaacaatagagctgcttctacaattttgcacatcaaaaaagacctccaactaccgagtttgtaagtacaatgtctcaacccactcccatcataactacaaaatcagctgctaagccaaaaccaaaaatttttaatttattccgcgtttgcttcatttcattattgctgatcgctgcggttgaatacttcaagtatggtacaagaattaactatgaatggttccattgtaccccaatcaaagaaccccagtctggctcagtaatcaagctttgggcacgtggtgggccaagttgtgacaaaagaggcgaatataaaactatagtaaagagaatcactagagattatgaaccaaatgatgaacatctctcgttctgtatcatcgagaatgataatgttccacccgtccactacccaattcacgaagataaaggtgaacctggctacgtagcttatgtcgggtacgacacagactctgagctggttcaagaactatgtgctgattccacaatttatcacatgtgaattctttcttttacatacataaacatagaagaaatccaaccctgatatagggatttataaatgcgtgtgcatatctatatttatacatataaagagaaaaaaattgctcatgataaaagaagtatcgcctgcccactttcctaaatcctcgaattttccctatattttgcgaacattttgcctaattcctcttgaatattaactttgaaaacttctaaaggatatagtttatcaaggtcgataccagaggttgttttcctatcttctctgattttatcaattgttggtataaagtccatatatcgggccaaaaagtgttgctctttcacctcagtaggctcaaatctttcgtctactgtttttatcaatccaatagaatcgcaccccttcggtattaatatctcactgcgtgtgaccatttcaatatgatctttcatatctctatcttcacaaaaatgctttagaagctcttggtatttaagcctttgtgcttcctctcgtttctcttcggtatggtcttcgcatatatagaatagtgagctatcattaaaatagcaaaacgatcttaacgtttgcaaaatgaagtcaatatgtactgactgccatactgtagtgtgtctttgtaagtttaatatttcgccactgtttaagcaccatacagaaaattcattatcgtcattcagttgcttaattttattgaatgcgtaggatagttcattcagccacaacttttggtcgttcagtgtccaatctaataatatgagccagcgaaccttcgaactatgttcttgtaaaaacggctttagaagatctagtgcatcgtcagtgtttcttattagcgtgtaaacatcgacagaataattttcctttaagtcgttggtccatcctatggtggcgtaattaatcaaagtggtatccagtattgaattgcttccctctggaaaacagatatttataaattgatgcagtgttttacttgatggggaatatatgattgctgttatcgtagcagtctctgtgctgttgattgtggattcattctgagacaataatttgtcccaggcattacaattatccattaatacatacaattcttttatcttcttttctttttgtacaagttgcggattacttctctttgtttacctttttgcttttatttttttttttaatacgtgcatatatatatatatatttagtttaggtcagaatacaaagataattatgtataaatgggcgcatttggaaactattttacatacaactgaacaagttcggaacaatctatcaataatctgcacaattatataatccgatatcgacttcagccttcatatctgatgaattatttgcgatcgattcacgtttttcttccaattcttgaatataaccgtcttcaacaccagtgacataatttccggtaaatacaccatcttcgaatttggttattttatcagttttacaacaatcaatcaaatcttccaatgattggtaaatgactctttcacaaccgattacttccgccacttcttcatcggttctgttataagcaatcaagttctttgtgtctgttaagtcaataccataaatatggttgtaacgaatggctggggcagctgaagcgaagtaaacctttgttgcaccggattccttggccatgttaacaatctcttttgaagtagtacctctgacaatagaatcatccactatcagaaccttcttacccttaaattcagactccatagggttaagcttcctccttactgaagaaaccctttccctctggtttggcatgataaatgtcctgcccacgtatctgtttttaacaaagccctctctataaggcttccctaacacattagcacattctagtgcacatgttcttgcagtatctgggacgggaataacaacatcaatatcttctggcttcagttgctttagaatattttccgctaatttagaacccatagccaatcttgtgtgataaactgatattccatccaagacactgtccggtctggcgaaatatacgtattcaaataaatcaggtctataagagttaataggaaccacttgtttgaactcaggttcacctttgctacagttcttagggatgataactgcctcgccaggctttaagtcacgatatttagtaaagttgtgagctttgaaaacaacactttctgaagctaacatatagtccttagtgccgtccggattttctctttcaccgaacaataatggcctaataccatttggatctctgaaaccaaataatgcaaaaccggcaagtaaaccaacgcaagcataaccgccacggcataaacggtaaacaccttctaacgcgtggaaaacatcttcattgttaactctgtacttgttatgtttttccagttcagcagcaaaaatattcaatagtaactccgaatcactgtccgtgttaatatgtctatgaacgtcttcatccatatatctcttcaatgatgcagtattcaccaagttaccgttatgtgccaagttaataccgtaaggactattgacgtaaaatggttgcgcttctgaattagccgaagacccggctgtaggatatctcaagtgggcaatacccatggaaccagcaagaccggaaacacgttgttgggtaaatacgtcacgagccataccattacctttacattggtagattctaccacgagaaccacaggtagctataccagctgcatcttgtccacgatgttgtagaaaaatgcatccatcacataactccggagctactggagtggtttggtttgctaatacaatacctaaaataccacacattttttctattctgctgtttgctgtacctctttctttgctaaacttattagaacgaaatctactactttcaagacgatgtcttcgcaactatgacttaaaagtgaataaaattgtacggtggctgttgaaatttttctaaaatgaaaaaaaaaaaaacgaaggactttaccttgacttaataataagaatctgaaaagtacaaacctattattgaaattgtaagtaagcaaactttaaatacaccgaagctctgacatttgccgcatgagcagtcattcggattcatgatcccagattatattttattattcatgttcgttctaactctgtcctgttattttcggtcaggaagagtcaatacatcgggtcattgaaaaaccgcggagaaagataataacttttcttttttccttaaatcttgaaaaacttatacatgtataaatcaatatttacttacgagcgttcatagttcttgctggtcttttagttcattctctaaatgatccagatcttcttgtatggtccaaagttcgcggtacaatgaccctggcatagccaacagttcaagatgcttaccttcctctcttactcttccgttgtcaaggactatgatcttgtctgcatctgcaattgtcctcagtctatgtgcgatgtatacactcgttctcgaacccgaagtaaagttatctctaatggttcgtaagagagcttgttctgtgtgtgtgtccaaggcgcttgtggcctcgtcaaaaaacatgatccttgcattcttcaatagtacccttgcaattgccagcctttgcttttcaccaccgctgatcatcaaccctcgctccccgacgatggtgtcaaaaccttgtggtaatttcttgattaagggtgctagctgggctttttcaactacagttatcacttcctcgtcggttgcgtcaatacgaccgaactttacattttcccagatagtgtcattgaaaagtggtgtgtcctgtggtaccacaccaatcaccttcctcaaggcatcgatgtcatattctttaatatctctaccgtttatgaggatccttccgctttcaggatcataaaatctaaagactaattttaaaatggtggacttcccactgcccgaagacccaactattgcggttttccagcctgctgggatggtaaagctggcattctttaaaattttcctatcgggatgatatccaaacgtgacgttctcaaaagtaatatcgtagggaacattttctggaagcattaagggacgttcggcatttttaatcttgacttcattttttcttaacttaaatagcgtttccatatcaatcagagactgctttaaatctctgtaaacactaccaagaaaatttagcggtactgatagttgaaaaaccaactgattaattagaaccaagtcaccaactgtcaagttgccaccaataacgccggtgcaacccatatacatcattgcagttagggcagtagtaaaaattagattttggccggagttcaaaaatgctagagattgcgatactttaatttgagagtcacgatagttcatcaaggagccattatacttatctgcaagatatttttcattgttgaagtattttaccgcctcaaaattaattaaagaatctaaagccacactggcagctttgttatcggccttgttagcatcccttctaaaatgtgtcctccatgcggtcgtctttatagtgaaaatggagtataaaagcattgtactgaatgttattgcggcaaatgacgcaccgaattgatacgtcaaaatcccacaaacgacagatatttcaaaacttatagggataatgtggaataccatggccgttaacacttgagatataccctttgtacctctatccatggccctcgtcagaccacccgtttgtctactcaagtgccatcccaaatctaacttcataaggtgctggaaagtttgtagcgacacagttctaatggcattctgtgccactttggcaaatacggcgttcctcagttcgccgaataaaacagagccgaaccttgcaacaccatagcaaagaatggttaatccaatcgctgccggaagggcgactgtaggatcatcccatgctatattcattgaatcaatagtttgcttgaaaaaaaaaggtacttgaacatttaaaattttggcggatatcaacagtccaagggcaatcagtacccttatcctcactttattgttgcctttgggccaaatatagcgaaatagatctttcaagattttcagttccgagagggttggggccttgctggtcttttttacctgagtcttcacttttggagccgacgagaattgctcgacggattttttgtgcgtaatatccttttgtgcttgattccataaattcacagctgaattgaataacagaggccgctgggttgataacttagacacagtaaatataacgggcgaatggttccggattagaccagatctaaattttgatcttacaattcgcccaattacaggacatcttggaagaagcagcatttgcaggttggagtggaatctatcaacaacgatatacttacgttgctctgtcgcaattttcgaaattgtactctttgctgtgctgattgctttgtttgcgattattaatgtagaaagtcatcggaaagccctcgcgctctttcccagtgaaatttcacgtgatgtaatctgatgaagggcacgtataggtcagtgacctttgctgtgcaaattgggtaaggtaatttcttttaaagactttaagaatggtaaagtgaggtacaacaacatattataagacttacttggtatgtaccttaccttccttagatatttttcatgctgcgtagaaaattgcaccatctccaatcgtcacttttatacattttcaaaagaatatagatgagtatagcaatatagggtttacacatatgtacagaaaagcagaatagtaagttttgtttcatcacttagataggtttttaatttcttcttcacatttggtaatgactgcattactggcattgattttaccggataaatagtccaatctggtcttgaaaagtttctgatcaggaactttccccaaaggttttaattcttcttcccatttcttgattctaccagtttcaaaacccacaacctttaataagtaacgggtttttagcacttttgcgagttcaggatcgttgatcaagtatgtgaatgctgccctgtatagcggtttggcaggcctgatttcctgtaaaacacccctatctctagatacagttattaaaccattattctccaattccatgattcccgtttctggtgcggctttgaataatggcttgttaacgatttcatggaatggaatgactgggttcgcactcaataattcgattaattcccaggcttgtgcacttttattgctgtcaatcttgtcacttaaaaacatttgagttatttgctcagaagcctgttcaatcattttgtctactgcttccgagggctcttctcctgactttacccttcttacaaatgcctgtaagtctaacatcctaccacccaatggctctaaagaagcgtcaatttcctgtaattccttttcatttaaaataacctcagcttttttgacactcgtatcggcctcactatcagaatcattattttcagcagtttccttttctgattcaggttcttttacgttttcacccttggattttttattgtaatataagtaatcctccaattgggataatacatagttcctcgaattctcttttgaggcatctgataggattaggtttttgaagacttgattgggtagtgattcgctcaatctttggttggatgcaacggtttccgttaagaaaatcacatgagcaatattcatttgaactagcatagctgcccaatcggatagttccttatacacaaatccatttatttccgacttgccctcaaacctatctatgacgataacgggtttagcttccggatgttgctgtaggtaatcttcttccttaacattaactgtcccatcaccggtggaaacaaaagccttgtaattcttgagagcaatacgtctaatggacatcaatgaggtagttaacatgtttctaaaccgagattccttcgtctcagacaacccagttttttgccctgttaatccttgcactgttaaatcaaggacacctgtgacagagtcaatccatgggaatattgggaaataacccaattgactagcggcattttttaaaaacataggatctgttctggacttaatcaatttatcacaatccaaatacaaaacatttgctctattttgcaaagtgtgttgcatgaccaaatcatgtttccctgaacctctaggcccccttataaccacaaaagtattattattttcttcaagccacattttcaggtcattcactttctctattctttcctcccataaatgctttctttggtgattatcatcagggccgccccagtagtacttgatagaagtcatggtagatgaggttagcgttttcagttgtttccaaaacttattgtcccacgataaagaatatttgtgagtgatcttctgttcaatcgaaaattctcttataggatcaaacactaaaacagcaaagattgaaagtagcgcaaataaaactggaatagcaatccttgtatggttggtgaaaaaattactaactagatggcctcttctgatattttcgtattgtatgtgtaagacggtattatgaatttcgataccggaaacacaattcttggcagaaatggcaccacggaatgaacggtatcttacctttgccacattgttgttagcagcagtgggagggaaaatatcaataattgtcccatatcttctgaataaagagtatatttcttcttctgttaaggcgggcccttggaacttgatgactatagtggtacttggtagtcttcttaaatcctcaatccaaggcgaaccctttactgggaaggcagaagctcgagtgaagtacgagagtaagtttttagaggattctctggctgtattctgttggattagagaatttacctgagcttttgtatacttgggtggaacgacaaatgtggcaaatacaccaccatcccttttcactggaatggtagacttcaactccagtccataaatggggttattgggtggactggctaaattccttattttctccctcactgcatcccgtgactggtttcttagcaggagattgtaccacagtgttggattccaaaccgaggtggttctagcgtaaacattatcgaaatatatcagagtttcttcatctgatttgtgaataacaccagtatcggtggcggtgtttgactctcctgcctgctgatccttttgctggatctcgctcgacacatgtctcactgagggttgggcattcatcaggttcgctagtctatatttgcccttgaggatgcctattcctctggcgaggcatggcactggcatccttgacacattcagggaagtcgttcgtactagcaacatggtttacttttacaaatactacttcctgtataggcccgctatattttggttttagatcctgtcaatactgagttcatctttcattttctcaatataacattaccgttatctcccttatacttctcaaattcccatctacggaaccctgatcaagccctgagaaactatatgagggtgtgtacattgcagtgcatcatttgtgagggttcaataattgaaattatagggtggacgtcaagacgaaaagtgaaaaattacatccgtatagaattatataacttgatgagatgagatgagtaaatgacagaagaattaccgtttcatcattgaacttcgatcatttcaatgctggcatgcgaaggaaaatgagaaatatcgagggagacgattcagaggagcaggacaaactataaccgactgtttgttggaggatgccgtacataacgaacactgctgaagctaccatgtctacagtttagaggaatgggtacaactcacaggcgagggatggtgttcactcgtgctagcaaacgcggtgggagcaaaaagtagaatattatcttttattcgtgaaacttcgaacactgtcatctaaagatgctatatactaatataggcatacttgataatgaaaactataaatcgtaaagacataagagatccgcttatttagaagtgtcaacaacgtatctaccagcaatttggcccttctccatcttttcgtaaatttctggtaaactggataagccaactacctttattggagacttgactagacctctggcaaagaaatctaaggcttctctggtatcagctctgttccccacgtaagagccgacaatggagatagacttgacaacgtggttgaagacatcagaggagcactttgcaccggctggcaaaccaaccaagacaacagtaccgttcgccctacagtatctggtagaagcttcgatagcggcttcggaaacggaaacattgatgataccgtgggcaccgccgttggtagccttaacgactgcgctaacaatgtccttctctttggtgaagtcgatgaatacttcaccaccgagcgaggtaaacaattcttcctttcctggaccaccatcaatacctaagactctgtaacccatcgccttagcatattgaacagccaaagaacctagaccaccagcagcaccagaaatggccgcccagtggcctgctctcaagttggcagacttcaaagccttgtatacggtgataccagcacacaagattggcgcgacttcagccaagtcagtaccttgaggaatgtgagcggcttgaacagcgtcagcggtagcgtattcttggaaagaaccgtcgtgggtgtaaccagacaagtcagcgtgaggacagttggattcgttacccaattcacagtattcacaggccatacaagaaccgttcaaccatttgataccggcgtagtcaccgatcttccagcccttaacgttttcacccatgccgacaacgacaccggcaccttcgtgaccaccaactaatggtaacttagttggcaatggccagtcaccatgccaagcgtgcaaatcggtgtggcagacaccagagtacttgacgttgattaacaattcgttgggctttggctttggaactgggatatccttatgctccaacttgccgttggattcgtagaagataatggctttttgagtttctggaatagacattgtgtattacgatatagttaatagttgatagttgattgtatgctttttgtagcttgatattctatttaccaagaagaaacaagaagtgataaaaacaacaagagagcagtagtaagagtatttcgagtgtgaaaaaagtcgctactggcactctatttatatgtgataggcatgctatagctttaccaaaaagtgaaccccatttctatgctctcctctgccttttttttttttttttttttcattctctcaatctgaaattctcttatttctccaacttataagttggagatgcccggtgttccggcagaggagatcagtctcgtgaagtggatggtttcccgcctgcgggcaaaacgtcataacatttttatgagcgaaagccgttaatgaagacaaaatcccttaattaaaacattagaatggtgattagaaaggcaggattaatcagttacacaggctgtaaccggagagacggatcataaggcaatttttagataagactggttagagttcttggcatcagaaaatttgagaaacgatttttccgtttgtttgcccctacgttttgcccctttgatcaaactatcagttaagatattaatttttttgagaaaacgattctttgattagtctcttcaaacaaacaatgagctctgaagacgaattgggaagtatcggtactgtgtttcccggaagtcccatagataagagcattgggagtattctcccacaatttgatgaagaagtggagactttgctggaagatagcttcacgtggaacattcctgactggaacgagttaacaaacccgaaatacaattcgcccaggtttagaattggtgatttcgaatgggacattctattattccctcagggaaaccataataaaggtgttgcggtatatctggaacctcatccggaagaaaaattagatgagactacgggagagatggtgccagttgatccggactggtattgttgtgctcagtttgccattggtatatctagacctggtaatggtgacaccatcaatttaattaacaaatcgcatcaccgattcaacgctctagatacagactggggatttgcaaatttgatagatttgaacaacttgaaacatccctcaaaaggaagaccgctttcgttcttaaacgaagggaccttgaacataacagcgtatgtgcgcatattgaaggatcctactggtgtcttgtggcataatttcctgaattatgactcgaagaaagtcacgggctatgttggcttccgaaatcagggtgccacatgctatttgaattcgttattgcaatcttacttctttacaaaatacttcagaaaactggtttacgaaatacccaccgaacatgaaagtccaaacaacagtgtcccattggctttgcaaagagctttctaccaactacaagtatccgatataccattagacactttggaacttaccaggtcattcggttgggacactgcggaatccttcactcaacacgatgtgcaggaattgaataggatattaatggacaggctggaaaataatatgaagggaacacccgtggaggggaagttaaatgaaatatttgtcggaaaaatgaaaagttatattaaatgtatcaatgttgattatgaatctgctagagtggaggacttttgggatctgcaactgaatgtcaaaaatttcaagaatttacaagaatcttttgacaattacattgagatggaactaatgaatggtgaaaatcagtatgctgctcaagactatggtttgcaagatgctcaaaaaggtgttatattcgaatcatttccgccagttttacatctgcagttgaaaagatttgaatacgattttaattatgatcagatggtaaaggttaacgataaatatgaatttcctgaaacaattgacttgtcgcccttcgttgataaagacgtattaaagaaaacgttagactcggagaacaaggataagaatccttatgtttataacttacatggtgtgctagttcattctggtgatatatctaccggccactactatactctgattaaacctggtgttgaagatcaatggtacagatttgatgatgaaagggtttggagggtcacaaagaaacaagttttccaagaaaattttggatgtgataggttgcctgatgaaaaagttcgtacaatgacgagaggtgagtatcagaactatatcattcaacgccatacaagtgcttatatgcttgtttatatacgtcaagaacaagaggaggatttgctgcgtccagttttggaatctgatgttcctaagcatgtaatcacaagagtaagagaagaaatcaaagaacgggaaacaaaagaaaaggaaattagagaagcacacctgtatgtcacgctcagattgcactcaatcaaagagtttattcattatgaaggatttgactatttcgcacatgatgggtttaggttatttgcagaggagctcaatgactctggtttgcagcaaatcaacttaaaagtcttgagaacaactaagttatcggatatttttgcaagcattaaggaaactatgaatattccacaagaaagggacgtcaaatattggaaaatggattatcgcagaaacagcactttgcgtttaacacaacccataaattttgaatccgtaaacatcactttgcaggaggcattaaaaaaggagaagaaaaggactatgcaaacgcaatatggagaggaaggtgttgctagtactgaggaagacgacaaggcacttttagaaactgtatcattcttagatcttttcattgaggagccctatctagagttacaatttttgaacaagctgaaggaagcttctttaatctcaaaggcccagctggatgatgagctgatatcaactataagaacgaatcttccagaactaacaaagggaggaatcgagcctgtttttgccaccgacaataaatctaatttgctattcgtcaagagctacgacccacatacccaaaagctattgggatttggccattttgccgtaaatcaattgcaacagctatcggatatatctgcaattattgaggacagcatttcttccaacgaaaagctgactttctacgaagaagtccaacctggtaccataaatgaaatatatatgaaggagacaatatatgatgctgatatagacacgggtgatatagtttcatttgaggttccaggtgctgttttgccagatacttttccagtttacgcaacaatcaaagatttttactcatatctgaggtatcgtgtaaaattgaagttttctaaatttgacggttcaagtgaggaatatggagttagtaatgaaatcccagagagcttcgaattctggatatccgcttatgcaccttatgatgaccttgctagaatggtgtcgaaatatgcgcacgttaagccagaatatctaaagattattgccctttattctaatggaagatttgtgttaaaatcaacctcacttttgaatgattaccttttgaaagatttcaattgcgatcaaataccgccttttgcatttgaagtattgtctgtgcctttgaaagaattggagcgtttgaggccaattaaattatattggctaaaaaatagttatattcattatcaatgtttcgaattcgaagtcgcaaacgattatacagaatctcaatttcttgaaaaagtgcaacacaagatcggctttaccgatgaagaaaaggagaacatcttactctggaccaacacaaatttccagtttcagggcttattatcggaccaaaacaccttcaaagatgtgagtaaacattctttactctttggtagaattttacccgaggagtctaaattgttcaaagaattaaatcgtctagaaaacgtacaaacatcttcattggaggattttatggatgatgaaaacgcgactgacagaccaatggacgatgagcaagatctaggtatggcgatagaacattctgaagatatgaaagggcgtatagtggttgttcaacaatatttcaaagaccttgagaatagacacggaatatccttcttatttaatttaataccagacgaaacattcccaaagacaaaagatcgtcttcatgcaaaatttggtctcggacaaaaagaattttcaaagatcaaattaagtattggttactccactgaagaaggtacggtgtttagaagtttgcaaggattttcggacgaagaattggacaaagttatattgtatgacattatgtccaacttagattatatctacatggatcatccggatagattgagatcgcattcttcctatgatagaccaatgatcattaaaaactgatacgtcttacgactatgtttagctttgatgttttctccattttttttatgtttttttatgataatctctcagccgccatcacttccacacaggcaatgctctacagttttattttgcttttaggtaatgccgcatatatatatatatataagttagaacacaaactatagagcagcgaggacccgtagctaaaaggaagacaaattgaaaaatctttcacaaatgagtatagaatatatactttacacaaaacacataagtaaacaataacgtgataagaataggagagcaaatatgggaaagggcttatttcccccatatttggctgctttttaagaaaaagggaaaaagaatgatcataaagtaaatgaagtttcagtggtttaatcacttgatagaataccccagtatttttcaacaccgtattgcccatcatctttccatagatcattgaaggcggtaaataagtaagctgaagagccgcaggagcttttgatagaagaaatggcggcttcttggtttgctttagatgggacagcttcgccgtaagtatcacccttagatggccaaccagtttcggtaataacgacgtcctttttcccaccacaagcagtgtaaaccctttcgatttgttctagtacccatggtcctgcatcttgggccgcagtattttcatcgaagtatgcatgggcgttgacagccatatagtcagaataattacacaggtcagggttatttataacagcaatgaaggtatcaacggaaacgactgagcctgtataaccagcagaggttaaagctgacttggccgtggaaacgtattcaccgacttgcgtcgtagtggcagaaccgccattgaccagttcgttaccgacagaaacagtggtaatatcatcccaggagccataagactcaactgcagatttaatagtatcaacggcgtcttgaattttgtcaacgtaatatatgcctaagaataatttctggcttgaagttttagcttgcaagacattctcaacctgactacagtcaacgccatataatctgatgttgtcaaaaccagtcaactgttctaaatctgaggcgacttgagcagtagatttacaggacccatcatcattgtaaggactgtaagtaatacccttagcaccggaggctgagatactagatgaagcggaggatgaagctgaagatgaagttgaggatgaggatgagggtgaggatgaagtcgaagaaccaaccgtagatgctgcctcggaagattgaagagtgctggtttgttgttgagaagtgacgacattagcggaagttgttggttctaaagtggatgtagttgcttgagaagcaactgcagtactgctggtagtagctacaacagcattctcgttcactggaacaatagtttcgccgctgttaccggaaacgacaacagtaacctgcgcatggactgtggcagtaacaacgtcacgcttttcatgtttatggcgaacagcaggagctcctagagctccggttaataatgcagatacagttaggaaatttgaaaaacgcataatggaatgaagactttttttgcgttaatactatcttttgacaatttgaaaaaaagaacagtaatagtaaaggagagacgtgacagttggatgttcagctcaatattgcaaaagtatagtatttaactcttttatttgggcctatataatagatgaatttaaaatgggaaaaatatgatgcacgcttcaaagatacactgtaagacaaacttcacgcagacatctttccctccattataaatactacagttttgaaacaaacgtggaaaagaaggcttatggatacggctctcgatggagaagttactgtacacatgaaaacacgaataactttcaaacgcgtgcgacgtttgttaccatattcaaacgtttcaacgcgaattttttgtccgctgtttcgcgcaattaaaagtcttggcatttttctcttcaggttttacttcgtccgaaatcttcgaggacttttccgaaaaaggtaaattactgcaaacggtctttcgcgaaatctagaccgaagatctctggggatatgtaaggaacaaatatttttgtcattgagggcttagataaaaagaaaatctagatgtcttgcctgagaaaaagaaagagggaggcattctttcttaattattaccgtgcctggtatcagcataagtgaaggccgagacagctttcgtatatggctgttgcacgtctctgaactaatcattctcgcccatcaagatcggaccatcttgcctagtgcggcaatgatggttaaattatgcgggtaagagttttacatggtcagcggctatttggcgagaaccttcaaaagtaattatgccttctaggatttgccactatacaacttaatcattaagggctgtggaactgcatattgggaaaagaaaaacatactgagaaggaaagttaaggagttgaatatggattttatgagtcccaagttttcgctaactgacgttgagtatcctgcttggtgccaagacgatgaagtcccaataacaatgcaggaaattagagaaatttttgtggagctcatggataagtttggcttccagaaatcttctatggaaaatatgtatcaacatttaatgggacagctggactccagggcaagtcgtacaggtgctcaaaatgctttagtatcgctacatgtttcatatattggaggcgaacacgcaaattatagaaaatggtattttgccgctcagctcgatttagatgaagagatcgggtttcaaaacatgcgactacatggaaaggcacgccaaagaaacgtaaaaatggcgaagaaaagaggcgtatcgataaaggaacaaattaagcaatggaatgagaaggagcaagagttcatcaataaccatccaaagatcacactgactcaagaacaattggaagatcagacaaacttgaaaagtgcagactacaaatggaaattgaaaatgaaaaaattgacgcccgaaaatatgataagacagctggccctttatttgctttgctggggtgaagccaatcaagtcagattcgccccagaatgcctttgctttattttcaaatgtgcacttgattatgatattagtacgtcaagtagcgaaaaaacggtgaaatcacctgagtattcatacttaaatgacgttattactcccttatacgaattcctaaggggccaagtatacaaaaaagacgcaaaggggaactggaaacgaagagaaaaagaccacaagaatattattggttacgacgacatcaatcaattattttggtacccggaaggatttgaacgtattattttaaacaatggagaacgattagttgacaagccattggaggagagatatctttactttaaagacgttgcatggtctaaagtattttataagacatatagagaaaccagaagttggaagcattgttttaccaatttcaatagattctggattatccattttgcaccgttttggttcttcaccacatttaattcccccactttgtacaccaagaattatatacagttattgaataaccagcctacaccccaagttagactatcagtgattgcctttggaggcacaattgcatgtttagttcaaattttagccaccgtgttcgagtggggatttgtacctcgagaatggccaggcgctcagcatttatcgagtagaatgattggcttacttttttgtcttgcaatcaatttgggaccttccgtgtatgttctggggtttttcgaatgggatgttcattcaaaatctgcgtatatcgtgtccatcgtccaactaatcattgcatttttaaccacttttttttttgctgtcagacctttgggcggcttatttcgtccatatttgaataaagacaaaaaacatcggaggtacatctcatcgcaaacctttaccgcttcatttcctaagctgacaggacgcagcaaatggttttcttatgggttatgggtatttgtgtatttggcgaaatatattgagtcctatttttttttgaccttgtccctcagggaccccatcagggtcctctctattatggatttgtccagatgtcaaggtgaatatttgttgggtcctattctatgtaaatggcaagccaaaattacattagttctcatgctgctttctgacttgggcctgttttttctcgacacttacctttggtacattatttgcaactgtattttttccattgtactgtcattttctcttggtacttcaattctcacgccatggaagaatgtatactctcgattgccaaaaaggatatattccaaaatccttgctacttcagagatggatgtaaaatttaaagcaaaaatactgatatcgcaggtttggaatgccattgttatatcaatgtatagggaacatcttctctccattgaacatttacaaagactcttgtttcagcaagttgactccttaatgggagacacaagaaccctgaaatcgcctacatttttcgttgcacaagatgattcaacgttcaagtcaatggaattttttccatcaaattcagaggcaaaaagaaggatatccttttttgcccaatccctggcgacccccatttcagaacctgttccagtggattgtatgccaacttttaccgttttggtaccccattattcagaaaagattctgttgggcttgaaggaaattatcagggaagaatctcctaaaagtaaaatcacggtgcttgagtatttgaagcatctacaccctacagaatgggaatgttttgttaaggataccaaactactaagcatggaaaagagctttttgaaagaggcagagagcagtcatgatgaagatagattggaaattccggatgctctgtacgatccaaggtctagcccgctttctgaccatactgagtcccggaagttgcccacagaagacgatcttattaaggagaaaattaatgatttgccattttcttactttggcttcaactcatcagaaccatcgtacaccctgagaacaagaatctgggcatcattgcggacgcagactttgtaccgaaccctttcagggtttatgaactattccaaagctattaagctactgtatcgaattgaaaacccctctttagttagcttgtatcgtggcaataatgaagcattggagaatgacttagaaaatatggctagcaggaaatttaggatggttgttgctatgcagagatatgcaaaatttaataaggatgaagtggaggcaacagaactacttttaagagcctatccaaatatgtttatatcttaccttttggaagaattagagcaaaatgaatctgagaaaacgtactattcgtgcctgactaatggctatgctgagtttgacgaagaaagtggattaaggaagccaatattcaaaattcgcctgtcgggcaatccaatacttggcgatggaaaatcggataatcagaaccattctattatattttatcgtggtgagtatattcaggtgattgatgcaaaccaagataattatttggaggaatgcctaaagatacggtctgttttaagtgagttcgaagagcttgagcttaatcccacaatcccatacattcctggcattgaatatgaagaagaaccaccgcccatcgctattgttggttcaagagagtatattttttcagaaaatattggagtgttaggtgatattgctgcaggtaaagaacagacttttggaaccttatttgctagaacgttggctgaaattggtggtaaattgcactatgggcatcccgattttctcaatggcatttttatgaccactcgtggtggcctgtctaaggcacaaagaggattgcatttaaacgaggatatatatgctggaatgaacgcaatctgccgtggtggaaagataaaacatagtgattactaccaatgtggtaagggtagagatttgggatttgggtccatcctgaatttcactactaaaataggtgcaggtatgggggaacagctactatcaagggagtactattatttggggacacaacttcccatggatagatttttatcgtttttttatgcacatcctggtttccatctgaataatctttttatttccttttcggttcaactgttcttcgttctgcttttaaacttgggtgcgttgaaccatgaaattatagcctgcttttacgacaaggatgcaccaattacaaatcttgagacacccgttggttgttataatattcagcctgcattgcattgggtatcgatattcgtactatcaatcttcattgttttctttattgcctttgcccctttgctgattcaagaagttttggaaaagggtatttggagagcagcttcaaggttcctacatcatcttctttcaatggccccattatttgaagtattcgtctgccaagtttattcgaattctctattgatggacttgacctttgggggagcaaagtacatatctacaggtcgtgggtttgcaataacacgcctcgatttttttacgctctattccagatttgttaatatatcgatatattctggtttccaagtgttcttcatgttattattcgcgattatttccatgtggcaacccgccttattatggttttggattacagtcatttcgatgtgcttcgcaccttttattttcaatccacatcagttcgcattcatggatttcttcattgattataaaacctttatccactggttattctcaggtaacacgaaatatcaaaaagaatcgtgggcaaactttgtcaagagttctcgatcaagatttacgggctataaaagtaaaactgtagatgatatttccgaagattcaggccatgattcaaagaaagcgaggttttggaacgtcttctttgcagaactatttctacctttctgtgtgttcctcttcaacttcaccgctttttctttcattaatgcacaaacaggggtctctgactcaacaccaactagcgctgttttccgtttgttgctcgtaacttttttgccaatctttcttaactcaatagtgctttttctattattttgggtttcactttttgtggttcctggattgtcatattgttgtaaagacgcaggtgccgtgattgcgtttattgcacacactttctcggttttggtctatcttttagatttcgaactgatgtggttcttacaaggttggaactttacccgtacattgatactgcttattacgtgcatcaatatgcatctgattcttttcaaggtctttacgacgatattcttgacaagggagtataaaaacaataaggcacatttggcatggtggaatggtaaatggtacaatacgggcatgggctggtctatcattttacagcccatacgagaatacttcgtgaagattatggaatctagttattttgcagcagatttctttcttggtcacttcctcttatttatacaaacgcccataatattgttaccatttatcgattactggcatacaatggtgctattttggatgaatccaagaagtattatcgcgcataaaagaattttgactcgaaagcagagagcattaagaagtaggatagtttcaaaatatttctctctatattttgtgatgctaggtgtgctcctttttatgctcatcgcgccattctttgctggtgatttcgtatctagtccgcaagaattgctggaaggcacccttttcgaaggaatcttccaacctaacaaccaaaacaacaacgatactggtccaaatgctccatcgacaatcctgactacaacaccaactttacctacctttaggactgtcgcatagggataaaaaaaaaaagttattttgagtagctgataaagcgagctggtgcctatcatagccggctcagactttttatgaattcacaggccagccctggctattcttttgcgtacttttagttcgatatattttcgcggctcgcgttttgtttgcttcttattttacactgagttttcgtgccgcaaacgtggagatgggaaaaagaaaagtcgggaaaataatgagaaatttctacttttggtattcctcatacagcctgcgcggtttattagtaaaatacccgataatcctcgaggtttgaaaaacttttccctctactactgttgacacggatttttttatttaagaggaaaagtcgtggttgttttcctcgaacaaattagatatccataaatagttgtgtcgttttattaagctatttcaaaatcagtttttatttttaaagtctgataaaacaaaaacaacaaacacagctaaatctcaacaatgttgtttaaatccctttcaaagttagcaaccgctgctgctttttttgctggcgtcgcaactgcggacgatgttccagcgattgaagttgttggtaataagtttttctactccaacaacggtagtcagttctacataagaggtgttgcttatcaggctgataccgctaatgaaactagcggatctactgtcaacgatcctttggccaattatgagagttgttccagagatattccatacctcaaaaaattgaacacaaatgttatccgtgtctacgctatcaataccactctagatcactccgaatgtatgaaggctttgaatgatgctgacatctatgtcatcgctgatttagcagctccagccacctctatcaatagagacgatccaacttggactgttgacttgttcaacagctacaaaaccgttgttgacacttttgctaattacaccaacgttttgggtttcttcgccggtaatgaagttactaacaattacaccaacacagatgcatctgctttcgtgaaggcagctattagagacgtcagacaatacatcagcgacaagaactacagaaaaattccagttggctactcttccaatgatgacgaagataccagagttaagatgactgattatttcgcttgtggtgatgatgatgttaaggctgatttttacggtattaatatgtatgaatggtgtggtaaatctgacttcaaaacttctggttatgctgatagaactgcagaattcaaaaacttatctattcctgttttcttctctgaatacggttgtaacgaagtaacaccaagactatttactgaggttgaagccttgtacggttctaatatgacagatgtctggtctggtggtatcgtatacatgtacttcgaagagactaacaaatacggtttagttagcatcgatggtaatgatgttaaaactttggatgacttcaacaactattcttctgaaatcaacaaaatatcaccaacttccgccaacacaaagtcttacagtgcaacaacaagtgatgttgcttgtccagctactggtaagtactggtccgctgcaacagaattaccaccaactccaaacggaggcttgtgttcatgtatgaatgcagccaatagttgtgttgtttccgatgacgttgattctgatgattacgaaaccttatttaactggatctgtaatgaagtcgactgtagcggtatttcagcaaacggtaccgccggtaagtatggtgcttactctttctgtacaccaaaggaacagctatctttcgttatgaatttgtactacgagaagagtggtggtagcaaatctgactgtagcttcagcggttctgccactctacaaactgccaccacgcaagctagttgctcctccgctttgaaagagattggtagtatgggtaccaactctgcatcaggtagtgttgatttgggttccggaactgaatccagtactgcctcttctaacgcttcggggtcttcttccaagtctaactccggctcttctggttcttccagttcttcttcttcttcttcagcttcatcttcatcttctagcaagaagaatgctgccaccaacgttaaagctaacttagcacaagtggtctttacctccatcatttccttatccattgccgctggtgtcggttttgctttggtttaaaaagcttcgacacatacataataactcgataaggtatggtatcttatttcattgtggggtagtttttacgaaaaaaatgaaaagttgtaagtatagtatatattttttttctatgtaagttttataagattctattcgctattaccaccggtaaattaaaaagaacactattgttacattatatgtttttaaatcatcaaaaaagacaatattcatttaatattccttatagaactacttaacattgttcttctttctattaaacgtctttatgcaaaccatttatgtactttctccataatatcagctggatatctattgaaaattgccatagcatcactagaaggcaaaaatcccaacaactttttaactgaacttatcaccgtttggccttccctttcggtcaaacttctctcattcaaggcttgtatgactgaatcaactacagcggagatattagattgagcacacacaattggcgaattattttcaatcaattgactcaaaaattgatagttgaatgaggcagcttctttgtcagttattgttggtaacgttttgaaccaattagccgtgtacgtgtctacgttaggaatgttggaattgtatgcataaagaattttggcgatggctgcactggcattctctgttgaagaacgattttcttccagtttggagcctggaaaatcgacaatctgaacaagtgtatctaaagtcggtatgcaaacgtcagcatatgtagatggagcgtattgggcacaaacaccgattatataagaagcagcttggcgaatacgagcgtcaggagaaatcaagcactcggtaacctttggaataaatgcgttcttcatgctagcagtttgttcgccaccatattgaatcaagtcaccaatcactactaatgcaaaaatgactaaaattggttcattatctaaaaggaatgtgtttatcataggccatatattctccaaattctttagataatgaccatttgtggttttcaaaacggccgcgatagacttgttgatttcatcgagaagatcttcgtcagtaaagtcttcctcttcatcaatattttcattatattcatcaccatcaccatggcgatcctgcatcctttcgtaagtgtcagttaagttggcggagacacccttagtaaatgccgctaattggtcttcgcttaagcaattgtcacccatgactttaataccattcactaacgagttgtgataaacttgcgtgatttctggcattggttctgacattaagcctccgattagtttagacgaagctttatgccacaacaataccaattcctcgttttgagtaccggtggctgcaagtaaacaagataatagaataggaattaaagttgctcctgcagcacgaacaccgtcatgtaggtaaaagtcaagcgatggtagagctatttcttccattacttctttaacatatacagcaaattggcctcttaaaagtgtcgcatagctttgtaatagctccattgctgatactttatcgtcaaggacggatgtgtgaatagcaatgtgttttccctgaacttgaacaacatcccaatctggatattgttggaaatttgctgcttcttcttcttcaattaaaccgacgtcttgcgttgctttggcagtaattagcaggggtggtataacaatcggtaacaacggaacaaaatcatcacccagaattcggcaaatcctgctccaactttgttctaagtatgatctgagcgcatcatcttcatcgatatctgagttttgtaaagcgaccaatatagaaatcagctcttgagagtgctcatgaaatttttccttaccaacggcaaaaccaatcagagttgcacattccatacatttacctttcaaaacactattatctttattgttaaccttcaaaacatttaataataatggcattagagtatcgtaatacttgataaatttattctttgcagcttcagcaataaatgcaatggttgttagggcctgttcctgtacgtaaagtttgttgctttgtaataaaactaataaatttgtcaatagactatccaagtaaggctcaagaatatccttcgaagcgaattcagaaaagttaaccagagccgctgcggcgtgcgtttgaactcttgaggtgcattctgacgttagtttagatattaaagccggcaaaattctatcgtgtgcagttctttgaatgaatggtgaaaaatcagtagatatttgacccaaaacattacaacatccatactgtactcttggatgaggatcgttgatgaggggaattaccatatccaggatttttgggatctcgccgatcagaacatcagcacaaccctcagctgcagaggaaagtgccatcatggccgcgaatctttctctccattcggttgatgtgatcatttgctgtaaatattggaacaatggtgcagccaaatattcaccacccagctttaaagcaacacgatcaagagcttgacgagcgtggtcatatgtaacttcctcttcatcatcggtatcgtcagattctatccattctgctgcatcatcatcatctatggatacctccgtcatcatgattaaagtaaccatcactaaagtttgcccgtaattctggttcgatttacacatttggggagcgttctcgctgaaaacggttagcagttcgagtgctgtggttcttgctggaggttctaaatccttattttttataaccatatcagtgaattgtattatttggtcaaacatatccttgaatagttttggtgccaattccaccaactcaattaacgattcaaaaactgatgcaagggcatcgtccttaccatcatctaaaaatcttggtaaactattcaaaagacttggtaataaaatacctaacttggaccactcagattttggtagttgcttaaaataacccacgaaagccgtaactgcagcaattttgacattatcacttgcatcagtaaagcctgattgaaaaattggtaagatactgttgatgtcaacagcggtaattaaataaggtacagtcgtcaaaattctaaaactggattctctaaaatttgggttaccgctttttaaagactctattaaagcttgtagtaattctggccatgctggtaagtcgtcttgaacacactcagcaatagcatcagatagtttgtgcctaattgaatcagctctttccgacaaaaacccttttaacaatgaagaacgaatttgtgcaagaacttctttcctaatatgtgtgatatttttggacataatcataagcttcgaagaagggggagcttttaatgctaattttctaaacagaacagcagataatgctgcaactgttgtatcttgggagaaagcggcttgttcagccaaaaaagttaaaagatactcaatattgttttcggtaatccattcttcactaagagccttctcagctacagaacgtatttgattgtcaggggaagcaaacgcctggacaatctgaagtaatgttctattaacttcttccggtaaagcagacatagcgatggctctagttacggttgaaatcacgtgtcgttaggataaagtggcttgcaagctaattacttttgtttgggctatctgccactttgatctactcagtctattagccactcggtatctgaagagcgccgaacttcgatcactgttatagctgtctataatactatagtgattattggaccgtctggtattagtattcccatttttttagtgaatttcatttttctttttttcctgggtagaaaatgaaaaatttttcagtttctgcaaagaattgatatcgtgcgtcatgatgataataccgatttactgcagttcgtacaatttatttttttttttagaatgtcaaacagatagtccatgataggctattggattatttatcaacactcatgatccatatattttgagattatatttgatgaagaaataaagcggcatatcatacttttcttaaagtttaatagtttgtattatattataaagagtgtttacgtaacaaaaaaaactatatatatatttgcttatgtgtaatgtacagtgaagacgattagattcaaaccctaaaactaaaaataaagagatcgctaaaagaatcgaaaaaaaaaaagatgagcaatatcaagaataaaaagcaaaagtgaatatggtttatactctcctgcttagtttccttctatattttttggttgctgatgttattcttctatctacaatgattttttgttaagaatgctttcgaagtagtttttgattttattgatcaacgacgatttgatggtgggttaagacgttctttagcgattttatattctttgttcaattttaccattgcttcttccaatttagtaatttcatcacccttttcgacaacaaagatggtcttctcgtcgtttaatttggctgggatttccaattctgcgataacagattgcaaaacttcaaccaccttattttctggaagatcaaataattcggctagtttagcaacagaaaaacttgaatagaacctcttgaaagaaaagaaataagtcttcaaagattcaacttgtactctttccgttaaactattcaacaccgtttccatgtttggtaataaagcccaagattttatttctcttaagtatttaacagagtctctccagttacctttttgcattgatttggcagcaaacaagacataatctcttaaagtttctggtggaccttggaaacttaacttgtcgtaatgttctaaggaacgacgaatggattttggagagtaaggaattctcttgaccttaataccggaatagaaggcagtcattcttggaatttcgatcaataaggaacatgttaagaagacgacatcgattaaatcgagattgatgtgttggtgatatggcaaacattgtctagcacgctcatcagctgaagcattgttactagaattgagagatattctgtgtagggattgttggcccaaaatttctcttaagtgagaacttgacagaagatcattcaaaatttgatgacattcttcaatcaaacataatttaaaggcggatagacccaattgaacaacaaccctgttgaataaaatttgtagggatgaatcgaattggttgatatttgtttgaacttgggaagttagtaacatatctttagcagtttggaaatctttgtttaatgcagtgtagtaaatgttgtataaaatagcacgtttttgaacagcaatgttgttttgcttggataagattgtcgataatccgtctattaaattgtcgacataatcagcagaatcgagctggtcttttgaagtaaatttagatttgaattgagcaggtatgatattccaagcagcagtttccataatttttatcaaattttcggatttatagtagatatgatccaatctcttgacgaatggacgtgtcaatgctctttctaggtcgtgttcatctttcaaagtcgcttcaaagtacaattgagttcttaggatcaaattatagattgattgttcatcccttaaacggatcaaataatcactggaatgaggatcgatgtttaacagggatttcatgaattcgtcatctaatctttcaacaaatgagaaaatggaacccagaatcctcttgacaccatcagaatcttctttaggttcatcttcaatgaaatcgattggatcagcaaattcattaacttggtaggtgtcaattgtctggtctaaaatagacaataatttactaatatcgttgaatgaagatttccattgatcaattggttggtaagataggttagctgaggcatcgaatcttgatggaatcaaagtcaaataagccattatgaattcatatggtttttcagctacagttaataactcctccaaagtagaaatcaaggattgttgattgacagtcttcttacctcttgagtcaattattgtttgtaatctagtgaagaaatcttcttgtaccgcttggtcattgccttgagacgaagaaattgtgaatccattagcagaaatatccaaatctgcggttggttccttatcaaatgattcaggatcatttctgaatttagccattgagtcttcattttctctagaaactttcttgactctttgctttgtagtgttataagctcttgcaacagctttattcttcaaatcagcttgttgtgtattattcacagcgtcctccacttgggcaacaaccttgatgaaaatatttggagtcccccagttttgttgttgagccctaactaagagacgcgagatcaaatcaaactcattagaaatagtcaaccagtcatcagagttctcagcttgagagatcttattataaacgtcttgcatttcatccaatagtttttctttggcagacttgactaccttcttgccatcttcttcatcggattcttcatcactggaatcatagttagagcttttcaaaaatttatttgaacctccaccttgttttctgaactcagatttcttgaaccagtcaggaccataaggctttgcatcagaatcatcagagtctacatcagcttcactttcactttcactttcattgaaaaaggagtcgtcagattcttggtccaattcagactcagaggaggaagagcttaacaaatcttcttcagacgaagataaaagatcttcttcggatgaagaactggctacatcgtattcgtaattagacgaaaagaaacgggacattttcgtagatctcgggcttggcaggctattgtgtgaagattgcaaatatgtgccttgttctcctttttttccttctatgctactctactaacaagtgcaactgcgaacctgtagctaatttttcattcctttcaaagctctttttctcattgaaaaatttttcaacggcgaaaaaaatgcgaaaaaaaaagcttggtcgtttccaacgagtagaggaaagtgacagtaataataatgattgcgtctctaatatatacgtacttatccattgcatgaaggtaatttgggattaaaatacagttgaaagagttgtcagtgtcatggggattgcatctgcaacgtccgaattggatacggggcatggtagctgagcatcaaagaactcttgaggaccttgacaatctacgaattgatcttgatccagtttgaatgctcgagcaagagtgtcccacgttgagaataccaataagatgtggggattagtttcggcggtaggcagtgatgataactcgggaatagaggtgtctctcgtggttaagggaacatatactgattgtgtataaccctcttttaaaggccccttcataaacaagtctgtgaacgatgacgctatacgagtatagtagccatactgcgagtccaatccggtgaaatcaccgtaagcttcctgaggagatacaattttcctcgttattgtgtcgatggtgacccttgcgtttatcggcaccagctgactttgtagagccagtgctttgcttttccctatattaatatatttggtttgcttgaataccttaccaatctttttgcgagccaaggtgggtttctgcatcttgatagtgaggccttctctgtaccgaccgtgatcttgcttttggtacctggtgaaaggaagtgtggataatcttggtaattttgaagcggcggtcaaataaggtctgaatttttcgttgaagacagtattgcgaagatatggaggcgtgacgaagtattgtaaaagtgccagtattaatttagcagtggagattttttttttggtggcatcgacctgggaattgtcctcaagaatgacaacctcagaaacattaaacagcgatgcaaacttggccacttggtacaccttatgcgtgatttgagagaggttgcgacagtccgataccaatgtcgtggggatacagagtgaataatgtctggtttgtgatagaggtttctcaacctttttgaacttcctcgtgctgctcatcaaactaagtgatacacagctttgtggtcagtagtatatattcctgggaccggtagtagttgtgaaacagagtactctcacttgccgatcacagctcatcgatgggaaatttttcatgtataaaataaagcttgttaaaaaatcagttcgtttcgcgtgataacaaacagtgcatatttatgtaccaagaatccaaaaaataagatatatttagtataggtaaacgttatggaggtgtcatgtttcatggttcttttgtcgtactatcatcttcgtcttcgtcttcgtcctttagcgcttcacgggactttttgttgaaaattgcccttacgtcgtaatgcttctttctcatttcttcaaatttcttatgtctagcctccggtgagtcttcatcattctcgtcgttggtctcaaaatccggttgtttgttctctttgatttcaaattccggttcgcccagggacaaatcgtcgatgtcatcgtttgccacctggcatggttttttatcactattatcctcatcttcatcatcatctactctgtagtattccccgtgagggtccacagcaccttggtagggggtcttgggctcgtctatgtgaatatcttggaactgcttttttgttatttcattttctgctaaatttctttggttccattgaactcgctcttctggtgtcatcttggccaacatgtcttgctcatgtttcagtgacagtgtgtcctttggaaggaaggtactcgatgttccaattatctccccctcctcttttgtattatctagtcccggtatattccttttatgtgatgtcaatttggcatttttctgcgtattttcgtaaacttgtcttctaaactcttcaagcgtttctggatcctgttgcgccagctgctccggcgataaggctagcgggtttttaagtatacctcccattattctgctgatgtgcgttcttgatgatacgaactcgttgtactgatgaagctcttggactttaagttgtagtggtgttctcaaattatcctttcggtggaagtcatttctccctaaaaaagcgtgagggcaaaacttgaaaccgggtaagaatatgcgatagtaccgttttgcctctaaagacagtgcttcagagaaatattagcaaggtgtcgaatcaagttatactagataggaggatttcataatgaataatgctttaaaatggttctcacctttattttatcattttcttcttttcttctgctattgatttggtagtgttcgggttaattcatttttttgttcaataacaagaaccaaacataaaaaaaaatactttaagaataaacaagactgatgaagcatagatcatattattagagcgcgtaaggtatgtagagcacagattggtccttcgagtgtgattatataattttatatacgctccttaatttaaaagcggcttagatagattttttatactttgctgttggaaaattcctgctgaagcaaaagaatttgcaattcgttcttagcctttaaccccaattttaaggctgaagccgtggcttatatcatgggctttgtttatccaacttttcacatctatagtacgctatctttgcatctcttaggcatgaattgataggcgatgagcagaatgaaaaatgaaaaaaaaataaaagtactaaattgaggctagtagaagttaggcaaaaaccgtccagaacctccacaaaaataactaaatacacatttatgggtagtgttcaacgacaagatttggtcctattcagcgaccaatcagtgcttcctgcccactttttccaagacagcaactctcataacttattcttcatcacccatcaatcctgtactcaaccactatggatgataaacgcactagtagaaacgcacgtgttaggttccccaagttcccttaatgaatcttcttcatcgatgctaccttcgtcaactcgctcccatgcagtccttgcgtcgtttatccacgaacagaactattttacaaattcattaaacaagctaaagatcccatctaataactacaatgttttagacttcctgtccgacttcatcgttaataatatccataataagccaagagacaaaatactaagtgacgtactcgcaaagttctccgctgctatacaaaataacccaactgacaccattgttatcatcgaacaaccagaattactgttgtcgctagtaagcggcctaacttgttcagaattaaacaataagttcatcacacctcttttgaggcaatgcaaagtgctaatcattgtttccaattcggacatatttaatatagatgaatacgatgcttctgttcattcctcgaatctgcaaaatttctacaaatcttcctttatcaaatcaatgattaatttgaacttgaatcctctgaagaccggttttgcaaaggacgtaaccggctcattgcacgtttgcaggggcggcgcacccattgcaacttcaaacacaagcctacacgtcgttgaaaatgaatacctatatctgaatgagaaggagtcaacaaaactattttatcgctaaataatgataagattatatacgaggcacattgattctcgtattattgttttttctatgaactgaatatatttttaagtacaatatcaatgaaaaatatatgcaatcgagctctatcaataaaaaaaataagacagaaaaaagtggaaacgatactacctactccgtcttgctcttattatgtcgtctaatttaaattcgactgcacatcttgtcttaattaaagctagtgcgggccatgtacttcgttcaccagattttatccagtatggaatgttgtttagttgaccttcaataatccttgttaatgatagacttttcatccttggtaccacagcaatctccgtagctgatctgggagtcttttcatcaattattagtctttttattaatgagcacaacaggcctaaattatccaatacctccatcctatgtcgaaattccatagtggcaatattttttaattttctttccagatgatacttaaatttaaacgccagcggttccatttcagtaaagttcaactgcggtatgcccaattctgggattatgtactctgctgaatcgttgactgccgaacttgggggcacagggctcattaaaggctctggctcaagatcctcgacagttcctgcctttatgggtgattgcgaagaggatctctgtgtttttcttactgtattcgcgtttataggaggcatatttggataatgcttataatagtaatattttgacgtttttatttcatgcttcaaatcatttaccaccaatggtgccaagtatggtctcgccaaagaaacaatgaagttattaacattgaatagttccgttaacctagtataggggctctccgttatgctcggattgttggcattttctggggtaagaaatttgacttgtttatttttattgatgttaagaaaaggctcaatttcattttctaaatttttacataatagtgatgtatcctctgaaattacaccagaaccaagtgagcattcaatggctgacttgattaatacgtttggggttgtcacataatttagtaaattagggcatgatttatcagttggatgaataacaatattgaaaacttttccagtaatttgataaacttcttcaaaagttttttccttaacaatatatttcataacaaaccggataaaaagataaacgtcttgagaataaccgtggtgtattaggttctgaatcaaagtccccaggtttaggtgctgctctaaattaccgtatccacagctttttaataaatctacatcattcttgatgatattcaagaggttgtcatcggtcaataattgctttagttgctcattggacaagcaaccgaataaacttgcaacgcatgcccccatagagctaccacttataatattaggcatcaggtcctgtaacaataaacctctaatcaccccaaggtgaaacagcccaaacaatgaaccaccttgcaagattaatgctgttgtgcccagtgacaacttacatctttggaaaaaggatgttggagttaaagtttgattatttaatatatccaagccttctagaattcgggtcaaatattgttcaataagtagctttgtacccatcaaagattttgtgaacaactttttatctccaatacccgcaaagttcctcaacatacaagggcctgtagtcgaaaacttctccttaactacatcatacttctcctcccttaacatattttccaatatgctatattgttcaatgacagaattgaagtcgtacctcctcgaaaagaaattccgccgccataaatttgcgcctgttatttcatccactacggacgcttgctgacaccacatttgatacgtatcacactcatctaacttcttaatagcgttataataaatgactcttgagtgtggccgcacatagttaatcagcttttgaacccagaagaaataaatatcggtgatgacatgtagaatttcccacacaaaaggaggtatatggtccaatgtggcatacactacacgcagtatccagtttttcaaaagggtcggtattacagcagacaccttgtattcctgcgccgtttccttcatgcttaacggcaactcaaagatgtgatatatgaatagatgattcccttactattgtgtcatagtacttctctatgtaatcagtactaatttctattagctgctacccagaaaaaaaaaaacataagaaaaaaagggttagggttgaattttcagacctaggataagtatctccgaaattactaaaaacctagtatttattaaaatgccctactaaaaaagtaaaaatgacctataaagaacataccctattatagagtggcaaaattaaaaattcaaaagtatcgtcaaagtatggaaaagaaccaagacgccactacatttaggtagacgtggtgatcaattgaagttcaagagaagtgggtaagaatacattgaactaagccttcatatatttacaaaacatgttcaggaacaattacgacggggacacagtcactttttctcctacaggccgtctgttccaagtggaatacgccttggaagctattaaacaagggagcgtcactgtggggttacgttcgaacactcatgctgttttagtagcgttgaaaagaaatgcagacgaattgtcatcataccagaaaaaaatcatcaaatgtgacgagcacatggggctctcgttagccgggttggctccagatgctagagttttaagtaattatttgagacaacagtgtaattactccagcttagtttttaacagaaagcttgccgtcgagagagcaggtcatttgctttgcgataaagcacagaaaaatacacaatcctatgggggcagaccctacggtgttggtttgttgatcatcgggtatgacaagagcggtgctcatcttttagaattccaaccttccggaaatgtcacagaactatatggtacagctattggcgcaagaagccaaggggcaaagacttatctagagagaactttagacacgtttataaaaattgacgggaacccggatgaactaatcaaagctggcgtcgaggctatcagccagtctctaagggacgaatccttgactgtagacaatctttcaatcgccatcgtgggtaaggatacgccttttacaatttacgatggagaagctgttgctaaatacatctaggtctggacacaaagtatcgtttccactaagcaattgtcaaagcaagaccaaagaagcctttcaccacggtcggggtttttttacatataaagataataatagattaacttagtacgtagtctcacttctcattcaaaattaaaaaagacgtggcttccaaatcaactaataaccccgcttaattccgccctccgccggggaataaacggagttatcccctgttgaaaattcagcatgattatgtatcacaatacataggtgttcgtctataaaaagaactacttattctggataaactttcgaactcgctcaaacctatttgtttctgtacatcgaatagacccataatcacttcttggttccaaaaagtaaagtaatagccaaaaatgtccccattgaacgtcggtatagttggtacaggtatttttgccagagatagacatctcccatcctaccaggaatttcctgacaaattcaaagtcattgccgccttcaacagacataaggcaaaagctttggattttgcaaaggttgctgacatacctgaaaataaggtttacgacaatctagatgaaattttgaatgaccctcatgtcgactacattgacgctttgctacctgctcaatttaatgctgatattgtcgagaaggcagttaaagcaggtaagccagttattttggaaaaaccaattgcggccaacttagaccaagcaaaggagattgtcaagatagcagaatccaccccattgcccgttggtgtggctgaaaattggttatatttaccatgtattaaaatcgcaaaggagcagatcgagaaaattggtcctgtagtagcattcacccacaattctaccggtccatttgttactcaaaataaatatttgaccacaacctggagacaaaaaccagagcacattggcggatttctatctgatggtggtgtccaccaattagctctcgttatttccctactcggtgaatttggatctgtttctgcattaacgagacaggtgcgtgaacgttccggtgcagatgatattgtctttgctactgtccagttgaaaaataaagaggttatcggaagttttacttatgggtctgcctttggtgctaccgaaaagtcggttttcttgaaagtctatggtaagaatggtaccgttaccgttgacttatcagacaaaaaagaccccgttgtaaaagtcaaattagggggttcagctgaagataacggtgacgaacaaatttttaaagtcgataatgatgaaagtttcggcgtcaacgctgaatttttgaattttcacgaagctgtcagcaagaaggacaaatccttatacctaggcacacccagaactgcatttcaccatttggcttgtgtggacgcgtttttaaaatcttctgccaagaatggtgactacgttaaaattgagcagccatgattaccgttttacgatgtaacgcttttttaaccttaatagatagattccctcatatatttataactatgtacccacataagtatacttttggaatgataatactaacgagataaaaaaccgttgaaaaatttctaagttttcttgaactaaaaatagccaaaattctccatccacttgttgttgcaaaatgttacgaaggcgaggttcttggaaatctggatgattatgggaaaattcgttcaacaagaacgccgagcctggacgaaatacttagtcggcatggaactagttatgaatgacttttcctatataagatctacaaccgtttccaattcaccatgagatatatatatgtttaacgaatcaggtactcgtccgaagcatttcgagtaatgcaaccccacaagtgtcccccaagaattcactgggatttttgatgaccgaaagaaagctattgcagctgctacggcgtcctttcatctccctttctttattcacggccttaagagcttgtccgcttcgccccaaaagcctaattgcttagagcatgagagttgaaaacgaccagaagtgtcgttttaggtaagcattcggccataatgaacagtaagtttgtccgaaaaatacaccgctagggttcgataacgaagagcgcatatcaattgcgttgtcgacttaattgctctcttagtacaacggtatgtgtcagtgataaaatcctaccggttccactttttgtgagcgatagatgacggaacgtatgcgcctatttcttttttttggcgcagcaaggacaatggtccctttttgagaaaatgttgtaggcttggccatcggcgtgaacgcatataaaaagaagactgccaacatgacagtatttgaaacaactacagatttggcaaagttcgccaagataaagaagaccgaagcaggtgctaagcttccattaaaagtttttcaagaaaaatctgattatgggttcaataagtagataccttcttaagaaagcagcagatgggcttaaagatgagcagagattgaagattgaaatgtccgatagcaaaagtgtcccagagtgctttcattttaatagggaaagaagaatgcccatagccgagataaacggcgaggatgggtttttcatgtttccgtctcagcaatcgcttgaaaattttgaaaacactaaaaagtattcgaatgagctgagtccagatgcaattggtattccattattccaaattatcaattgcactctaccgtttggtaaaagaggtcatagcaatactgtggtcggcaatgtcccatattataaaattttcaaatttattttaagaacggcagacgaacctccgccttatactgtggcaaaaatcgtttgctcaaacaacggattaatattgtataaagtgcctctttacgacatatataaaaatgtcagccaagcaaacgtaacttacagcttcgtagggactacgtctacggagcccaacttactagcaatggctcaccgagaaggacacagggatttggacactaaagtgaataatttaaatctcaggtggcatgtcacttattcgcccgtagttaccaacgatcattataaattaattctgttagcagattatgaagtgaatcgtttggatgaagatgtcattagagccgctaaaaataagatgtccatcgaccaaaaggatcaaaaagttcagaggttcgtggcagctcattatactagagaatttgaaacatctctttttaggtgggtcgctcaagagggccacttaattcttggcgagtattccacagatcaaggatcatttggattgaataatatcccaccattgacggaagaactcgggtgtcagagcctgctcatacattacatagagtacatgaagagacaacgtaaaaaaattgcgaaagaggcaaggagacaaaataaaagaaacgttgcaaacacgactaacatgaacatgaacctcatgtaacaaaagtttgcgtataataaaccagtatagatgtgtaactgtaatttttaacttatcacaagctcgttcccttcctgcgttgaaaaagcgggacaatgccagaatataaaaaaaagaagaaactttaaaccctgtcatatcttgtccgagatctcgtcgttcttgtttaattgatcttcttcgtatactgccaaaggtgccaaggcacaaaaaagtttaaagtggcacgggctattgcgtcacataaagcccgtagcgcaaaaaagtgatagctgacttcattagatcaccaaaatggaaaaaacttcgtgaagatttctttttatcttcctcacagtttttaacttccgggtgttatactctccgtttgaaaagttgattttgttaactttcctctttccttttggagtaaaaacaatatcctcgataggcaagaccttcctgcaccgctatggcggccattttgatttttctttactgtgggaagcaagaacttgttcaggcgccttcctggataagccatcttttttcaaacagtttcttctatacgataggaaagtcgttggccaatcgattaattaattgaacaataggagccaaataagcaggatatcttctttcgtataccgcctgcctcattattcagaacaaacacgagtgatctgacactatgaagttagcagtaatcctttctaagagaggtggcccaaaattcgaataaaattaactttccttaccatttagcctctatcaaaaaggttctaaaaagtaatatcacacagccgagcctaggacgtcacctctttcctacacagttgacattacttatgtactcaaaaggacgtatgtaccaaggaaagcatagtttttattcaaatcgagttttttattcttatatcctgcttaaaagtggtgattaatgaggaaaaaatgacagcaagaatgaaatagtatgtaatttctttagatttagcggtgcccgtgccttccacgcgcaactgttctctctaatttactattcgctttgaacgtaaaatgtgctttagtttcccagatgtagctcaagtattataccatcttttgcacctactttactaaattcatctcaggtataattgtatcgcatattctattttttttgacatttaatgcaaaattgtgtacctttcgttaaggcgaattttctggaccatgcgcagatctgatccaaaataaactttttttcatgaagctcgtttgcgatcattgcctgtgaatttagcgaaggtgtcagtccacggcgacttagaactcacgtaaaaataagcatcttgctaagactgttcagcagtcaacagtaaagttctgaaaacatgttttcttagtctctatctttgcccatgttcctctcaagtggaacaaagctaaaaatgaaatattaattttatataaagtctcactcacacctgtggtaattttgttccctcagatttgtcaatgattctgtcatagaaaaggtatccacaagaaagggtagcgccgtatcaaaatgggttcatctggttcaaaatcgaccacagccactaccacatcgcatagtagcacgactactactagtagcacaaccagtacaactacgcctactaccactagcacgacaagcacgacaagcactaaagttacaactagcccagaaattattgtcagtagttctagcacattagtttcttctgttgtacccgagtttacttctagctcgtcgctctcctctgatacaattgcctcaattctatcatcggagtcattggtttccattttttcttctctttcttacacatcatccgatatttctagtacatcagtcaacgatgtcgaatcatcaacctctggcccctcaaactcatacagtgcgctttcctccacaaatgcacaactgtccagctccactacagagactgactccataagtagtagtgctattcaaacatcttccccgcaaaccagttcatcaaatggaggtggttcctcttcggagccattgggaaagtcctctgtccttgaaactactgcttcatcttctgatacaactgcagtcacatcctccacatttaccacgcttactgacgtttcatcttctccaaagataagttcctcaggatcggctgtcacttcagttggtactacttccgatgcctcaaaggaagtttttagttcaagcacgtccgatgtttcttccctactatcaagtacttccagccccgcaagctctactatttctgaaaccctaccattttcctctacaattttatccatcacttccagcccagtaagttcagaagctccatcggcaacgtctagctcagtgagttcggaagcttcatcgtcaacatctagctcagtgagttcggaagctccattggcaacgtctagcgtagtgagttcagaagctccatcgtcaacgtctagcgtagtgagttcagaagctccatcgtcaacatctagctcagtgagttccgaaatttcgtcaacaacatctagctcagtaagttcagaagctccattggcaacgtctagcgtagtgagttcagaagctccatcgtcaacatctagctcagtgagttccgaaatttcgtcaacaacatctagctcagtaagttcggaagctccattggcaacgtctagcgtagtgagttcagaagctccatcgtcaacatctagctcagtgagttcagaagctccatcgtcaacatctagctcagtgagttcagaagctccatcgtcaacgtctagctcagtgagttcggaaatttcgtcaacaaaatctagcgtaatgagttcagaagtttcatcggcaacgtctagcctagtgagttcggaagctccatcggcaatttccagcttagcaagttctagactgtttagctctaaaaatacatcagttacttctactttggttgctacagaagcttcgtcagtaacttctagcctaagaccttctagtgagacattagcaagcaattcaatcattgaaagctctttgtcgacgggttacaattcgaccgtttctaccacaacatccgccgcatctagtacacttggatctaaggtttcgtcaagtaattccagaatggccacttccaaaacctcatctacttcctccgacttgagtaagtctagtgtaatattcggcaatagttctaccgttacaacctctccatcagcgtctatcagtttaaccgcatctccacttccatcggtctggtctgatatcacctcttcggaagcttcatcaatttcctctaacctggctagctccagtgcgccatctgacaataattccaccattgcaagtgcctcgctgattgtcaccaaaacaaaaaactcagtcgtttcatcaattgtctctagtataacttcttctgaaactacaaacgaatccaatttggccacatctagtacatcgcttttgagtaataaagctactgcccgttctttatcaacatccaacgctacaagtgcttctaacgttccaacaggcacatttagctccatgagctctcatacttcggtgataactcccggcttttccaccagtagtgcgtcactcgcaattaattcaactgtcgttagctcatcattggcaggttatagtttctcgacacctgaaagctctccaactacttccactttggttacttcagaggctccttcaaccgtttccagtatgaccacaagtgccccatttataaataattctacctctgctagaccttcgccaagtacagctagtttcattactgaatccacttcaagcatttccagcgtgccattagcgagtggcgacgtcacttcctcattagcggcccacaatttaactactttcagtgctccttcaacatccagtgcacaacttgtaagcaaatcaactacctctagctccatcctggtcacacccagaatcgacaggtctggaaattcctcaactgcctctagaattgcaacatcactccctaacaaaactacatttgtttcttccctaagttcaacatccgctcatgccagaaatatctttaattcaactgttctagctactgctaaacaaattgaaactttaacttcaacagtcaattgcagcaaccctactcctaattacaacataaccaaaacagtaatcgtaagtagggagactactgccataggaactgttacaagttgttcgggtggttgcaccaagaatagaaagtcaaccacacttattactataacagatattgatgcttctactgttactacttgcccagaaaaagaagtaacatcgaccacaagtggagatgaggcagaacataccactagcactaaaataagtaatttcgaaacgtccacgttttcggaaagttttaaggatatgaagacttctcaggaaactaaaaaagctaaaccaggatcagaaacggtgaggagctcgtcatcttttgtcgaaaaaacctcaccaacaacaaaggcttctccatcaacttccccatcagaaagtaaagctgcaggaaatacatccgttgcaacgaatgcttcaccatcaacttccccatcagaaagtcaaggtacaggaagcacatctgtagagggagcaaaaagcaagtcaactaaaaattcagaaggagtatcaaccactaaagcgaaaaacacatcaactgttgcgaaatcttcaactgaaagtccgatcgggaggggtgaaactacccttgaaacgataattgtctcgagccaaaagtcgctattaacatcacaactaagttcatccactgaaaaggtaaacagatctaccaccaaacctacggcagcgattcatggaacatcctcatccgctaaacaaagcacaacatatactgtcagcacggcaaaagaaaataccggtgcatccctgaacattaacatgaaagcttttgttattggcgctattgctttggtagcttagtaatatagttattgtccgataccctatgaacgtgcaccttttttgttagtgtattgatatgtgtttcttttcaccttaaaggtgcttagcaaggagaaaaagagaaaaaacaaaagagaactgtacgagttgtaaatatttaaatagtaccttataatcataaaaaaaagtttcaaatgtaacctatatcgattaaaacagcactcctatatacagacccaaaacatggagcagttaaaaagaaaggagctacatttatcaagagcttgacaacctagtctgaaaattctttgtcgtagccgactaaggtaaatctatatctaacgtcacccttttccatcctttcgaaggcttcatggacgccggcttcaccaacaggtaatgtttccacccaaattttgatatctttttcagagactaatttcaagagttggttcaattctttgatggaacctaaagcactgtaagaaatggagacagcctttaagccatatggctttagcgataacatttcgtgttgttctggtatagagattgagacaattctaccaccaaccttcatagcctttggcataatgttgaagtcaatgtcggtaagggaggaagcacagactacaatcaggtcgaaggtgtcaaagtacttttcaccccaatcaccttcttctaatgtagcaatgtagtgatcggcgcccatcttcattgcatcttctctttttctcgaagaacgagaaataacatacgtctctgcccccatggctttggaaatcaatgtacccatactgccgataccaccaagaccaactataccaacttttttacctggaccgcaaccgttacgaaccaatggagagtacacagtcaaaccaccacataatagtggagcagccaaatgtgatggaatattctctgggataggcaccacaaaatgttcatgaactctgacgtagtttgcatagccaccctgcgacacatagccgtcttcataaggctgactgtatgtggtaacaaacttggtgcagtatggttcattatcattcttacaacggtcacattccaagcatgaaaagacttgagcacctacaccaacacgttgaccgactttcaacccactgtttgacttgggccctagcttgacaactttaccaacgatttcatgaccaacgactagcggcatcttcatattgccccaatgaccagctgcacaatgaatatcactaccgcagacaccacatgcttcgatcttaatgtcaatgtcatgatcgtaaaatggttttgggtcatactttgtcttctttgggtttttccaatcttcgtgtgattgaatagcgataccttcaaatttctcaggataagacatgattttggcttttcttgttgttgtgttgaatttcttcctcgaatgtggatgtgaaagtctgtcgcaaatctattaaattagattgaattggccgaatttatacagaagattgacggcacttcacctcgagaactgttggtgcttttttgcctttcacttttctttttctcctatattgtcgtatcgcttccagatgtgaaaaattggcaatgtgatcttcggtcaaggacggaccggacatataagcggagcggggaatctttagtcagcaatggaagttcacacagtagagacacaaattgtgtcacagtatatcacccatttactgtaaaaagataaaaagaccagtaaatgtaacggaaaaccattcattttaacggagccgtgacgagagtggctgtgatcggaattccacgtcaaggtcctggaagacggggatcggggactaaaaaagagcgtcgaaagtatccagtacgtcattaccaagttgaaaatgaaaaaagatcaattagccacattttatcctggatttattatctattatatatcattttaaatggtttaggctcccagagaaaaaagcaaaactcaggtgaggtatatgtacaaactaaataaaagttctaaggtcgatcgctacctccgtatagaaattcctaaaatccctaaggaaaattaactccctcataagtaacatgaggaattcttcccactaatgctaaaatgttcaatgaagctatttttccaacatcataacctctgggaaacgcttttctacgtatgatagaagtatgcgcctacgtgcgtacaaagcggtaacctccactcttctttgacgatcggcccaattatgtgcttgcaacaaaactagcaagaaaaattcttcgataatcatagttggcgtgttagcaatcaattgacctgttgtactccaacgcaaaccggaagcaatacaaattaaaccaatgatgatgatgacggatacaagaacactccatggagttgagcagatcctattaatatattgggatgttctgtaaccaatagtgttaatttcaggagctttaccactaaattcttcgggacattcaatacctaattcttggaataattcaaggtcttctttagccacatcagaataatttttctcttcatgttgaacgattcggaagtacacttctctcaaaacgaaaccgtccaaaaacccaattaaacctgtgtatgtaccgataatcaaccaccaattatcatcccacttcattggcgaaccaataccaatccatgtggcgaacactgccacaccaatcaggacaccaataccagtaccaataatatcagcataccaatcaatcatctttctccctgtcgacctttttttagattcaatagtaacaactgggtgaggtgtttcaaaatcgttaaaatgctttcttatacgatagtcgattttctcgtccatatcaaagatatcaactaaaaacctccccgtgaaataatcatgtctagcccttatattttgtaagaaagtagtgcaaattagaagggaaactgcaactgcagtgttaatatacatctgccaagcgtcactgaactttttcaatcttggattactacctgtagtttctccggtgtaaggtggagtgttgcccgcatcttttgggatagcaccgcaaccaatccaaacgaaaatacctatccaaaatatcaccattgctgcaattgaacccatatacctacttgctacgttagataaacggtcgtaccaattttccacaggcagttctccgttaatggcagatgggtctatatgattttcaacagagctgacttcattagcttcaactgtgcagtctgctttttcttcctctggggtgcttcttgttagatagtttttgaaggaagccaatctcgacttcaatctaccgcagatcaaaatttgttcatgcgtactcatcaactgttgtctcatcaacagtgtgtcccaaacataactttgaatagactgtccgtcctgcataacaacttgccaattgaaaggtgcgttataaacaataccaataaccacccaaattatgaggatgatccaaacaataaaaaaaaccgcctgcgaaccggccactcgtaccaggaaatccagggtcttatctgtgaaacctttgcttaacccggtaaaacctttactcgtgaagattgcccctgtttctgttaaattcacattacaaagttcgtcatcagtactctcatcgctatggctgactactctgaccacatcatcatttttgtaatcgttagaatcaccgaattcttcgtactgtttgcagtcaacagtaggtgctctatgatgaacgtcaggcctagcacctggattcccgagaaactctgcaattttacccataatttgattaacgaatgtttaataataagggtcttattaggtttctatatctaccttttcccttcttatatctgatactgtttgacttatgataaaagaaacttacttacctatcaattaattcatgccgtgtgaagtatatttatataaacaagtatttctaaatgaagagcatcgaatcaagatgtggtagatgctaaactaatgggtgcaattaagaaggcttctaccaagcaagttcaaggccagtagcattatatagtttttttgtctttatttttttttttggtttttttttttttcgtttgagaaaaatgctgcttcctaaaaagactcagcaaaaatgctcatgacctaatcagtttcgagagcaaccccacgggtaggaaagaaagaggcgccaacgttaaaggaaactgcccatatctaatacataaccgcacaagctccaagctcattcaacacctgtgtgatttacgccccaataaggctcaagattcctcaatattttgtcgttgttcgagccatgaaaacctcaaattactgctacaggaccctagggtctcgctaaaaaaatgactacgcgcgcttatataattactcgaataagacaaaagaaaaaaacccttgcgatatgtcgtagacacgtaaaaatggcccatttagtggtagtcgcaaactagaggggtaaaaataacctgtccagtactgaaagtaatgctagggaaatgcgaatgaccgtacgtacaccttcgtacatgcaggtatttagggggcttattgtttatgaacaatagcactatgccaggtcaaacatatcatgttcgcgcagtctcctcgtgggatatataaagtgaacaaaaagtgcacccggttttcggaacaacgctcttcgcaacaaggcaaaaaagaaaaatgggacaacgtaatcggagaatacccaaaggacattataatccaatcaacgtagtagtacgtatggttagaacagcaagcacagatatttgctcatatgcaaggaaactggtgtgattagaatgccttaaacatgagtccaatgtatgcgaataagatgctacgttgaataagcagatcaaagaacttttggtaggaaaagcttctttttttaaaagcgcacgtttctttttctttgttggaccttccatcaaaatccttaatacgtgcagcgaagcagcaacgcattgacagttcatacaggaaagaggaacaaatattttgagctgcttgtcccaggaatctaggtgcttacgtatcttttattttatttaaatgtatgatcttacccacgataatggtcttagtactttagtttggcaatgatggaaccggaggacaacggacaaaagttagggtatctttactctgtcactgcgtattttttgaaatacactatttttacaaggagttaagcataacaagcacgtgctgcagatgttttcatttagtgagtgaagatctttattcaagtaattcatcttcatccgtataacttcttagtaaagcgacaaggtctgatggccgaatttttttaattttggccatcgtattaaaatgaacactctaaagccgaaatgagaaagatctcgctaatagtaggttaggactcaatggctaggttatatttttgccttcgtgagagtaatttacgtcgagtaatgtcgcctgacatccatatccctttgttattcttcattaaatgtcactacaaattctgtccttactgaagtaaagaatatttgaaaatactacactgatctttaattactgatctacaataacacacagtgttgaaggataattccaagactctcacctgcgactggtcgtgttaggaaaccaaactgaaatatgctaaatttcgagtgaaacctaccggaatcggtacatctccagaggattttaagtgaagatttaacatcgtataacaagcatgcataacttgtcactgggataaagagaaggtactaaattttcgtaggcgacaattttccatctcatagagtactcgaagaaaaacataaacactattaaaaatagctcctagtaaaggctttttggattctaattcaagtttacaaatacctaccaacaacattcttgatattgtaatctgctctgaagtagataccctaacgggattgttaagtcagggagcagcgtaacgacattcacgaaaagctctaaaaatgcgtagatttggaaagccatgtattgtttcacatgaaatttcggccaggcctcacatattacagccttgtaattataagatggtgctgagttgtaaggtaaaaaaacccattgagttattgcaccttcaagagttaatactttacacttttatgaaaatttgccttcacgtaaacttgatccagcaaaacatcaataagttgtcatatatttctcgaaaatatccaagggcacctgcttttatcagctgcgacaatagagccacggagccaacaaaaaaaggctttttagtttgccgcatgtaatgattggcgaataatttttcaaggttatgattgttcttgggaacacagatcacggaatccttttgccaataatacattagatggaatatttggatacaactttcgaatataacgccttttgagctagcaatatcgactgtatgggaatataaaagttaattttaggcaatttaattaatcgtgactggtcggagaaggcgagattgtagctccaccatgtgaggattattggcaaaggtttagatccggtggagatttatcttcttttaccccatcttacttgtgcactctcccaaattcccatctgatgaactgttagttgattcctttagattataaaacatatgatgtttactctgttttttgtcggcgaagtacggaaaagcatttgtgactctaaaaaaacatggcaaggataattaattaacaatacttcttgtgctgtttataaaatgtatttagtgtaacatgctgcttcctagcatatgtataatgttaagaattttccagtttctttaaaaaggcatttacgtgtatttcttgacggctgcagaaatctcttggatgtcttttggacttgttctgcaacaaccaccaatgatacgggcaccgctgctaatgtactgtttaacaaccgtatcccaactgttcagcttatcgctatttggcaaccatatcttcttttcagtatcataaacttcaccactgtttggataagcaagcaaggccatatttggcagtgcttgatgtagagactcaagaatgtcgggtgattggttgaagctgacgcagttgattcctaagaacgagaggttaggatttattttgtcgcccaagtccatcatctatttactacgaaacgataaatttccccgttttcttttacttttacttcatttaatataattcatatttatttcccatgtaccaattaattactcctaaaagaacagaaatagaaaaaagttgtatataacaagccaaaaaaaaaaaagaaaaaaggaaacacagcttatttcaaattgcaatctgcgtatttcgtaagtaacgaatgatctcacagcattgctttttttttttttttttttatatatatgtacattacctatgtcacatatgaccatgatgagtacaacactaaaaaccaaggcctactattcaattgttctctatatgatttccattctagcaaaatcgagtgctaccgatctgccgttttctttacctttcgaaccattgagctgttagccttctcttcacagaaactgaaggccattagaagcctccccttcaacaattcccttgtcttttgtttcagctatataatgcgtttatagctctaattgtggtcgaataggaagaatttgcgttaacacccgtaactagctttccatcggtaatagagtagtcatcccagggatgaattggcgccaagtacttggctctattcttgtttgcaacgcgttcaaccgttgtcaattttctgctcctcaagatgtcgtcaactcccagggcgatttcaccctcgagtgggaaacctgttatagctttgccttcgattaatggtcttgttgttttgatatctattaatccatcgaaaaggagcggtccatgacagatggcggcgatcacacccccattggcatatatcttggatgcaatatcttgcagatttttagctttgggatagtcaaatagagcaccatgtccagcagatgcaaagaatattttatagtcgctggcgttgacttcatttgcggtcttgatcctcgctaacgccttattgaaggcggaatttttcgtttcaaagttcatcttatcttcgccaccaataaagctctttggcaagtaatgttcatcccagccaaatccaccagtctcagaaacgaagtccacttcgaaaccatgcttttcgaaagtatcgaacgaccgcaaaatctcaactacaaaaacgcctgttttcgcaccatctttatagaagggaccgtggtatgaagtaagagatattagcgctctttttggagtcattgcaaggccagttttctttttgaatgaaggagaaaagtgttctagaaatatgttttagttctaagtatcgttgtctggagcaagcaaagaaaagcagacctgtatgtgcaactttcttgttttccattaaaatctcaagaaccggccccttgactgtgctcatatatcaagtatcggttttaaagtcccctaattgtgataattgcaagaatgacagtcaaaaagatatttttcttttctttctttttacctatccttcatgaaaatacctatgctgatactgaatatcttcatttgcagctatgcaatatttcagatactgcattttacccaagagtttctttactggtggttggattttttttaagacgagaagattaccagtcctggatgttcatgaatgtgcctattgcgtcatcagcgactccgcgccaagaaaagaaatactcgcatgctcggatttatagaatcgcataatggaaatagcttccttaaaggatggagataaggaaaaaatgacaagaacaaggaagtacttgggagctttctccgacatgttaaatatttgaaactcacgcagctctcctggaaagttgcatctggaaaggtaaggttgttttttgttcagacatcaaaatcggctcttgtagacaatgtcacagatccacaagttgaaaaaaaagtttcgatgaactggataaggggagaggtcacaaacaaagtgtagggggtgagtagtatagtggtaacttgttcatttacctaaataacattctcactagaaaagagatattgaaagactcctcgtttacctaacttggctggttcttaggtatataatagaaacatggatctggcaggttattacttacagtttgcattcccaccaggtaacaattttcattatatatagttattttttaccaccacttcttcttctttcactttgtcttgcaatagaaataccaaaacaaggtgaggaaaaaatcgaatctcaacgataaaaatatgtccatcacgaaggtacatgctagaacggtgtatgattctcgcggtaatccgactgttgaggttgaaattacaacagagaatggtctcttcagagcgatcgtcccatctggtgcctccaccggcattcacgaagctgttgaacttagagacgggaacaagtccgaatggatgggaaaaggggtgaccaaggcagtcagtaacgtcaatagtatcatagggcctgctttaatcaagtccgacttatgtgtaaccaatcagaagggcatagacgagctcatgatatcgttagacggaacttctaacaagtcaaggttgggcgccaatgctatccttggtgtttccttgtgcgttgctcgagctgctgccgcacaaaagggaattactctctacaagtatatagccgagttagcggatgctagacaggacccctttgttattcctgttccttttttcaatgttttgaatggtggagcccacgccggtggctctttagctatgcaagaattcaagatcgcgccagtcggggctcagagctttgcagaagccatgaggatgggttcggaggtttaccatcatttgaagatattggcgaaggagcaatatggaccttccgctggaaatgttggtgacgagggtggagtcgcccccgatatcgacactgccgaggacgccttggacatgattgtgaaagccattaacatatgcggttacgagggtagagtgaaagtaggaatcgatagtgctccttctgttttttataaggacgggaaatacgacctaaatttcaaggaaccgaactctgacccatctcactggctcagtccagctcagttagcagaatattatcattcattgctaaagaaatacccaatcatttccctggaagacccctacgccgaagatgattggtcctcgtggtctgccttcctaaagactgtcaatgttcagataattgcagatgacctgacatgcaccaacaagaccaggatcgcccgtgctatagaggagaaatgtgcgaatactctgttgctgaaactcaaccagatcggtactctgactgagtctattgaagccgccaatcaggctttcgatgctggatggggtgtaatgatatcacatagatcaggtgaaaccgaagatccgtttatcgctgatttggtcgttggtttaagatgtggtcaaattaaatcgggcgctttgtcgagatcagaaagactggccaagtataatgaacttttgcgtatcgaagaggaactgggggacgattgtatatatgctggtcataggtttcatgatggaaacaaactataaaggattgtcttgtttccttttttttttttttgtttttttatgactaaataaagtaaatcatatgaggttttattttttatttcgttgatttgggttacagtatggaaatggggcatttgacacaagttattttattcatatgttttatcttgtaggaaatcaaaccgtttttaaagttttccattgcctacacacaaaatcattacgaatctgtctgaacaagggtggacgtgtgggggaaggctgttccaatcaagaaatgcttacaactctactaacactgcagtttttcagctttctgattaatctcttcggtttaaattttttagcagctattactttctagtaacccttataacgcggttggtatcaaatcttcctgatagtacaagcagacctttgaccccattcttgttgtgtcttgaaatctttttttctgacaaaagtaagaagttacaccataatagagaagttaaataatgaaagtgtatcgatcatagaaatgatttcatttttttcaactactgttacggtcaagaaactaataatgaggataagttttcgcaacaatgattttggtgcaagtgatttaaagtcttgaattacttcaacacaatttgctttgcgacggtttagaataacgtaatcgtatcagcgaatccactaggcgcgcgtaaaaattacagactctaacaatatacgactcccagcacatatctactattctgtacaattccgggaaatagagggtacagtattattttttctcggcgatcgtttagggtatactggagataggcttagcaatacgcttctgaacgaggatctatagcaactaaattcagacattctgctacaccaaaaatggaagtatcacaggaacggaaaagggttttataaggcacctcggcacccctataactggcattctcacattcggcgcatacgaatagacaaaggccccagaaaacaataccttcgcatacagaatctataaagatgcatgcctcgtttaaaaacaagaacatcttcatagtgatcatgaaattgtgtgaaagatgagatatgtaatgcgtgaggtactaaatgaggatatgttaacgaatcgtttaagtggtgatgaccaatgaaggaataggtataaatagagatacttcaactatatgcctttgagaatatgtctttattccttcccttcctgttaagcttatatcagcactaacaaacaaaacaaatacaatggtcaaattaacttcaatcgctgccggtgttgccgccatcgctgccggtgttgccgctgctccagccactaccactctatctccatctgacgaaagagtcaacttggtcgaattgggtgtttacgtctccgatatcagagctcatttggctcaatactacttgtttcaagcagctcatccaactgagacctacccagttgagattgctgaagctgttttcaactatggtgacttcaccaccatgttgactggtattccagctgaacaagtcaccagagtcatcactggtgtcccatggtactccactagattgagaccagctatttccagtgctctatctaaggacggtatctacactgctattccaaaatagagagaagcttttacgaacgaaattccatagacaataaaaaagtaaagagaatgaaataaaatatgttattctattgatataaatacaattcctcatatgtaaatgtatattaatatgacaactcatttttgatcaataacagtgtttgtggagcattttctgaatacaataaacccaaaacagaaacttcccttttgtatcactgttctggaaaaggggtgggcggtaataaagctaatagggtgtgtccataagtaatactgaacttggaaatgtgcggctttgcagcattttgtctttctataaaaatgtgtcgttcctttttttcattttttggcgcgtcgcctcggggtcgtatagaatatgcgtcacttttaaaaataagattgcagatcagggcaaaacaagtagcaaatcatagcaagagaccctgatttttgtgacataaatatttttacttctgtgttaggttaactttttatgtaactgtaaatggaatagagttgaggggatagtgcccacaagtcaatatgtttattttgtaaagttgaaagataattatttttatgtttaggtgattttggtgttgaattttctgtaatattaacataagagtaatacattgagtggttagtatatggtgtaaaagtggtataacgcatgtattaagagcagttatacaatatttggggccgctgaatgagatatagatattaaaatgtggataatcatgggctttatgggtaaatggaacagggtatagaccactgaggcaagtgccgtgcataatgatatgagtgcatctagtactgatttagtgagagatgggccgtggagtggaatgtgagagtagggtaagttgagagtggtatatacttgtagcatccgtgtgcgtatgccatatcagtatacaagtgaaggtgagtatggcaagtggtggtgggattggtataaagtggtagggtaagtatgtgtgtattatttacgatcatttgttaacgtttcaatatggtaggtagaagaacagtatggtgagtagcagatggtggatggtagaggaatagcagggtaagtggtagtggagttggatatgggtaattggagggtaacggttatggtgcacgatgggttggtggtagcaagtagagagatggatggtggttggagcggtatggttgaaggggacagggtaacgagtggggaggtagcgtaatggagggtaagttaagagacatgctaaatcagggtaagaatagggtagggttagggtagggttagggtagtgttagggtgtgggtgtggtgtgtgtgtgtgggtgtggtgtgggtgtgggtgtggtgtgtgggtgtggtgtgtgggtgtgtgtgggtgtggtgtggtgtgtgggtgtggtgtgggtgtggtgtgtgtgtgggg
